(12) United States Patent
Riechmann et al.

(10) Patent No.: US 8,110,725 B2
(45) Date of Patent: Feb. 7, 2012

(54) POLYNUCLEOTIDES AND POLYPEPTIDES IN PLANTS

(75) Inventors: Jose Luis Riechmann, Barcelona (ES); Jacqueline E. Heard, Webster Groves, MO (US); Oliver Ratcliffe, Oakland, CA (US); T. Lynne Reuber, San Mateo, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 293 days.

(21) Appl. No.: 12/338,024

(22) Filed: Dec. 18, 2008

(65) Prior Publication Data

US 2009/0276912 A1 Nov. 5, 2009

Related U.S. Application Data

(60) Division of application No. 10/374,780, filed on Feb. 25, 2003, now Pat. No. 7,511,190, which is a continuation-in-part of application No. 09/934,455, filed on Aug. 22, 2001, now abandoned, which is a continuation-in-part of application No. 09/837,944, filed on Apr. 18, 2001, now abandoned, said application No. 10/374,780 is a continuation-in-part of application No. 10/225,068, filed on Aug. 9, 2002, now Pat. No. 7,193,129, and a continuation-in-part of application No. 09/837,944, and a continuation-in-part of application No. 10/171,468, filed on Jun. 14, 2002, now abandoned, said application No. 10/374,780 and a continuation-in-part of application No. 10/225,066, filed on Aug. 9, 2002, now Pat. No. 7,238,860, and a continuation-in-part of application No. 10/171,468, is a continuation-in-part of application No. 09/837,944, said application No. 10/374,780 is a continuation-in-part of application No. 10/225,067, filed on Aug. 9, 2002, now Pat. No. 7,135,616, and a continuation-in-part of application No. 09/837,944, and a continuation-in-part of application No. 10/171,468, said application No. 10/374,780 and a continuation-in-part of application No. 09/934,455, and a continuation-in-part of application No. 09/713,994, filed on Nov. 16, 2000, now abandoned.

(60) Provisional application No. 60/310,847, filed on Aug. 9, 2001, provisional application No. 60/336,049, filed on Nov. 19, 2001, provisional application No. 60/338,692, filed on Dec. 11, 2001, provisional application No. 60/227,439, filed on Aug. 22, 2000.

(51) Int. Cl.
*C12N 15/82* (2006.01)
*A01H 5/00* (2006.01)
*A01H 5/10* (2006.01)

(52) U.S. Cl. .......................... 800/278; 800/298; 800/287

(58) Field of Classification Search ........................ None
See application file for complete search history.

(56) References Cited

U.S. PATENT DOCUMENTS 7,635,800 B2 * 12/2009 Ratcliffe et al. .............. 800/290

OTHER PUBLICATIONS

Miao et al (2004, Plant Molecular Biology 55:853-867).*
McConnell et al, Nature 411 (6838):709-713, 2001.*
Bowie et al, Science 247:1306-1310, 1990.*

* cited by examiner

*Primary Examiner* — Stuart F. Baum
(74) *Attorney, Agent, or Firm* — Jeffrey M. Libby; Yifan Mao

(57) ABSTRACT

The invention relates to plant transcription factor polypeptides, polynucleotides that encode them, homologs from a variety of plant species, and methods of using the polynucleotides and polypeptides to produce transgenic plants having advantageous properties compared to a reference plant. Sequence information related to these polynucleotides and polypeptides can also be used in bioinformatic search methods and is also disclosed.

15 Claims, 14 Drawing Sheets

```
                                   10                  20                  30
SEQ ID NO 148       M D N H R R T K Q P K - - - - - - - - T N S I V T S S S E E
SEQ ID NO 1972    M F R S D K A E K M D K R - - - R R R Q S K A K A S C S E E
SEQ ID NO 38        M D N T N R L R L R R G P S L R Q T K F T R S R Y D S E E
SEQ ID NO 2142      M D N T D R R R R R K Q - - - - - - - - - H K I A L H D S E
SEQ ID NO 1084      M S T T - - - - - - - - - - - - - - - - - - A T T T S E E
SEQ ID NO 1085      M A D I D R S F D N N - - - - - - - - - - - - V S A V S T E
SEQ ID NO 1086      M A D I D R S F D N N - - - - - - - - - - - - V S A V S T E
SEQ ID NO 1083      M T D I D R S S D N - - - - - - - - - - - - - V S S D S I E
SEQ ID NO 1087      M A D S D L S S S Q - - - - - - - - - - - - - I S T H S T D
SEQ ID NO 1088      M A D S D R S S S E - - - - - - - - - - - - - V S T H S T D
SEQ ID NO 559       M D S S S G S - Q G K N S K T - - - - - - S D G C E T K E
SEQ ID NO 1082      M E S S G G S Q L G K N S K T - - - - - - S D G R E T K E
SEQ ID NO 1081      M D S S S G S - Q G K N S K T - - - - - - S D G C E T K E
SEQ ID NO 1089      M D S S S G S - Q D K K F R D - - - - - - N D R P E A K E
SEQ ID NO 1090                  M - Q L Y P F T - - - - - - - - - - - I I A E
                    M     .     S     .                             .   S   E 40                  50                  60
SEQ ID NO 148       V S S L E W E V V N M S Q E E E D L V S R M H K L V G D R W
SEQ ID NO 1972      V S S I E W E A V K M S E E E D L I S R M Y K L V G D R W
SEQ ID NO 38        V S S I E W E F I S M T E Q E E D L I S R M Y R L V G N R W
SEQ ID NO 2142      V S S I E W E F I N M T E Q E E D L I F R M Y R L V G D R W
SEQ ID NO 1084      V S S N E W K V I H M S E Q E E D L I R R M Y K L V G D K W
SEQ ID NO 1085      K S S Q - V S D V E F S E A E E I L I A M V Y N L A G E R W
SEQ ID NO 1086      K S S Q - V S D V E F S E A E E I L I A M V Y N L V G E R W
SEQ ID NO 1083      K S S Q - V S D V E F S E A E E I L I A M V Y N L V G E R W
SEQ ID NO 1087      S G N R G S S K V E F S E D E E T L I I R M Y K L V G E R W
SEQ ID NO 1088      S G K R G S S K V E F S E D E E T L I I R M Y K L V G E R W
SEQ ID NO 559       V N N T A Q N F V H F T E E E E D L V F R M H R L V G N R W
SEQ ID NO 1082      V N S T A Q N F V H F T E E E E D I V F R M H R L V G N R W
SEQ ID NO 1081      V N N T A Q N F V H F T E E E E D L V F R M H R L V G N R W
SEQ ID NO 1089      A N S T A Q H L V D F T E A E E D L V S R M H R L V G N R W
SEQ ID NO 1090      A N S T A Q H L V D F T E A E E D L V S R M H R L V G N R W
                    V S S             V   F S E   E E D L I   R M Y . L V G . R W 70                  80                  90
SEQ ID NO 148       E L I A G R I P G R T A G E I E R F W V M K N
SEQ ID NO 1972      E L I A G R I P G R T P E E I E R Y W L M K H G V V F A N R
SEQ ID NO 38        D L I A G R V V G R K A N E I E R Y W I M R N S D Y F S H K
SEQ ID NO 2142      D L I A G R V P G R Q P E E I E R Y W I M R N S E G F A D K
SEQ ID NO 1084      N L I A G R I P G R K A E E I E R F W I M R H G D A F S V K
SEQ ID NO 1085      S L I A G R I P G R T A E E I E K Y W T S R F S - T S Q
SEQ ID NO 1086      S L I A G R I P G R T A E E I E K Y W T S R F S - T S Q
SEQ ID NO 1083      S L I A G R I P G R T A E E I E K Y W T S R F S - T S Q
SEQ ID NO 1087      S I I A G R I P G R T A E E I E K Y W T S R F S G S S E
SEQ ID NO 1088      S L I A G R I P G R T A E E I E K Y W T S R F S G S S E
SEQ ID NO 559       E L I A G R I P G R T A K E V E M F W A V K H Q N T
SEQ ID NO 1082      E L I A G R I P G R T A E E V E K F W A I K H Q A T
SEQ ID NO 1081      E L I A G R I P G R T A K E Q Y T E G E I W C L E T F P R R
SEQ ID NO 1089      E I I A G R I P G R T A E E V E M F W S K K Y Q E R
SEQ ID NO 1090      E I I A G R I P G R T A E E V E M F W S K K Y Q E R
                    . L I A G R I P G R T A E E I E . Y W       R           .
```

FIG. 3A

```
                            100                  110                  120
SEQ ID NO 148
SEQ ID NO 1972   R R D F F R K
SEQ ID NO 38     R R R L N N S P F F S T S P L N L Q E N L K L
SEQ ID NO 2142   R R Q L H S S S H K H T K P H R P R F S I Y P S
SEQ ID NO 1084   R - - N - G S K T Q D S
SEQ ID NO 1085
SEQ ID NO 1086
SEQ ID NO 1083
SEQ ID NO 1087
SEQ ID NO 1088
SEQ ID NO 559
SEQ ID NO 1082
SEQ ID NO 1081   M
SEQ ID NO 1089
SEQ ID NO 1090
```

FIG. 3B

```
                            10                  20                  30
SEQ ID NO 170           M E S S S V D E S T T S T G S I C E T P A I T P A K K
SEQ ID NO 1950          M D S S C I D E I S S S T S E S F S A T T A K K L S P
SEQ ID NO 370       M D A M S S V D E S S T T T D S I P A R K S S S P A S -
SEQ ID NO 1184      M D G G - S V T D E T T T T S N S L S V P A N - - - - -
SEQ ID NO 1183      M D G G - C V T D E T T T S S D S L S V P - - - - - - -
SEQ ID NO 1182      M D A I S C M D E S T T T E S L S I S L S P T S S S E K
SEQ ID NO 1176          M G V V S F S S T S - S G A S T A T T E S G G A V R
SEQ ID NO 1177  M E Q E A A M V V F S C N S G S G G S S S T T D S K Q E E E
SEQ ID NO 1179      M D S T S C L L D D A S S G A S T G - - - - - - - K K
SEQ ID NO 1178      M D S S S C L V D D T N S G G S S - - - T D K L R A L A
SEQ ID NO 1186      M D S A S S L V D D T S S G G G G A C T D K L R A L A
SEQ ID NO 1185      M D S A S S L V D D T S G S G G G - A C T D K L R A L A
                    M D   . S   .   . T   . . . .   S           .       .

40                  50                  60
SEQ ID NO 170       - - - - - - - - - - - - - - - - - S S V G N L Y R M G S G S
SEQ ID NO 1950      P - - - - - - - - - - - - - - - - P A A A L R L Y R M G S G G
SEQ ID NO 370       - - - - - - - - - - - - - - - - - - - L L Y R M G S G T
SEQ ID NO 1184      - - - - - - - - - - - - - L S P P P - - - L S L D G S G A
SEQ ID NO 1183      - - - - - - - - - - - - - - - - P P - - - - - S R V G S V A
SEQ ID NO 1182      A K P S S M I T S S E K V S L S P P P S N R L C R V G S G A
SEQ ID NO 1176      M S P E P - - - - - - - - - - - - V V A V A A A Q Q L P V
SEQ ID NO 1177      E E E E - - - - - - - - - - - - - - - - L A A M E E D E L
SEQ ID NO 1179      A A A A A - - - - - - - - - - - - A S - K A L Q R V G S G A
SEQ ID NO 1178      A A A A E - - - - - - - - - - - - T - - A P L E R M G S G A
SEQ ID NO 1186      V F A A A - - - - - - - - - - - - S G - T P L E R M G S G A
SEQ ID NO 1185      A A A A S - - - - - - - - - - - - A S G P P P E R M G S G A
                                                          L   R     G S G A 70                  80                  90
SEQ ID NO 170       S - V V L D S E N - - - - G V E A E S R - - - - - - - - - -
SEQ ID NO 1950      S S V V L D P E N - - - - G L E T E S R - - - - - - - - - -
SEQ ID NO 370       S - V V L D S E N G V E V E V E A E S R - - - - - - - - - -
SEQ ID NO 1184      T A V V Y P D G C C V - - S G E A E S R - - - - - - - - - -
SEQ ID NO 1183      S A V V D P D G C C V - - S G E A E S R - - - - - - - - - -
SEQ ID NO 1182      S A V V D P D G G G S - - G A E V E S R - - - - - - - - - -
SEQ ID NO 1176      V K G V D S A D E V V T S R P A A A A A Q - - - - - - - - -
SEQ ID NO 1177      I H V V Q A A E L R L P S S T T A T R - - - - - - - - - -
SEQ ID NO 1179      S A V M D A A E P G A E A D S G G E - - - - - - - - - R R G
SEQ ID NO 1178      S A V V D A A E P G A E A D S G S G G R V C G G G G G G A G
SEQ ID NO 1186      S A V V D A A E P G A E A D S G S G - - - - - - - A A A V
SEQ ID NO 1185      S A V V D A A E P G A E A D S G S A P - - - A S V A A V A A
                    S A V V D         E       . .     . E   R 100                 110                 120
SEQ ID NO 170       - - - - K L P S S K Y K G V V P Q P N G R W G A Q I Y E K H
SEQ ID NO 1950      - - - - K L P S S K Y K G V V P Q P N G R W G A Q I Y E K H
SEQ ID NO 370       - - - - K L P S S R F K G V V P Q P N G R W G A Q I Y E K H
SEQ ID NO 1184      - - - - K L P S S K Y K G V V P Q P N G R W G A Q I Y E K H
SEQ ID NO 1183      - - - - K L P S S K Y K G V V P Q P N G R W G A Q I Y E K H
SEQ ID NO 1182      - - - - K L P S S K Y K G V V P Q P N G R W G A Q I Y E K H
SEQ ID NO 1176      - - - - - - Q S S R Y K G V V P Q P N G R W G A Q I Y E R H
SEQ ID NO 1177      - - - - - - P S S R Y K G V V P Q P N G R W G A Q I Y E R H
SEQ ID NO 1179      G G G G K L P S S K Y K G V V P Q P N G R W G A Q I Y E R H
SEQ ID NO 1178      G A G G K L P S S K F K G V V P Q P N G R W G A Q I Y E R H
SEQ ID NO 1186      S V G G K L P S S R Y K G V V P Q P N G R W G A Q I Y E R H
SEQ ID NO 1185      G V G G K L P S S R Y K G V V P Q P N G R W G A Q I Y E R H
                            K L P S S K Y K G V V P Q P N G R W G A Q I Y E . H
```

FIG. 4A

|  | 130 | | | | | | | 140 | | | | | | | | | 150 | | | | |
|---|---|---|---|---|---|---|---|---|---|---|---|---|---|---|---|---|---|---|---|---|---|
| SEQ ID NO 170  | Q | R | V | W | L | G | T | F | N | E | E | D | E | A | A | R | A | Y | D | V | A | V | H | R | F | R | R | R | D | A |
| SEQ ID NO 1950 | Q | R | V | W | L | G | T | F | N | E | Q | E | E | A | A | R | S | Y | D | I | A | A | C | R | F | R | G | R | D | A |
| SEQ ID NO 370  | Q | R | V | W | L | G | T | F | N | E | E | D | E | A | A | R | A | Y | D | V | A | A | H | R | F | R | G | R | D | A |
| SEQ ID NO 1184 | Q | R | V | W | L | G | T | F | N | E | E | D | E | A | V | R | A | Y | D | I | V | A | H | R | F | R | G | R | D | A |
| SEQ ID NO 1183 | Q | R | V | W | L | G | T | F | N | E | E | D | E | A | A | R | A | Y | D | I | A | A | L | R | F | R | G | P | D | A |
| SEQ ID NO 1182 | Q | R | V | W | L | G | T | F | N | E | E | D | E | A | A | R | A | Y | D | I | A | A | Q | R | F | R | G | K | D | A |
| SEQ ID NO 1176 | A | R | V | W | L | G | T | F | P | D | E | E | A | A | A | R | A | Y | D | V | A | A | L | R | Y | R | G | R | D | A |
| SEQ ID NO 1177 | A | R | V | W | L | G | T | F | P | D | E | E | A | A | A | R | A | Y | D | V | A | A | L | R | F | R | G | R | D | A |
| SEQ ID NO 1179 | Q | R | V | W | L | G | T | F | T | G | E | A | E | A | A | R | A | Y | D | V | A | A | Q | R | F | R | G | R | D | A |
| SEQ ID NO 1178 | Q | R | V | W | L | G | T | F | A | G | E | D | D | A | A | R | A | Y | D | V | A | A | Q | R | F | R | G | R | D | A |
| SEQ ID NO 1186 | Q | R | V | W | L | G | T | F | A | G | E | A | D | A | A | R | A | Y | D | V | A | A | Q | R | F | R | G | R | D | A |
| SEQ ID NO 1185 | L | R | V | W | L | G | T | F | T | G | E | A | E | A | A | R | A | Y | D | V | A | A | Q | R | F | R | G | R | D | A |
|                | Q | R | V | W | L | G | T | F |   | . | E | . | E | A | A | R | A | Y | D | V | A | A |   | R | F | R | G | R | D | A |

|  | 160 | | | | | | | | 170 | | | | | | | | 180 | | | | |
|---|---|---|---|---|---|---|---|---|---|---|---|---|---|---|---|---|---|---|---|---|---|
| SEQ ID NO 170  | V | T | N | F | K | D | V | K | M | D | - | - | - | - | - | - | E | D | E | V | D | F | L | N | S | H | S | K | S | E |
| SEQ ID NO 1950 | V | V | N | F | K | N | V | L | E | - | - | - | - | - | - | - | D | G | D | L | A | F | L | E | A | H | S | K | A | E |
| SEQ ID NO 370  | V | T | N | F | K | D | T | T | F | - | - | - | - | - | - | - | E | E | E | V | E | F | L | N | A | H | S | K | S | E |
| SEQ ID NO 1184 | V | T | N | F | K | P | L | A | G | A | - | - | - | - | - | D | D | A | E | A | E | F | L | S | T | H | S | K | S | E |
| SEQ ID NO 1183 | V | T | N | F | K | P | P | A | A | S | - | - | - | - | - | D | D | A | E | S | E | F | L | N | S | H | S | K | F | E |
| SEQ ID NO 1182 | V | T | N | F | K | P | L | A | G | A | D | - | - | - | D | D | D | G | E | S | E | F | L | N | S | H | S | K | P | E |
| SEQ ID NO 1176 | A | T | N | - | F | P | G | A | A | - | - | - | - | - | A | S | A | A | E | L | A | F | L | A | A | H | S | K | A | E |
| SEQ ID NO 1177 | V | T | N | R | A | P | A | A | E | G | - | - | - | - | A | S | A | G | E | L | A | F | L | A | A | H | S | K | A | E |
| SEQ ID NO 1179 | V | T | N | F | R | P | L | A | E | S | - | - | D | P | E | A | A | V | E | L | R | F | L | A | S | R | S | K | A | E |
| SEQ ID NO 1178 | V | T | N | F | R | P | L | A | E | A | - | - | D | P | D | A | A | A | E | L | R | F | L | A | T | R | S | K | A | E |
| SEQ ID NO 1186 | V | T | N | F | R | P | L | A | D | A | - | - | D | P | D | A | A | A | E | L | R | F | L | A | S | R | S | K | A | E |
| SEQ ID NO 1185 | V | T | N | F | R | P | L | A | E | S | D | L | D | P | D | A | A | A | E | L | R | F | L | A | S | R | S | K | A | E |
|                | V | T | N | F |   | P | . | A |   |   |   |   |   |   |   |   |   | . | E | L |   | F | L |   | . | H | S | K | A | E |

|  | 190 | | | | | | | | 200 | | | | | | | | 210 | | | | |
|---|---|---|---|---|---|---|---|---|---|---|---|---|---|---|---|---|---|---|---|---|---|
| SEQ ID NO 170  | I | V | D | M | L | R | K | H | T | Y | N | E | E | L | E | Q | S | K | R | R | - | - | - | - | - | R | N | G | N | G |
| SEQ ID NO 1950 | I | V | D | M | L | R | K | H | T | Y | A | D | E | L | E | Q | N | N | K | R | Q | L | F | L | S | V | D | A | N | G |
| SEQ ID NO 370  | I | V | D | M | L | R | K | H | T | Y | K | E | E | L | D | Q | R | K | R | N | - | - | - | - | - | R | D | G | N | G |
| SEQ ID NO 1184 | I | V | D | M | L | R | R | H | T | Y | D | N | E | L | Q | Q | S | T | R | G | G | - | - | - | - | R | R | R | - | - |
| SEQ ID NO 1183 | I | V | D | M | L | R | K | H | T | Y | D | D | E | L | Q | Q | S | T | R | G | G | - | - | - | - | R | R | R | - | - |
| SEQ ID NO 1182 | I | V | D | M | L | R | K | H | T | Y | N | D | E | L | E | Q | S | K | R | S | R | G | V | V | - | R | R | R | G | S |
| SEQ ID NO 1176 | I | V | D | M | L | R | K | H | T | Y | A | D | E | L | R | Q | G | L | R | R | G | R | - | - | - | - | G | M | G | A |
| SEQ ID NO 1177 | V | V | D | M | L | R | K | H | T | Y | D | D | E | L | Q | Q | G | L | R | R | G | - | - | - | - | - | - | S | - | - |
| SEQ ID NO 1179 | V | V | D | M | L | R | K | H | T | Y | L | E | E | L | T | Q | N | K | R | A | F | A | - | - | - | - | A | I | S | P |
| SEQ ID NO 1178 | V | V | D | M | L | R | K | H | T | Y | F | D | E | L | A | Q | S | K | R | T | F | A | - | - | - | - | A | S | T | P |
| SEQ ID NO 1186 | V | V | D | M | L | R | K | H | T | Y | F | D | E | L | A | Q | N | K | R | A | F | A | - | - | - | - | A | A | S | A |
| SEQ ID NO 1185 | V | V | D | M | L | R | K | H | T | Y | G | E | E | L | A | Q | N | R | R | A | F | A | - | - | - | - | A | A | A | A |
|                | I | V | D | M | L | R | K | H | T | Y |   | D | E | L |   | Q |   | . | R |   |   |   |   |   |   |   |   |   |   |   |

|  | 220 | | | | | | | | 230 | | | | | | | | 240 | | | |
|---|---|---|---|---|---|---|---|---|---|---|---|---|---|---|---|---|---|---|---|---|
| SEQ ID NO 170  | N | M | T | R | T | L | L | T | S | G | L | S | N | D | G | V | S | T | T | G | F | - | - | - | - | - | - | R | S | A |
| SEQ ID NO 1950 | K | R | N | G | S | S | T | T | Q | N | D | - | - | - | - | - | K | V | L | - | - | - | - | - | - | - | - | K | T | C |
| SEQ ID NO 370  | K | E | T | T | A | F | A | L | A | S | M | - | - | - | - | V | V | M | T | G | F | - | - | - | - | - | - | K | T | A |
| SEQ ID NO 1184 | - | - | R | D | A | E | T | A | S | S | G | - | - | - | - | - | A | F | D | A | - | - | - | - | - | - | - | K | A | R |
| SEQ ID NO 1183 | - | - | L | D | A | D | T | A | S | S | G | - | - | - | - | - | V | F | D | A | - | - | - | - | - | - | - | K | A | R |
| SEQ ID NO 1182 | A | A | A | G | T | A | N | S | I | S | G | - | - | - | - | - | A | C | F | T | - | - | - | - | - | - | - | K | A | R |
| SEQ ID NO 1176 | - | - | R | A | Q | P | T | P | S | - | - | - | - | - | - | - | - | - | - | - | - | - | - | - | - | - | - | W | A | R |
| SEQ ID NO 1177 | - | - | R | A | Q | P | T | P | R | - | - | - | - | - | - | - | - | - | - | - | - | - | - | - | - | - | - | W | A | R |
| SEQ ID NO 1179 | P | - | P | P | K | H | P | A | S | - | - | - | - | - | - | S | P | T | S | S | - | - | - | - | - | - | S | A | A | R |
| SEQ ID NO 1178 | S | - | A | A | T | T | T | A | S | - | - | L | S | N | G | H | L | S | S | P | R | S | P | F | A | P | A | A | A | R |
| SEQ ID NO 1186 | A | - | T | A | S | S | L | A | N | N | P | P | S | Y | A | S | L | S | P | A | T | A | T | A | A | A | A | A | A | R |
| SEQ ID NO 1185 | S | - | L | A | S | P | Q | L | P | - | - | - | - | P | A | K | N | T | S | P | - | - | - | - | - | - | A | A | A | R |
|                |   | . |   |   | . |   |   |   |   |   |   |   |   |   |   |   |   |   |   |   |   |   |   |   |   |   |   | A | A | R |

```
                              370                 380                 390
SEQ ID NO 170    Y I G W K S R S G - - - - - - - - - - - - - - - S D L
SEQ ID NO 1950   Y I D W K V R S G - - - - - - - - - - - - P - - R E N
SEQ ID NO 370    F I G W K S K S G - - - - - - - - - - - - - - - L D L
SEQ ID NO 1184   Y I D C K A R S G K V N N A A G L F I P V G - - - - P V V
SEQ ID NO 1183   Y I D C K A R S G E V N N A G G L F V P I G - - - - P V V
SEQ ID NO 1182   Y I D W K T R N - - V N N E V A L F G P V G - - - - P V V
SEQ ID NO 1176   F I D C K K N N A A A T T T C A G D E R P - - - - T T S G
SEQ ID NO 1177   L I D C K K - M E R N N L A T V D D D A R - - - - - - - -
SEQ ID NO 1179   F I D C K V R A K P T T A A A A A F L S A V A A A A A P P
SEQ ID NO 1178   F I D C K L V R S T G A A L A S P A D Q - - - - - - P A P
SEQ ID NO 1186   F I D C K L R P N S V A A A S T A G P S - - - - - - P P A
SEQ ID NO 1185   Y R H C Q R R R R D V D I S F G D A A T V P - A W P R P I V
                 . I D C K     R                 .                       .

400                 410                 420
SEQ ID NO 170    D A G R V L R L F G V N I S P E S - - - - S R N D V V G N
SEQ ID NO 1950   P V Q V V V R L F G V D I F N V T T V - - - K P N D V V A V
SEQ ID NO 370    E T G R V M R L F G V D I S - - - - - - - L N A V V V V
SEQ ID NO 1184   E P V Q M V R L F G V D L L K L P V P - - - G S D G I G V
SEQ ID NO 1183   E P V Q M V R L F G V N L L K L P V P - - - G S D - - G V
SEQ ID NO 1182   E P I Q M V R L F G V N I L K L P G S D T I V G N N N A S
SEQ ID NO 1176   A E P R V V R L F G V D I A G G D C R - - - K R E R A V E M
SEQ ID NO 1177   - - - V V V K L F G V D I A G D K T R
SEQ ID NO 1179   P A V K A I R L F G V D L L T A A P - - - E L Q D A G G A
SEQ ID NO 1178   S P V K A V R L F G V D L L T A - - - - - - - - P A P V E
SEQ ID NO 1186   P V A K A V R L F G V D L L T A P V T - - - A A A P A E A V
SEQ ID NO 1185   I G T A A M N N G A T V A S A T I A - - - G H D I E V A V
                 .       . V R L F G V D . .     .                     . . . .

430                 440                 450
SEQ ID NO 170    K R - - - - V N D T E M L S L V C S K Q R I F H A S
SEQ ID NO 1950   C G G K R S R D V D D M F A L R C S K K Q A I I N A L
SEQ ID NO 370    K E - - - - T T E V L M S S L R C K K - Q R V L
SEQ ID NO 1184   G C D - G K R K E M E L F A F E C S K K L K V I G A L
SEQ ID NO 1183   G K - - - - R K E M E L F A F E C C K K L K V I G A L
SEQ ID NO 1182   G C C N G K R R E M E L F S L E C S K K P K I I G A L
SEQ ID NO 1176   G Q E V F L L K R Q C V H Q R T P A L G A L L L
SEQ ID NO 1177
SEQ ID NO 1179   A M T K S K R A M D A M A E S - Q A H V V F K K Q C I E L A
SEQ ID NO 1178   Q M A G C K R A R D L A A T T P P Q A A A F K K Q C I E L A
SEQ ID NO 1186   A V A G C K R A R D L G S - - - P P Q A A F K K Q L V E L A
SEQ ID NO 1185   A P S G A R S F R L F G F N V E C S G D D A P A P A P A
                 .             R         .         C             .   .   .   .

460                 470                 480
SEQ ID NO 170
SEQ ID NO 1950
SEQ ID NO 370
SEQ ID NO 1184
SEQ ID NO 1183
SEQ ID NO 1182
SEQ ID NO 1176
SEQ ID NO 1177
SEQ ID NO 1179   L T
SEQ ID NO 1178   L V
SEQ ID NO 1186   L V
SEQ ID NO 1185   E V E Y V D G D T
```

FIG. 4D

```
                                          10                  20                  30
SEQ ID NO 186                     M N P F Y S T F P D S F L S I S D H R S
SEQ ID NO 1958                      M N S F S A F S E M F G S D Y E P
SEQ ID NO 1960                              M F G S D Y E S
SEQ ID NO 1962                      M N S F S A F S E M F G S D Y E S
SEQ ID NO 1238  M N I F K S P L D H D L N C G G I F H D S A E A S Y S S E T
SEQ ID NO 1242    M F T L N H S S D L Y H V S P E L S S S L D T S P A S
SEQ ID NO 1240  M N I L G Q S L H Q - S N N G S Y S C S S P E T A N S S N L
SEQ ID NO 1241  M N I L G Q S F N E - S N N G S Y S C S S P E T G S S S N I
SEQ ID NO 1243  M N M Y T L N H S S Y L Y H V S P E L S S S L D S S S P A S
SEQ ID NO 1222              M D T E D T S S A S S S S V S P
SEQ ID NO 1223        M E W A Y Y G S G - - - - Y S S S G T P S
SEQ ID NO 1232        M D V S A A L S S - - - - D Y S S G T P S
SEQ ID NO 1221          M E K N T T A M G Q L M S S S A T T
SEQ ID NO 1231          M E K N T A A S G Q L M T S S A E A
SEQ ID NO 1227              M E V E E A - - - A Y R T V W S E -
SEQ ID NO 1235    M C T S K L E E I T G E W P - - - P P A L Q A A S T
SEQ ID NO 1230    M C G I K - Q E M S G E S S G - - S P C S S A S A E
SEQ ID NO 1229              M E Y - - - - - - - - Y E - - Q E - -
SEQ ID NO 1228  M D M A G - H E V N S S S S - - - S S G A E S S S S
SEQ ID NO 1246    M C P T K - K G M T G E P S - - - S P C S S A S A S
SEQ ID NO 1247    M D M G R - L Q L Q L Q H A - - - A S S S S T S A S
SEQ ID NO 1244    M D M G R - H Q L Q L Q H A - - - A S S S S T S A S
SEQ ID NO 1245        M E Y A A V G Y G Y G Y G Y D E R Q E P A
                                                        . S 40                  50                  60
SEQ ID NO 186   P V S - - - - D S S E C S P K L A S S C P K K R A G R K K F
SEQ ID NO 1958  - - - - - - Q G G D Y C P T L A T S C P K K P A G R K K F
SEQ ID NO 1960  P V S - - - - S G G D Y S P K L A T S C P K K P A G R K K F
SEQ ID NO 1962  S V S - - - - S G G D Y I P T L A S S C P K K P A G R K K F
SEQ ID NO 1238  R S T P - - - - S D - E E V I L A S A R P K K R A G R V F
SEQ ID NO 1242  E G S R G V A F S D - E E V R L A V R H P K K R A G R K K F
SEQ ID NO 1240  P T T P K A V H S D E E V N T L A S A H P K K R A G R R I F
SEQ ID NO 1241  P N T - - - F H S D E E V H T L A S A R P K K R A G R R I F
SEQ ID NO 1243  E G S R G V A F S D - E E V R L A V R H P K K R A G R K K F
SEQ ID NO 1222  P S S P - - - - - - - G G G H H R L P P K R R A G R K K F
SEQ ID NO 1223  P V G G D G D E D S - - Y M T V S S A P P K R A G R T K F
SEQ ID NO 1232  P V A A D A D D G S S A Y M T V S S A P P K R R A G R T K F
SEQ ID NO 1221  A A T - - - - - - - A T G P A - - - S P K R P A G R T K F
SEQ ID NO 1231  T P - - - - - - - - - - S - - - - - - S P K R P A G R T K F
SEQ ID NO 1227  - - - - - - - - - - - - - - - - - - - P P K R P A G R T K F
SEQ ID NO 1235  T S S - S E P C R R L S - - - - - P P S S K R P A G R T K F
SEQ ID NO 1230  R - - - Q H Q T V W T A - - - - - - P P K R P A G R T K F
SEQ ID NO 1229  - - - - - - - - - - - - E Y A T V T S A P P K R P A G R T K F
SEQ ID NO 1228  S S G - - - - - - - - - R - - - - Q Q Y K K R P A G R T K F
SEQ ID NO 1246  T L P E H H Q T V W T S - - - - - - P P K R P A G R T K F
SEQ ID NO 1247  S S S S S E Q N K L A W S P S S P Q P P K K R P A G R T K F
SEQ ID NO 1244  S S S - - E Q D - - - K - P L C C S G P K K R P A G R T K F
SEQ ID NO 1245  E S A D G G G G G D D E Y A T V L S A P P K R P A G R T K F
                                                        P K R P A G R T K F
```

FIG. 5A

|  | 70 | 80 | 90 |
|---|---|---|---|
| SEQ ID NO 186  | R E T R H P I Y R G V R Q R | N S - - - - G - | K W V C E V R E |
| SEQ ID NO 1958 | R E T R H P I Y R G V R Q R | N S - - - - G - | K W V S E V R E |
| SEQ ID NO 1960 | R E T R H P I Y R G V R Q R | N S - - - - G - | K W V C E L R E |
| SEQ ID NO 1962 | R E T R H P I Y R G V R R R | N S - - - - G - | K W V C E V R E |
| SEQ ID NO 1238 | K E T R H P V Y R G V R R R | N K - - - - N - | K W V C E M R V |
| SEQ ID NO 1242 | R E T R H P V Y R G V R R R | N S - - - - D - | K W V C E V R E |
| SEQ ID NO 1240 | K E T R H P V Y R G V R R R | N N - - - - N - | K W V C E V R V |
| SEQ ID NO 1241 | K E T R H P V Y R G V R R R | N N - - - - N - | K W V C E V R E |
| SEQ ID NO 1243 | R E T R H P V Y R G V R R R | N T - - - - D - | K W V S E V R E |
| SEQ ID NO 1222 | R E T R H P V Y R G V R A R | A G - - - - G S | R W V C E V R E |
| SEQ ID NO 1223 | K E T R H P V Y K G V R S R | N - - - - - P G | R W V C E V R E |
| SEQ ID NO 1232 | K E T R H P V F K G V R R R | N - - - - - P G | R W V C E V R E |
| SEQ ID NO 1221 | Q E T R H P V F R G V R R R | G R - - - - A G | R W V C E V R V |
| SEQ ID NO 1231 | Q E T R H L V F R G V R W R | G C - - - - A G | R W V C K V R V |
| SEQ ID NO 1227 | R E T R H P V Y R G V R R R | G G R P G A A G | R W V C E V R V |
| SEQ ID NO 1235 | H E T R H P V F R G V R R R | G R - - - - A G | R W V C E V R V |
| SEQ ID NO 1230 | R E T R H P V F R G V R R R | G N - - - - A G | R W V C E V R V |
| SEQ ID NO 1229 | R E T R H P V Y R G V R R R | G P - - - - A G | R W V C E V R E |
| SEQ ID NO 1228 | R E T R H P V Y R G V R R R | G G - - - - A G | R W V C E V R V |
| SEQ ID NO 1246 | R E T R H P V F R G V R R R | G S - - - - A G | R W V C E V R V |
| SEQ ID NO 1247 | R E T R H P V F R G V R R R | G A - - - - A G | R W V C E V R V |
| SEQ ID NO 1244 | R E T R H P V F R G V R R R | G A - - - - A G | R W V C E V R V |
| SEQ ID NO 1245 | R E T R H P V Y R G V R R R | G P - - - - A G | R W V C E V R E |
|  | R E T R H P V Y R G V R R R . | . G R W V C E V R V |

|  | 100 | 110 | 120 |
|---|---|---|---|
| SEQ ID NO 186  | P N K - K S R I W L G T F | P T V E M A A R A H D V A A L A L |
| SEQ ID NO 1958 | P N K - K T R I W L G T F | Q T A E M A A R A H D V A A L A L |
| SEQ ID NO 1960 | P N K - K T R I W L G T F | Q T A E M A A R A H D V A A I A L |
| SEQ ID NO 1962 | P N K - K T R I W L G T F | Q T A E M A A R A H D V A A L A L |
| SEQ ID NO 1238 | P N N - N S R I W L G T Y | P T P E M A A R A H D V A A L A L |
| SEQ ID NO 1242 | P N K - K T R I W L G T F | P T P E M A A R A H D V A A M A L |
| SEQ ID NO 1240 | P N D K S T R I W L G T Y | P T P E M A A R A H D V A A L S L |
| SEQ ID NO 1241 | P N D K S T R I W L G T Y | P V P E M A A R A H D V A A L A L |
| SEQ ID NO 1243 | P N K - K T R I W L G T F | P T P E M A A R A H D V A A M A L |
| SEQ ID NO 1222 | P Q - A Q A R I W L G T Y | P T P E M A A R A H D V A A I A L |
| SEQ ID NO 1223 | P H G - K Q R I W L G T F | E T A E M A A R A H D V A A M A L |
| SEQ ID NO 1232 | P H G - K Q R I W L G T F | E T A E M A A R A H D V A A L A L |
| SEQ ID NO 1221 | P G S R G D R L W V G T F | D T A E E A A R A H D A A M L A L |
| SEQ ID NO 1231 | P G S R G D R F W I G T S | D T A E E T A R T H D A A M L A L |
| SEQ ID NO 1227 | P G A R G S R L W L G T F | A T A E A A A R A H D A A A L A L |
| SEQ ID NO 1235 | P G R R G C R L W L G T F | D A D A A A R A H D A A M L A L |
| SEQ ID NO 1230 | P G R R G C R L W L G T F | D T A E G A A R A H D A A M L A I |
| SEQ ID NO 1229 | P N K - K S R I W L G T F | A T A E A A A R A H D A A A L A L |
| SEQ ID NO 1228 | P G K R G A R L W L G T Y | V T A E A A A R A H D A A M I A L |
| SEQ ID NO 1246 | P G R R G C R L W L G T F | D T A E A A A R A H D A A M L A L |
| SEQ ID NO 1247 | P G R R G A R L W L G T Y | L G A E A A A R A H D A A M L A L |
| SEQ ID NO 1244 | P G R R G A R L W L G T Y | L G A E A A A R A H D A A M L A L |
| SEQ ID NO 1245 | P N K - K S R I W L G T F | A T P E A A A R A H D V A A L A L |
|  | P . . . R I W L G T F | T A E M A A R A H D V A A L A L |

FIG. 5B

| | | | | | | | | | | 130 | | | | | | | | | 140 | | | | | | | | 150 | | | | |
|---|---|---|---|---|---|---|---|---|---|---|---|---|---|---|---|---|---|---|---|---|---|---|---|---|---|---|---|---|---|---|---|
| SEQ ID NO 186 | R | G | R | - | - | - | - | - | - | S | A | C | L | N | F | A | D | S | A | W | R | L | R | I | P | - | - | - | - | - |
| SEQ ID NO 1958 | R | G | R | - | - | - | - | - | - | S | A | C | L | N | F | A | D | S | A | W | R | L | R | I | P | - | - | - | - | - |
| SEQ ID NO 1960 | R | G | R | - | - | - | - | - | - | S | A | C | L | N | F | A | D | S | A | W | R | L | R | I | P | - | - | - | - | - |
| SEQ ID NO 1962 | R | G | R | - | - | - | - | - | - | S | A | C | L | N | F | A | D | S | A | W | R | L | R | I | P | - | - | - | - | - |
| SEQ ID NO 1238 | R | G | K | - | - | - | - | - | - | S | A | C | L | N | F | A | D | S | R | W | R | L | T | V | P | - | - | - | - | - |
| SEQ ID NO 1242 | R | G | R | - | - | - | - | - | - | Y | A | C | L | N | F | A | D | S | A | W | R | L | P | V | P | - | - | - | - | - |
| SEQ ID NO 1240 | R | G | K | - | - | - | - | - | - | S | A | C | L | N | F | A | D | S | A | W | R | L | P | L | P | - | - | - | - | - |
| SEQ ID NO 1241 | R | G | K | - | - | - | - | - | - | S | A | C | L | N | F | A | D | S | A | W | R | L | P | L | P | - | - | - | - | - |
| SEQ ID NO 1243 | R | G | R | - | - | - | - | - | - | Y | A | C | L | N | F | A | D | S | T | W | R | L | P | I | P | - | - | - | - | - |
| SEQ ID NO 1222 | R | G | E | R | - | - | - | - | - | G | A | E | L | N | F | P | D | S | P | S | T | L | P | R | - | - | - | - | - | - |
| SEQ ID NO 1223 | R | G | R | - | - | - | - | - | - | A | A | C | L | N | F | A | D | S | P | R | R | L | R | V | P | P | - | - | - | - |
| SEQ ID NO 1232 | R | G | R | - | - | - | - | - | - | A | A | C | L | N | F | A | D | S | P | R | R | L | R | V | P | P | - | - | - | - |
| SEQ ID NO 1221 | C | G | A | S | - | - | - | - | - | - | A | S | L | N | F | A | D | S | A | W | L | L | H | V | P | R | A | P | V | A |
| SEQ ID NO 1231 | C | G | A | S | - | - | - | - | - | - | A | S | L | N | F | A | D | S | A | W | L | L | H | V | P | R | A | P | V | V |
| SEQ ID NO 1227 | R | G | R | - | - | - | - | - | - | A | A | C | L | N | F | A | D | S | A | W | R | M | P | P | V | P | A | S | A | A |
| SEQ ID NO 1235 | R | G | R | A | A | - | - | - | - | - | A | C | L | N | F | A | D | S | A | W | L | L | A | V | P | P | - | P | A | T |
| SEQ ID NO 1230 | N | A | G | G | G | G | G | G | G | A | C | C | L | N | F | A | D | S | A | W | L | L | A | V | P | - | - | - | R | S |
| SEQ ID NO 1229 | R | G | R | - | - | - | - | - | - | G | A | C | L | N | F | A | D | S | A | R | L | L | R | V | D | P | - | - | - | - |
| SEQ ID NO 1228 | R | G | G | A | G | G | - | G | G | A | A | C | L | N | F | Q | D | S | A | W | L | L | A | V | P | - | - | P | A | A |
| SEQ ID NO 1246 | A | G | A | G | A | - | - | - | - | - | C | C | L | N | F | A | D | S | A | W | L | L | A | V | P | - | - | - | A | S |
| SEQ ID NO 1247 | G | - | - | - | - | - | - | R | G | A | A | C | L | N | F | P | D | S | A | W | L | L | A | V | P | P | P | P | A | L |
| SEQ ID NO 1244 | G | - | - | - | - | - | - | R | G | A | A | C | L | N | F | P | D | S | A | W | L | L | A | V | P | P | P | P | A | L |
| SEQ ID NO 1245 | R | G | R | - | - | - | - | - | - | A | A | C | L | N | F | A | D | S | A | R | L | L | Q | V | D | P | - | - | - | - |
| | R | G | R | | | | | | | | A | C | L | N | F | A | D | S | A | W | R | L | | V | P | | | | | |

| | | | | | | | | | 160 | | | | | | | | | 170 | | | | | | | | | 180 | | |
|---|---|---|---|---|---|---|---|---|---|---|---|---|---|---|---|---|---|---|---|---|---|---|---|---|---|---|---|---|---|
| SEQ ID NO 186 | - | E | T | T | C | P | K | E | I | Q | K | A | A | S | E | A | A | M | A | F | Q | N | E | T | T | T | E | - | - | - |
| SEQ ID NO 1958 | - | E | S | T | C | A | K | D | I | Q | K | A | A | A | E | A | A | L | A | F | Q | D | E | T | C | D | T | - | - | - |
| SEQ ID NO 1960 | - | E | S | T | C | A | K | E | I | Q | K | A | A | A | E | A | A | L | N | F | Q | D | E | M | C | H | M | - | - | - |
| SEQ ID NO 1962 | - | E | S | T | C | A | K | D | I | Q | K | A | A | A | E | A | A | L | A | F | Q | D | E | M | C | D | A | - | - | - |
| SEQ ID NO 1238 | - | A | T | N | A | E | E | I | R | R | A | A | G | E | A | A | E | A | F | A | V | A | D | G | - | - | - | - | - | - |
| SEQ ID NO 1242 | - | A | T | A | E | A | K | D | I | Q | K | A | A | A | E | A | A | Q | A | F | R | P | D | Q | T | L | K | - | - | - |
| SEQ ID NO 1240 | - | A | S | T | N | A | K | E | I | R | R | V | A | A | A | A | V | A | I | A | A | E | D | S | R | G | - | - | - | - |
| SEQ ID NO 1241 | - | A | S | T | N | A | K | E | I | R | R | V | A | A | A | A | V | A | I | A | A | E | D | S | C | G | - | - | - | - |
| SEQ ID NO 1243 | - | A | T | A | N | A | K | D | I | Q | K | A | A | A | E | A | A | E | A | F | R | P | S | Q | T | L | E | - | - | - |
| SEQ ID NO 1222 | A | R | T | A | S | P | E | D | I | R | L | A | A | A | Q | A | A | E | L | Y | R | R | P | P | P | P | L | - | - | - |
| SEQ ID NO 1223 | L | G | - | A | G | H | E | E | I | R | R | A | A | V | E | A | A | E | L | F | R | P | A | P | G | Q | H | - | - | - |
| SEQ ID NO 1232 | I | G | - | A | S | H | D | D | I | R | R | A | A | A | E | A | A | E | A | F | R | P | P | P | D | E | S | - | - | - |
| SEQ ID NO 1221 | S | G | H | D | Q | L | P | D | V | Q | R | A | A | S | E | A | V | A | E | F | Q | R | R | G | S | - | - | - | - | - |
| SEQ ID NO 1231 | S | G | - | - | L | R | P | P | A | A | R | C | A | T | R | C | L | Q | G | H | R | R | V | P | A | P | G | - | - | - |
| SEQ ID NO 1227 | L | A | G | - | - | A | R | G | V | R | D | A | V | A | V | A | V | E | A | F | Q | R | Q | S | - | - | - | - | - | - |
| SEQ ID NO 1235 | L | R | C | - | - | A | A | D | V | Q | R | A | V | A | R | A | L | E | D | F | E | Q | R | E | S | S | S | S | V | F |
| SEQ ID NO 1230 | Y | R | T | - | - | L | A | D | V | R | H | A | V | A | E | A | V | E | D | F | F | R | R | R | L | A | D | - | - | - |
| SEQ ID NO 1229 | A | T | L | A | T | P | D | D | I | R | R | A | A | I | E | L | A | E | S | C | P | - | H | D | A | A | A | - | - | - |
| SEQ ID NO 1228 | P | S | D | - | - | L | A | G | V | R | R | A | A | T | E | A | V | A | G | F | L | Q | R | N | K | T | T | N | - | - |
| SEQ ID NO 1246 | C | A | S | - | - | L | A | E | V | R | H | A | V | A | D | A | V | D | D | F | L | R | H | Q | L | V | P | - | - | - |
| SEQ ID NO 1247 | S | G | G | - | - | L | D | G | A | R | R | A | A | L | E | A | V | A | E | F | Q | R | R | R | - | - | - | - | - | - |
| SEQ ID NO 1244 | S | G | G | - | - | L | D | G | A | R | R | A | A | L | E | A | V | A | E | F | Q | R | R | R | - | - | - | - | - | - |
| SEQ ID NO 1245 | A | T | L | A | T | P | D | D | I | R | R | A | A | I | Q | L | A | D | A | A | S | Q | Q | D | E | T | A | - | - | - |
| | . | . | | . | | | | | I | R | R | A | A | A | E | A | A | | . | F | | | | | | | | | | |

FIG.5C

|  | 190 | 200 | 210 |
|---|---|---|---|
| SEQ ID NO 186 | - - - - G S - K T A | A E A E E A A G E | G V R E G E R - - - - |
| SEQ ID NO 1958 | - - - - T T T N H G | L D M E E T M V E | A I Y T P E - - - - - |
| SEQ ID NO 1960 | - - - - T T D A H G | L D M E E T L V E | A I Y T P E - - - - - |
| SEQ ID NO 1962 | - - - - T T - D H G | F D M E E T L V E | A I Y T A E - - - - - |
| SEQ ID NO 1238 | - - - - - - - - - - | - - D D V N I - - | - - - - - - - - - - - |
| SEQ ID NO 1242 | - - - - N A - - - - | - N T R Q E C V E | A V A V A - - - - - - |
| SEQ ID NO 1240 | - - - - K Q - - - - | - L R T N A I - D | A V A D - C E V S S S |
| SEQ ID NO 1241 | - - - - E Q - - - - | - L Q N S I V N D | A V A D D C E V S R S |
| SEQ ID NO 1243 | - - - - N T - - - - | - N T K Q E C V K | V V T T - - - - - - - |
| SEQ ID NO 1222 | - - - - A L P E - - | - D P Q E G T S G | G - - - - - - - - - - |
| SEQ ID NO 1223 | - - - - N A A E A A | A A V A A Q A T A | A S A - - - - - - - - |
| SEQ ID NO 1232 | - - - - N A A T E V | A A A A S G - A T | N S N A - - - - - - - |
| SEQ ID NO 1221 | - - - - T A A T A T | A T S G D A A S T | A P P S - - - - - - - |
| SEQ ID NO 1231 | - - R G S T A T A T | A T S G D A A S T | A P P - - - - - - - - |
| SEQ ID NO 1227 | - - - - A P S S P A | E T F A N D G D E | E E D - - - - - - - - |
| SEQ ID NO 1235 | P L A I D V V A E D | A M S A T S E P S | A A S D - - - - - - - |
| SEQ ID NO 1230 | - - D A L S A T S S | S S T T P S T P R | T D D D - - - - - - - |
| SEQ ID NO 1229 | - - - - A A A S S S | A A A V E A S A A | A A P A - - - - - - - |
| SEQ ID NO 1228 | G A S V A E A M D E | A T S G V S A P P | P L A N N A G S - - S |
| SEQ ID NO 1246 | - - E D D A L A A T | P S S P S S E D G | N T S D - - - - - - - |
| SEQ ID NO 1247 | - - F G A V A A D E | A T S G T S P P S | S S S S P S G T Y V S |
| SEQ ID NO 1244 | - - F G A A A A D E | A T S G T S P P S | S S S - - - - - - - A |
| SEQ ID NO 1245 | - - - - A V A A D V | V A P S Q A D D V | A A - - - - - - - - - |
|  | . . . | A . |  |

|  | 220 | 230 | 240 |
|---|---|---|---|
| SEQ ID NO 186 | - - - - - - - - - - | - - - - - - - - - | - - - - - - - - - - - |
| SEQ ID NO 1958 | - - - - - - - - - - | - - - - - - - - - | - - - - - - - - - - - |
| SEQ ID NO 1960 | - - - - - - - - - - | - - - - - - - - - | - - - - - - - - - - - |
| SEQ ID NO 1962 | - - - - - - - - - - | - - - - - - - - - | - - - - - - - - - - - |
| SEQ ID NO 1238 | - - - - - - - - E Q | - - - - - - - - - | - - - - - - - Q Q S V |
| SEQ ID NO 1242 | - - - - - - - - - - | - - - - - - - - - | - - - - - - - - - - V |
| SEQ ID NO 1240 | D I G V D E N C N N | - - - - - - - - - | - - - - - - - N K A S |
| SEQ ID NO 1241 | D V S F D E D S N S | - - - - - - - - - | - - - - - - - N K G L |
| SEQ ID NO 1243 | - - - - - - - - - - | - - - - - - - - - | - - - - - - - - - - - |
| SEQ ID NO 1222 | - - - - - - - - - - | - - - - - - - - - | - - - - - - - - - G A |
| SEQ ID NO 1223 | - - - - - - - - - - | - - - - - - - - - | - - - - - - - - - - - |
| SEQ ID NO 1232 | - - - - - - - - - - | - - - - - - - - - | - - - - - - - - - - - |
| SEQ ID NO 1221 | S S P V L S P N D - | - - - - - - - - - | - - - - - D N A S S A |
| SEQ ID NO 1231 | S A P V L S A K Q C | E F I F L S S L D | C W M L M S K L I S S |
| SEQ ID NO 1227 | N K D V L P V A A A | - - - - - - - - - | - - - - - - - E V F D A |
| SEQ ID NO 1235 | - - D D A V T S S S | - - - - - - - - - | - - - - - - - S T T D A |
| SEQ ID NO 1230 | - - E E S A A T D G | - - - - - - - - - | - - - - - - - D E S S S |
| SEQ ID NO 1229 | - - - - - - - - - - | - - - - - - - - - | - - - - - - - - - - - |
| SEQ ID NO 1228 | E T P G P S S I D G | - - - - - - - - - | - - - - - - - T A D T A |
| SEQ ID NO 1246 | - - G G E S S S D - | - - - - - - - - - | - - - - - - - - - S S P |
| SEQ ID NO 1247 | Q A P A P A I E R V | - - - - - - - - - | - - - - - - - - P V E A S |
| SEQ ID NO 1244 | T K P A P A I E R V | - - - - - - - - - | - - - - - - - - P V E A S |
| SEQ ID NO 1245 | - - - - - - - - - - | - - - - - - - - - | - - - - - - - - - - - |

FIG. 5D

```
                             250                 260                 270
SEQ ID NO 186    R A E E Q N G G V F Y M D D E A L L G M P N F F E N M A E G
SEQ ID NO 1958   - - - - Q S E G A F Y M D E E T M F G M P T L L D N M A E G
SEQ ID NO 1960   - - - - Q S Q D A F Y M D E E A M L G M S S L L D N M A E G
SEQ ID NO 1962   - - - - Q S E N A F Y M H D E A M F E M P S L L A N M A E G
SEQ ID NO 1238   M A T N D D E V Q E P L Q Q E E V Q D L H D L L L S I A N E
SEQ ID NO 1242   A E T T T A T A Q G V F Y M E E E Q V L D M P E L L R N M
SEQ ID NO 1240   Q R F C D L D E I T M P D A P V F E D M H E W L Q T M A A E
SEQ ID NO 1241   R V F C D L D E I T M A D A P V F E D M R E W L Q S M A D E
SEQ ID NO 1243   - T T I T E Q K R G M F Y T E E E Q V L D M P E L L R N M
SEQ ID NO 1222   T A T S G R P A A V F V D E D A I F D M P G L I D D M A R G
SEQ ID NO 1223   E L F A D F P C Y P - - M D G L E F E M Q G Y L D M A Q G M
SEQ ID NO 1232   E Q F A S H P Y Y E V M D D G L D L G M Q G Y L D M A Q G M
SEQ ID NO 1221   S T P A V A A A L D H G D M F G G M R T D L Y F A S L A Q G
SEQ ID NO 1231   S R A K G S L C L R K N P I S F C M V T N S Y T A L L L E Y
SEQ ID NO 1227   G A F E L D - - - - D G F R F G G M D A G S Y Y A S L A Q G
SEQ ID NO 1235   D E E A S P - - - F E L D V V S D M G W S L Y Y A S L A E G
SEQ ID NO 1230   P A S D L A - - - F E L D V L S D M G W D L Y Y A S L A Q G
SEQ ID NO 1229   M M M Q Y Q D D M A A T P S S Y D Y A Y Y G N M D F D Q P S
SEQ ID NO 1228   A G A A L D - - M F E L D F F G E M D Y D T Y Y A S L A E G
SEQ ID NO 1246   P T G A S P - - - F E F D V F N D M S W D L H Y A S L A Q G
SEQ ID NO 1247   E T A A L D G A V F E P D W F R D M D L D L Y Y A S L A E G
SEQ ID NO 1244   E T V A L D G A V F E P D W F G D M D L D L Y Y A S L A E G
SEQ ID NO 1245   - - - - - - - - - A A A A A A A A A M Y G G G M E F D H S Y
                                        D    .              .    A   G 280                 290                 300
SEQ ID NO 186    M L L P P P E V G W N H N - - - - - - - - - - - D F D G V G D
SEQ ID NO 1958   M L L P P P S V Q W N H N Y - - - - - - - - - D G E G D G D
SEQ ID NO 1960   M L L P S P S V Q W N Y N F - - - - - - - - - D V E G D D D
SEQ ID NO 1962   M L L P L P S V Q W N H N H - - - - - - - - - E V D G D D D
SEQ ID NO 1238   P L M S P P P C A R D G R D - - - - - - - - - W N D V D I F
SEQ ID NO 1242   V L M S P T H C L G Y E Y E - - - - - - - - - D A D L D A Q
SEQ ID NO 1240   P L R S P T F V T Y V N V R - - - - - - - - - D V W N F V E
SEQ ID NO 1241   P L R S P T F V T Y V N V R - - - - - - - - - D V W N F V E
SEQ ID NO 1243   V L M S P T H C I G Y E Y E - - - - - - - - - D A D L D A Q
SEQ ID NO 1222   M M L T P P A I G R S L D D - - - - - - - - - W A A I D D D
SEQ ID NO 1223   L I E P P P L A G Q S T W A - - - - - - - - - - E E D Y D
SEQ ID NO 1232   L I D P P P M A C D P A V G G G - - - - - - - - - E D D N D
SEQ ID NO 1221   L L I E P P P P P T T - - - - - - - - - - - - A E G F C D
SEQ ID NO 1231   I I L Q M N S M I V L - - - - - - - - - - - - I H E L S K
SEQ ID NO 1227   L L V E P P A A G - - - - - - - - - - - - - - A W W E D G
SEQ ID NO 1235   L L M E P P A S G A S - - - - - - - - - - - S D D D D D
SEQ ID NO 1230   M L M E P P S A A L G - - - - - - - - - - - D D G D - -
SEQ ID NO 1229   Y Y Y D G M G G G E - - Y Q S - - - - W Q - - M D G D D D
SEQ ID NO 1228   L L M E P P P A A T - - - - - - - - - - - - - A L W D N G
SEQ ID NO 1246   L L V E P P - S A V T - - - - - - - - - - - - A F M D - -
SEQ ID NO 1247   L L V E P P P P - - - - - - - - - - - - - - - A A W D H G
SEQ ID NO 1244   L L V E P P P P P P - - - - - - - - - - - - - A A W D H G
SEQ ID NO 1245   C Y D D G M V S G S S D C W Q S G G G G W H S S V D G D D D
                 . L       P P   . .                              . . . D  .
```

FIG. 5E

|  | 310 |  | 320 |  | 330 |
|---|---|---|---|---|---|
| SEQ ID NO 186 | - - - - - - - - - - | V S | L W S F | D E |  |
| SEQ ID NO 1958 | - - - - - - - - - - | V S | L W S Y |  |  |
| SEQ ID NO 1960 | - - - - - - - - - - | V S | L W S Y |  |  |
| SEQ ID NO 1962 | D - - - - - - - - - | V S | L W S Y |  |  |
| SEQ ID NO 1238 | D D - - - - - - D E | I S | L W N F | S I |  |
| SEQ ID NO 1242 | D - - - - - - - A E | V S | L W N F | S I |  |
| SEQ ID NO 1240 | D D - - - - - - A E | V S | L W S F | T V |  |
| SEQ ID NO 1241 | D D - - - - - - A E | V S | L W S F | T I |  |
| SEQ ID NO 1243 | D - - - - - - - A E | V S | L W S F | S I |  |
| SEQ ID NO 1222 | D D H Y - - - H M D | Y K | L W M D |  |  |
| SEQ ID NO 1223 | C - - - - - - - - - | E V | N L W S Y |  |  |
| SEQ ID NO 1232 | G - - - - - - - - - | E V | Q L W S Y |  |  |
| SEQ ID NO 1221 | D E G - - C G G A E | M E | L W S |  |  |
| SEQ ID NO 1231 | Y Q V - - F L L L T | M I | T H H L | F Q W R R |  |
| SEQ ID NO 1227 | E - - - - L A G S D | M P | L W S Y |  |  |
| SEQ ID NO 1235 | A I V D S S D I A D | V S | L W S Y |  |  |
| SEQ ID NO 1230 | - - - - - A I L A D | V P | L W S Y |  |  |
| SEQ ID NO 1229 | G G A G G Y G G G D | V T | L W S Y |  |  |
| SEQ ID NO 1228 | D E - - - - - G A D | I A | L W S Y |  |  |
| SEQ ID NO 1246 | - - - - - E G F A D | V P | L W S Y |  |  |
| SEQ ID NO 1247 | D C S - - H S G A D | V A | L W S Y |  |  |
| SEQ ID NO 1244 | D C C - - D S G A D | V A | L W S Y |  |  |
| SEQ ID NO 1245 | G - - - - - - A G D | M T | L W S Y | N A V E S V S S A G G W E R |  |
|  | . | . . V . | L W S Y |  |  |

|  | 340 | 350 | 360 |
|---|---|---|---|
| SEQ ID NO 186 |  |  |  |
| SEQ ID NO 1958 |  |  |  |
| SEQ ID NO 1960 |  |  |  |
| SEQ ID NO 1962 |  |  |  |
| SEQ ID NO 1238 |  |  |  |
| SEQ ID NO 1242 |  |  |  |
| SEQ ID NO 1240 |  |  |  |
| SEQ ID NO 1241 |  |  |  |
| SEQ ID NO 1243 |  |  |  |
| SEQ ID NO 1222 |  |  |  |
| SEQ ID NO 1223 |  |  |  |
| SEQ ID NO 1232 |  |  |  |
| SEQ ID NO 1221 |  |  |  |
| SEQ ID NO 1231 |  |  |  |
| SEQ ID NO 1227 |  |  |  |
| SEQ ID NO 1235 |  |  |  |
| SEQ ID NO 1230 |  |  |  |
| SEQ ID NO 1229 |  |  |  |
| SEQ ID NO 1228 |  |  |  |
| SEQ ID NO 1246 |  |  |  |
| SEQ ID NO 1247 |  |  |  |
| SEQ ID NO 1244 |  |  |  |
| SEQ ID NO 1245 | R P R S G A T T G Q G R K W G S R E R V R I |  |  |

POLYNUCLEOTIDES AND POLYPEPTIDES IN PLANTS

RELATIONSHIP TO COPENDING APPLICATIONS

This application claims the benefit of U.S. Non-provisional application Ser. No. 09/837,944, filed Apr. 18, 2001 (abandoned); U.S. Provisional Application No. 60/310,847, filed Aug. 9, 2001 (expired); U.S. Nonprovisional application Ser. No. 09/934,455 (abandoned), filed Aug. 22, 2001; U.S. Provisional Application No. 60/336,049, filed Nov. 19, 2001 (expired); U.S. Provisional Application No. 60/338,692, filed Dec. 11, 2001 (expired); U.S. Non-provisional application Ser. No. 10/171,468, filed Jun. 14, 2002 (abandoned); U.S. Non-provisional application Ser. No. 10/225,066, filed Aug. 9, 2002, which issued as U.S. Pat. No. 7,238,860 on Jul. 3, 2007; U.S. Non-provisional application Ser. No. 10/225,067, filed Aug. 9, 2002, which issued as U.S. Pat. No. 7,135,616, which filed on Nov. 14, 2006; and U.S. Non-provisional application Ser. No. 10/225,068, filed Aug. 9, 2002, which issued as U.S. Pat. No. 7,193,129 on Mar. 20, 2007; the contents of which are hereby incorporated by reference in their entirety.

The claimed invention, in the field of functional genomics and the characterization of plant genes for the improvement of plants, was made by or on behalf of Mendel Biotechnology, Inc. and Monsanto Company as a result of activities undertaken within the scope of a joint research agreement, said agreement having been in effect on or before the date the claimed invention was made.

TECHNICAL FIELD

This invention relates to the field of plant biology. More particularly, the present invention pertains to compositions and methods for modifying a plant phenotypically.

BACKGROUND OF THE INVENTION

A plant's traits, such as its biochemical, developmental, or phenotypic characteristics, may be controlled through a number of cellular processes. One important way to manipulate that control is through transcription factors—proteins that influence the expression of a particular gene or sets of genes. Transformed and transgenic plants that comprise cells having altered levels of at least one selected transcription factor, for example, possess advantageous or desirable traits. Strategies for manipulating traits by altering a plant cell's transcription factor content can therefore result in plants and crops with new and/or improved commercially valuable properties.

Transcription factors can modulate gene expression, either increasing or decreasing (inducing or repressing) the rate of transcription. This modulation results in differential levels of gene expression at various developmental stages, in different tissues and cell types, and in response to different exogenous (e.g., environmental) and endogenous stimuli throughout the life cycle of the organism.

Because transcription factors are key controlling elements of biological pathways, altering the expression levels of one or more transcription factors can change entire biological pathways in an organism. For example, manipulation of the levels of selected transcription factors may result in increased expression of economically useful proteins or biomolecules in plants or improvement in other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits. A number of the agriculturally relevant characteristics of plants, and desirable traits that may be imbued by gene expression are listed below.

Useful Plant Traits

Category: Abiotic Stress; Desired Trait: Chilling Tolerance

The term "chilling sensitivity" has been used to describe many types of physiological damage produced at low, but above freezing, temperatures. Most crops of tropical origins such as soybean, rice, maize and cotton are easily damaged by chilling. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. For example, photoinhibition of photosynthesis (disruption of photosynthesis due to high light intensities) often occurs under clear atmospheric conditions subsequent to cold late summer/autumn nights. By some estimates, chilling accounts for monetary losses in the United States (US) second only to drought and flooding. For example, chilling may lead to yield losses and lower product quality through the delayed ripening of maize. Another consequence of poor growth is the rather poor ground cover of maize fields in spring, often resulting in soil erosion, increased occurrence of weeds, and reduced uptake of nutrients. A retarded uptake of mineral nitrogen could also lead to increased losses of nitrate into the ground water.

Category: Abiotic Stress; Desired Trait: Freezing Tolerance.

Freezing is a major environmental stress that limits where crops can be grown and reduces yields considerably, depending on the weather in a particular growing season. In addition to exceptionally stressful years that cause measurable losses of billions of dollars, less extreme stress almost certainly causes smaller yield reductions over larger areas to produce yield reductions of similar dollar value every year. For instance, in the US, the 1995 early fall frosts are estimated to have caused losses of over one billion dollars to corn and soybeans. The spring of 1998 saw an estimated $200 M of damages to Georgia alone, in the peach, blueberry and strawberry industries. The occasional freezes in Florida have shifted the citrus belt further south due to $100 M or more losses. California sustained $650 M of damage in 1998 to the citrus crop due to a winter freeze. In addition, certain crops such as *Eucalyptus*, which has the very favorable properties of rapid growth and good wood quality for pulping, are not able to grow in the southeastern states due to occasional freezes.

Inherent winter hardiness of the crop determines in which agricultural areas it can survive the winter. For example, for wheat, the northern central portion of the US has winters that are too cold for good winter wheat crops. Approximately 20% of the US wheat crop is spring wheat, with a market value of $2 billion. Areas growing spring wheat could benefit by growing winter wheat that had increased winter hardiness. Assuming a 25% yield increase when growing winter wheat, this would create $500 M of increased value. Additionally, the existing winter wheat is severely stressed by freezing conditions and should have improved yields with increased tolerance to these stresses. An estimate of the yield benefit of these traits is 10% of the $4.4 billion winter wheat crop in the US or $444 M of yield increase, as well as better survival in extreme freezing conditions that occur periodically.

Thus plants more resistant to freezing, both midwinter freezing and sudden freezes, would protect a farmers' investment, improve yield and quality, and allow some geographies to grow more profitable and productive crops. Additionally, winter crops such as canola, wheat and barley have 25% to 50% yield increases relative to spring planted varieties of the same crops. This yield increase is due to the "head start" the fall planted crop has over the spring planted crop and its reaching maturity earlier while the temperatures, soil moisture and lack of pathogens provide more favorable conditions.
Category: Abiotic Stress; Desired Trait: Salt Tolerance.

One in five hectares of irrigated land is damaged by salt, an important historical factor in the decline of ancient agrarian societies. This condition is only expected to worsen, further reducing the availability of arable land and crop production, since none of the top five food crops—wheat, corn, rice, potatoes, and soybean—can tolerate excessive salt.

Detrimental effects of salt on plants are a consequence of both water deficit resulting in osmotic stress (similar to drought stress) and the effects of excess sodium ions on critical biochemical processes. As with freezing and drought, high saline causes water deficit; the presence of high salt makes it difficult for plant roots to extract water from their environment (Buchanan et al. (2000) in *Biochemistry and Molecular Biology of Plants*, American Society of Plant Physiologists, Rockville, Md.). Soil salinity is thus one of the more important variables that determines where a plant may thrive. In many parts of the world, sizable land areas are uncultivable due to naturally high soil salinity. To compound the problem, salination of soils that are used for agricultural production is a significant and increasing problem in regions that rely heavily on agriculture. The latter is compounded by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. Thus, germination normally takes place at a salt concentration much higher than the mean salt level in the whole soil profile.
Category: Abiotic Stress; Desired Trait: Drought Tolerance.

While much of the weather that we experience is brief and short-lived, drought is a more gradual phenomenon, slowly taking hold of an area and tightening its grip with time. In severe cases, drought can last for many years, and can have devastating effects on agriculture and water supplies. With burgeoning population and chronic shortage of available fresh water, drought is not only the number one weather related problem in agriculture, it also ranks as one of the major natural disasters of all time, causing not only economic damage, but also loss of human lives. For example, losses from the US drought of 1988 exceeded $40 billion, exceeding the losses caused by Hurricane Andrew in 1992, the Mississippi River floods of 1993, and the San Francisco earthquake in 1989. In some areas of the world, the effects of drought can be far more severe. In the Horn of Africa the 1984-1985 drought led to a famine that killed 750,000 people.

Problems for plants caused by low water availability include mechanical stresses caused by the withdrawal of cellular water. Drought also causes plants to become more susceptible to various diseases (Simpson (1981). "The Value of Physiological Knowledge of Water Stress in Plants", In *Water Stress on Plants*, (Simpson, G. M., ed.), Praeger, N.Y., pp. 235-265).

In addition to the many land regions of the world that are too arid for most if not all crop plants, overuse and over-utilization of available water is resulting in an increasing loss of agriculturally-usable land, a process which, in the extreme, results in desertification. The problem is further compounded by increasing salt accumulation in soils, as described above, which adds to the loss of available water in soils.
Category: Abiotic Stress; Desired Trait: Heat Tolerance.

Germination of many crops is very sensitive to temperature. A transcription factor that would enhance germination in hot conditions would be useful for crops that are planted late in the season or in hot climates.

Seedlings and mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function (Buchanan, supra).

Heat shock may result a decrease in overall protein synthesis, accompanied by expression of heat shock proteins. Heat shock proteins function as chaperones and are involved in refolding proteins denatured by heat.
Category: Abiotic Stress; Desired Trait: Tolerance to Low Nitrogen and Phosphorus.

The ability of all plants to remove nutrients from their environment is essential to survival. Thus, identification of genes that encode polypeptides with transcription factor activity may allow for the generation of transgenic plants that are better able to make use of available nutrients in nutrient-poor environments.

Among the most important macronutrients for plant growth that have the largest impact on crop yield are nitrogenous and phosphorus-containing compounds. Nitrogen- and phosphorus-containing fertilizers are used intensively in agriculture practices today. An increase in grain crop yields from 0.5 to 1.0 metric tons per hectare to 7 metric tons per hectare accompanied the use of commercial fixed nitrogen fertilizer in production farming (Vance (2001) *Plant Physiol.* 127: 390-397). Given current practices, in order to meet food production demands in years to come, considerable increases in the amount of nitrogen- and phosphorus-containing fertilizers will be required (Vance, supra).

Nitrogen is the most abundant element in the Earth's atmosphere yet it is one of the most limiting elements to plant growth due to its lack of availability in the soil. Plants obtain N from the soil from several sources including commercial fertilizers, manure and the mineralization of organic matter. The intensive use of N fertilizers in present agricultural practices is problematic, the energy intensive Haber-Bosch process makes N fertilizer and it is estimated that the US uses annually between 3-5% of the nation's natural gas for this process. In addition to the expense of N fertilizer production and the depletion of non-renewable resources, the use of N fertilizers has led to the eutrophication of freshwater ecosystems and the contamination of drinking water due to the runoff of excess fertilizer into ground water supplies.

Phosphorus is second only to N in its importance as a macronutrient for plant growth and to its impact on crop yield. Phosphorus (P) is extremely immobile and not readily available to roots in the soil and is therefore often growth limiting to plants. Inorganic phosphate (Pi) is a constituent of several important molecules required for energy transfer, metabolic regulation and protein activation (Marschner (1995) *Mineral Nutrition of Higher Plants,* 2nd ed., Academic Press, San Diego, Calif.). Plants have evolved several strategies to help cope with P and N deprivation that include metabolic as well as developmental adaptations. Most, if not all, of these strategies have components that are regulated at the level of transcription and therefore are amenable to manipulation by transcription factors. Metabolic adaptations include increasing the availability of P and N by increasing uptake from the soil though the induction of high affinity and low affinity transporters, and/or increasing its mobilization in the plant. Developmental adaptations include increases in primary and secondary roots, increases in root hair number and length, and associations with mycorrhizal fungi (Bates and Lynch (1996) *Plant Cell Environ.* 19: 529-538; Harrison (1999) *Annu. Rev. Plant Physiol. Plant Mol. Biol.* 50: 361-389).

Category: Biotic Stress; Desired Trait: Disease Resistance.

Disease management is a significant expense in crop production worldwide. According to EPA reports for 1996 and 1997, US farmers spend approximately $6 billion on fungicides annually. Despite this expenditure, according to a survey conducted by the food and agriculture organization, plant diseases still reduce worldwide crop productivity by 12% and in the United States alone, economic losses due to plant pathogens amounts to 9.1 billion dollars (FAO, 1993). Data from these reports and others demonstrate that despite the availability of chemical control only a small proportion of the losses due to disease can be prevented. Not only are fungicides and anti-bacterial treatments expensive to growers, but their widespread application poses both environmental and health risks. The use of plant biotechnology to engineer disease resistant crops has the potential to make a significant economic impact on agriculture and forestry industries in two ways: reducing the monetary and environmental expense of fungicide application and reducing both pre-harvest and post-harvest crop losses that occur now despite the use of costly disease management practices.

Fungal, bacterial, oomycete, viral, and nematode diseases of plants are ubiquitous and important problems, and often severely impact yield and quality of crop and other plants. A very few examples of diseases of plants include:

Powdery mildew, caused by the fungi *Erysiphe, Sphaerotheca, Phyllactinia, Microsphaera, Podosphaera*, or *Uncinula*, in, for example, wheat, bean, cucurbit, lettuce, pea, grape, tree fruit crops, as well as roses, phlox, lilacs, grasses, and Euonymus;

*Fusarium*-caused diseases such as *Fusarium* wilt in cucurbits, *Fusarium* head blight in barley and wheat, wilt and crown and root rot in tomatoes;

Sudden oak death, caused by the oomycete *Phytophthora ramorum*; this disease was first detected in 1995 in California tan oaks. The disease has since killed more than 100,000 tan oaks, coast live oaks, black oaks, and Shreve's oaks in coastal regions of northern California, and more recently in southwestern Oregon (Roach (2001) *National Geographic News*, Dec. 6, 2001);

Black Sigatoka, a fungal disease caused by *Mycosphaerella* species that attacks banana foliage, is spreading throughout the regions of the world that are responsible for producing most of the world's banana crop;

*Eutypa* dieback, caused by *Eutypa lata*, affects a number of crop plants, including vine grape. *Eutypa* dieback delays shoot emergence, and causes chlorosis, stunting, and tattering of leaves;

Pierce's disease, caused by the bacterium *Xylella fastidiosa*, precludes growth of grapes in the southeastern United States, and threatens the profitable wine grape industry in northern California. The bacterium clogs the vasculature of the grapevines, resulting in foliar scorching followed by slow death of the vines. There is no known treatment for Pierce's disease;

Bacterial Spot caused by the bacterium *Xanthomonas campestris* causes serious disease problems on tomatoes and peppers. It is a significant problem in the Florida tomato industry because it spreads rapidly, especially in warm periods where there is wind-driven rain. Under these conditions, there are no adequate control measures;

Diseases caused by viruses of the family Geminiviridae are a growing agricultural problem worldwide. Geminiviruses have caused severe crop losses in tomato, cassava, and cotton. For instance, in the 1991-1992 growing season in Florida, geminiviruses caused $140 million in damages to the tomato crop (Moffat (1991) *Science* 286: 1835). Geminiviruses have the ability to recombine between strains to rapidly produce new virulent varieties. Therefore, there is a pressing need for broad-spectrum geminivirus control;

The soybean cyst nematode, *Heterodera glycines*, causes stunting and chlorosis of soybean plants, which results in yield losses or plant death from severe infestation. Annual losses in the United States have been estimated at $1.5 billion (University of Minnesota Extension Service).

The aforementioned pathogens represent a very small fraction of diverse species that seriously affect plant health and yield. For a more complete description of numerous plant diseases, see, for example, Vidhyasekaran (1997) *Fungal Pathogenesis in Plants and Crops: Molecular Biology and Host Defense Mechanisms*, Marcel Dekker, Monticello, N.Y.), or Agrios (1997) *Plant Pathology*, Academic Press, New York, N.Y.). Plants that are able to resist disease may produce significantly higher yields and improved food quality. It is thus of considerable importance to find genes that reduce or prevent disease.

Category: Light Response; Desired Trait: Reduced Shade Avoidance.

Shade avoidance describes the process in which plants grown in close proximity attempt to out-compete each other by increasing stem length at the expense of leaf, fruit and storage organ development. This is caused by the plant's response to far-red radiation reflected from leaves of neighboring plants, which is mediated by phytochrome photoreceptors. Close proximity to other plants, as is produced in high-density crop plantings, increases the relative proportion of far-red irradiation, and therefore induces the shade avoidance response. Shade avoidance adversely affects biomass and yield, particularly when leaves, fruits or other storage organs constitute the desired crop (see, for example, Smith (1982) *Annu. Rev. Plant Physiol.* 33: 481-518; Ballare et al. (1990) *Science* 247: 329-332; Smith (1995) *Annu. Dev. Plant Physiol. Mol. Biol.*, 46: 289-315; and Schmitt et al. (1995), *American Naturalist*, 146: 937-953). Alteration of the shade avoidance response in tobacco through alteration of phytochrome levels has been shown to produce an increase in harvest index (leaf biomass/total biomass) at high planting density, which would result in higher yield (Robson et al. (1996) *Nature Biotechnol.* 14: 995-998).

Category: Flowering Time; Desired Trait: Altered Flowering Time and Flowering Control.

Timing of flowering has a significant impact on production of agricultural products. For example, varieties with different flowering responses to environmental cues are necessary to adapt crops to different production regions or systems. Such a range of varieties have been developed for many crops, including wheat, corn, soybean, and strawberry. Improved methods for alteration of flowering time will facilitate the development of new, geographically adapted varieties.

Breeding programs for the development of new varieties can be limited by the seed-to-seed cycle. Thus, breeding new varieties of plants with multi-year cycles (such as biennials, e.g. carrot, or fruit trees, such as citrus) can be very slow. With respect to breeding programs, there would be a significant advantage in having commercially valuable plants that exhibit controllable and modified periods to flowering ("flowering times"). For example, accelerated flowering would shorten crop and tree breeding programs.

Improved flowering control allows more than one planting and harvest of a crop to be made within a single season. Early flowering would also improve the time to harvest plants in which the flower portion of the plant constitutes the product (e.g., broccoli, cauliflower, and other edible flowers). In addition, chemical control of flowering through induction or inhibition of flowering in plants could provide a significant advantage to growers by inducing more uniform fruit production (e.g., in strawberry)

A sizable number of plants for which the vegetative portion of the plant forms the valuable crop tend to "bolt" dramatically (e.g., spinach, onions, lettuce), after which biomass production declines and product quality diminishes (e.g., through flowering-triggered senescence of vegetative parts). Delay or prevention of flowering may also reduce or preclude dissemination of pollen from transgenic plants.

Category: Growth Rate; Desired Trait: Modified Growth Rate.

For almost all commercial crops, it is desirable to use plants that establish more quickly, since seedlings and young plants are particularly susceptible to stress conditions such as salinity or disease. Since many weeds may outgrow young crops or out-compete them for nutrients, it would also be desirable to determine means for allowing young crop plants to out compete weed species. Increasing seedling growth rate (emergence) contributes to seedling vigor and allows for crops to be planted earlier in the season with less concern for losses due to environmental factors. Early planting helps add days to the critical grain-filling period and increases yield.

Providing means to speed up or slow down plant growth would also be desirable to ornamental horticulture. If such means be provided, slow growing plants may exhibit prolonged pollen-producing or fruiting period, thus improving fertilization or extending harvesting season.

Category: Growth Rate; Desired Trait: Modified Senescence and Cell Death.

Premature senescence, triggered by various plant stresses, can limit production of both leaf biomass and seed yield. Transcription factor genes that suppress premature senescence or cell death in response to stresses can provide means for increasing yield. Delay of normal developmental senescence could also enhance yield, particularly for those plants for which the vegetative part of the plant represents the commercial product (e.g., spinach, lettuce).

Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. In an experimental setting, tobacco plants engineered to inhibit leaf senescence had a longer photosynthetic lifespan, and produced a 50% increase in dry weight and seed yield (Gan and Amasino (1995) *Science* 270: 1986-1988). Delayed flower senescence may generate plants that retain their blossoms longer and this may be of potential interest to the ornamental horticulture industry, and delayed foliar and fruit senescence could improve post-harvest shelf-life of produce.

Further, programmed cell death plays a role in other plant responses, including the resistance response to disease, and some symptoms of diseases, for example, as caused by necrotrophic pathogens such as *Botrytis cinerea* and *Sclerotinia sclerotiorum* (Dickman et al. *Proc. Natl. Acad. Sci.*, 98: 6957-6962). Localized senescence and/or cell death can be used by plants to contain the spread of harmful microorganisms. A specific localized cell death response, the "hypersensitive response", is a component of race-specific disease resistance mediated by plant resistance genes. The hypersensitive response is thought to help limit pathogen growth and to initiate a signal transduction pathway that leads to the induction of systemic plant defenses. Accelerated senescence may be a defense against obligate pathogens, such as powdery mildew, that rely on healthy plant tissue for nutrients. With regard to powdery mildew, *Botrytis cinerea* and *Sclerotinia sclerotiorum* and other pathogens, transcription factors that ameliorate cell death and/or damage may reduce the significant economic losses encountered, such as, for example, *Botrytis cinerea* in strawberry and grape.

Category: Growth Regulator; Desired Trait: Altered Sugar Sensing

Sugars are key regulatory molecules that affect diverse processes in higher plants including germination, growth, flowering, senescence, sugar metabolism and photosynthesis. Sucrose, for example, is the major transport form of photosynthate and its flux through cells has been shown to affect gene expression and alter storage compound accumulation in seeds (source-sink relationships). Glucose-specific hexose-sensing has also been described in plants and is implicated in cell division and repression of "famine" genes (photosynthetic or glyoxylate cycles).

Category: Morphology; Desired Trait: Altered Morphology

Trichomes are branched or unbranched epidermal outgrowths or hair structures on a plant. Trichomes produce a variety of secondary biochemicals such as diterpenes and waxes, the former being important as, for example, insect pheromones, and the latter as protectants against desiccation and herbivorous pests. Since diterpenes also have commercial value as flavors, aromas, pesticides and cosmetics, and potential value as anti-tumor agents and inflammation-mediating substances, they have been both products and the target of considerable research. In most cases where the metabolic pathways are impossible to engineer, increasing trichome density or size on leaves may be the only way to increase plant productivity. Thus, it would be advantageous to discover trichome-affecting transcription factor genes for the purpose of increasing trichome density, size, or type to produce plants that are better protected from insects or that yield higher amounts of secondary metabolites.

The ability to manipulate wax composition, amount, or distribution could modify plant tolerance to drought and low humidity or resistance to insects, as well as plant appearance. In particular, a possible application for a transcription factor gene that reduces wax production in sunflower seed coats would be to reduce fouling during seed oil processing. Antisense or co-suppression of transcription factors involved in wax biosynthesis in a tissue specific manner can be used to specifically alter wax composition, amount, or distribution in those plants and crops from which wax is either a valuable attribute or product or an undesirable constituent of plants.

Other morphological characteristics that may be desirable in plants include those of an ornamental nature. These include changes in seed color, overall color, leaf and flower shape, leaf color, leaf size, or glossiness of leaves. Plants that produce dark leaves may have benefits for human health; flavonoids, for example, have been used to inhibit tumor growth, prevent of bone loss, and prevention lipid oxidation in animals and humans. Plants in which leaf size is increased would likely provide greater biomass, which would be particularly valuable for crops in which the vegetative portion of the plant constitutes the product. Plants with glossy leaves generally produce greater epidermal wax, which, if it could be augmented, resulted in a pleasing appearance for many ornamentals, help prevent desiccation, and resist herbivorous insects and disease-causing agents. Changes in plant or plant part coloration, brought about by modifying, for example, anthocyanin levels, would provide novel morphological features.

In many instances, the seeds of a plant constitute a valuable crop. These include, for example, the seeds of many legumes, nuts and grains. The discovery of means for producing larger seed would provide significant value by bringing about an increase in crop yield.

Plants with altered inflorescence, including, for example, larger flowers or distinctive floral configurations, may have high value in the ornamental horticulture industry.

Modifications to flower structure may have advantageous or deleterious effects on fertility, and could be used, for example, to decrease fertility by the absence, reduction or screening of reproductive components. This could be a desirable trait, as it could be exploited to prevent or minimize the escape of the pollen of genetically modified organisms into the environment.

Manipulation of inflorescence branching patterns may also be used to influence yield and offer the potential for more effective harvesting techniques. For example, a "self pruning" mutation of tomato results in a determinate growth pattern and facilitates mechanical harvesting (Pnueli et al. (2001) *Plant Cell* 13(12): 2687-2702).

Alterations of apical dominance or plant architecture could create new plant varieties. Dwarf plants may be of potential interest to the ornamental horticulture industry.

Category: Seed Biochemistry; Desired Trait: Altered Seed Oil

The composition of seeds, particularly with respect to seed oil quantity and/or composition, is very important for the nutritional value and production of various food and feed products. Desirable improvements to oils include enhanced heat stability, improved nutritional quality through, for example, reducing the number of calories in seed, increasing the number of calories in animal feeds, or altering the ratio of saturated to unsaturated lipids comprising the oils.

Category: Seed Biochemistry; Desired Trait: Altered Seed Protein

As with seed oils, seed protein content and composition is very important for the nutritional value and production of various food and feed products. Altered protein content or concentration in seeds may be used to provide nutritional benefits, and may also prolong storage capacity, increase seed pest or disease resistance, or modify germination rates. Altered amino acid composition of seeds, through altered protein composition, is also a desired objective for nutritional improvement.

Category: Seed Biochemistry; Desired Trait: Altered Prenyl Lipids.

Prenyl lipids, including the tocopherols, play a role in anchoring proteins in membranes or membranous organelles. Tocopherols have both anti-oxidant and vitamin E activity. Modified tocopherol composition of plants may thus be useful in improving membrane integrity and function, which may mitigate abiotic stresses such as heat stress. Increasing the anti-oxidant and vitamin content of plants through increased tocopherol content can provide useful human health benefits.

Category: Leaf Biochemistry; Desired Trait: Altered Glucosinolate Levels

Increases or decreases in specific glucosinolates or total glucosinolate content can be desirable depending upon the particular application. For example: (i) glucosinolates are undesirable components of the oilseeds used in animal feed, since they produce toxic effects; low-glucosinolate varieties of canola have been developed to combat this problem; (ii) some glucosinolates have anti-cancer activity; thus, increasing the levels or composition of these compounds can be of use in production of nutraceuticals; and (iii) glucosinolates form part of a plant's natural defense against insects; modification of glucosinolate composition or quantity could therefore afford increased protection from herbivores. Furthermore, tissue specific promoters can be used in edible crops to ensure that these compounds accumulate specifically in particular tissues, such as the epidermis, which are not taken for human consumption.

Category: Leaf Biochemistry; Desired Trait: Flavonoid Production.

Expression of transcription factors that increase flavonoid production in plants, including anthocyanins and condensed tannins, may be used to alter pigment production for horticultural purposes, and possibly to increase stress resistance. Flavonoids have antimicrobial activity and could be used to engineer pathogen resistance. Several flavonoid compounds have human health promoting effects such as inhibition of tumor growth, prevention of bone loss and prevention of lipid oxidation. Increased levels of condensed tannins in forage legumes would provide agronomic benefits in ruminants by preventing pasture bloat by collapsing protein foams within the rumen. For a review on the utilities of flavonoids and their derivatives, see Dixon et al. (1999) *Trends Plant Sci.* 4: 394-400.

The present invention relates to methods and compositions for producing transgenic plants with modified traits, particularly traits that address the agricultural and food needs described in the above background information. These traits may provide significant value in that they allow the plant to thrive in hostile environments, where, for example, temperature, water and nutrient availability or salinity may limit or prevent growth of non-transgenic plants. The traits may also comprise desirable morphological alterations, larger or smaller size, disease and pest resistance, alterations in flowering time, light response, and others.

We have identified polynucleotides encoding transcription factors, developed numerous transgenic plants using these polynucleotides, and have analyzed the plants for a variety of important traits. In so doing, we have identified important polynucleotide and polypeptide sequences for producing commercially valuable plants and crops as well as the methods for making them and using them. Other aspects and embodiments of the invention are described below and can be derived from the teachings of this disclosure as a whole.

SUMMARY OF THE INVENTION

Transgenic plants and methods for producing transgenic plants are provided. The transgenic plants comprise a recombinant polynucleotide having a polynucleotide sequence, or a sequence that is complementary to this polynucleotide sequence, that encodes a transcription factor.

The polynucleotide sequences that encode the transcription factors are listed in the Sequence Listing and include any of any of SEQ ID NO: 2N−1, wherein N=1-229, SEQ ID NO: 459-466; 468-487; 491-500; 504; 506-511; 516-520; 523-524; 527; 529; 531-533; 538-539; 541-557; 560-568; 570-586; 595-596; 598-606; 610-620; 627-634; 640-664; 670-707; 714-719; 722-735; 740-741; 743-779; 808-823; 825-834; 838-850; 855-864; 868-889; 892-902; 908-909; 914-921; 924-925; 927-932; 935-942; 944-952; 961-965; 968-986; 989-993; 995-1010; 1012-1034; 1043-1063; 1074-1080; 1091-1104; 1111-1121; 1123-1128; 1134-1138; 1142-1156; 1159-1175; 1187-1190; 1192-1199; 1202-1220; 1249-1253; 1258-1262; 1264-1269; 1271-1287; 1292-1301; 1303-

1309; 1315-1323; 1328-1337; 1340-1341; 1344-1361; 1365-1377; 1379-1390; 1393-1394; 1396-1398; 1419-1432; 1434-1452; 1455-1456; 1460-1465; 1468-1491; 1499; 1502; 1505-1521; 1523-1527; 1529-1532; 1536-1539; 1542-1562; 1567-1571; 1573-1582; 1587-1592; 1595-1620; 1625-1644; 1647-1654; 1659-1669; 1671-1673; 1675-1680; 1682-1686; 1688-1700; 1706-1709; 1714-1726; 1728-1734; 1738-1742; 1744-1753; 1757-1760; 1763-1764; 1766-1768; 1770-1780; 1782-1784; 1786-1789; 1791-1804; 1806-1812; 1814-1837; 1847-1856; 1858-1862; 1864-1873; 1876-1882; 1885-1896; 1902-1910; 1913-1916; 1921-1928; 1931-1936; 1940-1941; 1944-1946, or SEQ ID NO: 2N−1, wherein N=974-1101.

The transcription factors are comprised of polypeptide sequences listed in the Sequence Listing and include any of SEQ ID NO: 2N, wherein N=1-229, SEQ ID NO: 467; 488-490; 501-503; 505; 512-515; 521-522; 525-526; 528; 530; 534-537; 540; 558-559; 569; 587-594; 597; 607-609; 621-626; 635-639; 665-669; 708-713; 720-721; 736-739; 742; 780-807; 824; 835-837; 851-854; 865-867; 890-891; 903-907; 910-913; 922-923; 926; 933-934; 943; 953-960; 966-967; 987-988; 994; 1011; 1035-1042; 1064-1073; 1081-1090; 1105-1110; 1122; 1129-1133; 1139-1141; 1157-1158; 1176-1186; 1191; 1200-1201; 1221-1248; 1254-1257; 1263; 1270; 1288-1291; 1302; 1310-1314; 1324-1327; 1338-1339; 1342-1343; 1362-1364; 1378; 1391-1392; 1395; 1399-1418; 1433; 1453-1454; 1457-1459; 1466-1467; 1492-1498; 1500-1501; 1503-1504; 1522; 1528; 1533-1535; 1540-1541; 1563-1566; 1572; 1583-1586; 1593-1594; 1621-1624; 1645-1646; 1655-1658; 1670; 1674; 1681; 1687; 1701-1705; 1710-1713; 1727; 1735-1737; 1743; 1754-1756; 1761-1762; 1765; 1769; 1781; 1785; 1790; 1805; 1813; 1838-1846; 1857; 1863; 1874-1875; 1883-1884; 1897-1901; 1911-1912; 1917-1920; 1929-1930; 1937-1939; 1942-1943; or SEQ ID NO: 2N, wherein N=974-1101.

The transgenic plant that comprises the recombinant polynucleotide has a polynucleotide sequence, or a sequence that is complementary to this polynucleotide sequence, selected from any of the following:

(a) a polynucleotide sequence that encodes one of the transcription factor polypeptide sequences of Paragraph 2 of this Summary; or (b) a polynucleotide sequence that comprises one of the polynucleotide sequences of paragraph 3 of this Summary.

The transgenic plant may also comprise a polynucleotide sequence that is a variant of the sequences in (a) and (b) that encode a polypeptide and regulate transcription, including:

(c) a sequence variant of the polynucleotide sequences of (a) or (b);

(d) an allelic variant of the polynucleotide sequences of (a) or (b);

(e) a splice variant of the polynucleotide sequences of (a) or (b);

(f) an orthologous sequence of the polynucleotide sequences of (a) or (b);

(g) a paralogous sequence of the polynucleotide sequences of (a) or (b);

(h) a polynucleotide sequence encoding a polypeptide comprising a conserved domain that exhibits at least 70% sequence homology with the polypeptide of (a), and the polypeptide comprises a conserved domain of a transcription factor that regulates transcription; or (i) a polynucleotide sequence that hybridizes under stringent conditions to a polynucleotide sequence of one or more polynucleotides of (a) or (b), and the polynucleotide sequence encodes a polypeptide that regulates transcription.

A transcription factor sequence variant is one having at least 26% amino acid sequence similarity, or at least 40% amino acid sequence identity. A preferred transcription factor sequence variant is one having at least 50% amino acid sequence identity and a more preferred transcription factor sequence variant is one having at least 65% amino acid sequence identity to the transcription factor polypeptide sequences of paragraph 3 of this Summary, and that contains at least one functional or structural characteristic of the similar transcription factor polypeptide sequences. Sequences having lesser degrees of identity but comparable biological activity are considered to be equivalents.

The transcription factor polypeptides of the present invention include at least one conserved domain, and the portions of the polynucleotide sequences encoding the conserved domain generally exhibit at least 70% sequence identity with the aforementioned preferred polynucleotide sequences. In the case of zinc finger transcription factors, the percent identity across the conserved domain may be as low as 50%.

Various types of plants may be used to generate the transgenic plants, including soybean, wheat, corn, potato, cotton, rice, oilseed rape, sunflower, alfalfa, clover, sugarcane, turf, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, mint and other labiates, rosaceous fruits, and vegetable brassicas.

The transgenic plant may be monocotyledonous, plant, and the polynucleotide sequences used to transform the transgenic plant may be derived from either a monocot or a dicot plant. Alternatively, the transgenic plant may be a dicotyledonous plant, and the polynucleotide sequences used to transform the transgenic plant may be derived from either a monocot or a dicot plant.

These transgenic plants will generally possess traits that are altered as compared to a control plant, such as a wild-type or non-transformed plant (i.e., the non-transformed plant does not comprise the recombinant polynucleotide), thus producing an phenotype that is altered when compared to the control, wild-type or non-transformed plant. These transgenic plants may also express an altered level of one or more genes associated with a plant trait as compared to the non-transformed plant. The encoded polypeptides in these transgenic plants will generally be expressed and regulate transcription of at least one gene; this gene will generally confer at least one altered trait, phenotype or expression level.

Any of the polynucleotide sequences listed in the Sequence Listing, their complements, and functional variants used to transform the transgenic plants of the present invention may further comprise regulatory elements. The regulatory elements, may comprise, for example, constitutive, inducible, or tissue-specific promoters operably linked to a polynucleotide sequence.

Presently disclosed transcription factor sequences may be used to produce transformed plants with a variety of improved traits. An example of such an altered trait is enhanced tolerance to abiotic stress, such as salt tolerance, chilling conditions, and drought conditions. Salt and drought tolerance, both forms of osmotic stress, may be mediated in part by increased root growth or increased root hairs relative to a non-transformed, control or wild-type plant. Tolerance to abiotic stresses such as salt, chilling and drought tolerance may confer a number of survival, quality and yield improvements, including improved seed germination and improved seedling vigor, plant survival, as well as improved yield, quality, and range.

Another example of an altered trait that may be conferred by transforming plants with the presently disclosed transcription factor sequences includes altered sugar sensing. Altered sugar sensing may also be used to confer improved seed germination and improved seedling vigor, as well as altered flowering, senescence, sugar metabolism and photosynthesis characteristics.

The invention also pertains to method to produce these transgenic plants.

The present invention also relates to a method of using transgenic plants transformed with the presently disclosed transcription factor sequences, their complements or their variants to grow a progeny plant by crossing the transgenic plant with either itself or another plant, selecting seed that develops as a result of the crossing; and then growing the progeny plant from the seed. The progeny plant will generally express mRNA that encodes a transcription factor: that is, a DNA-binding protein that binds to a DNA regulatory sequence and regulates gene expression, such as that of a plant trait gene. The mRNA will generally be expressed at a level greater than a non-transformed plant; and the progeny plant is characterized by a change in a plant trait compared to the non-transformed plant.

The present invention also pertains to an expression cassette. The expression cassette comprises at least two elements, including:

(1) a constitutive, inducible, or tissue-specific promoter; and (2) a recombinant polynucleotide having a polynucleotide sequence, or a complementary polynucleotide sequence thereof, selected from the group consisting of a polynucleotide sequence encoding a (a) polypeptide sequence selected from the transcription factor sequences in the third paragraph of this Summary; or (b) a polynucleotide sequence selected from the transcription factor polynucleotides of second paragraph of this Summary, or (c) sequence variants such as allelic or splice variants of the polynucleotide sequences of (a) or (b), where the sequence variant encodes a polypeptide that regulates transcription. The polynucleotide sequence may also comprise an orthologous or paralogous sequence of the polynucleotide sequences of (a) or (b), with these sequences encoding a polypeptide that regulates transcription, a polynucleotide sequence that encoding a polypeptide having a conserved domain that exhibits 72% or greater sequence homology with the polypeptide of (a), where the polypeptide comprising the conserved domain regulates transcription, or a polynucleotide sequence that hybridizes under stringent conditions to a polynucleotide sequence of one or more polynucleotides of (a) or (b), where the latter polynucleotide sequence regulates transcription. In all of these cases, the recombinant polynucleotide is operably linked to the promoter of the expression cassette.

The invention also includes a host cell that comprises the expression cassette. The host cell may be a plant cell, such as, for example, a cell of a crop plant.

The invention also concerns a method for identifying a factor that is modulated by or interacts with a polypeptide of the third paragraph of this Summary. This method is conducted by: expressing the polypeptide in a plant; and then identifying at least one factor that is modulated by or interacts with the polypeptide.

The invention also pertains to a method for identifying at least one downstream polynucleotide sequence that is subject to a regulatory effect of any of the polypeptides of the third paragraph of this Summary. This method includes expressing any of the polypeptides of the third paragraph of this Summary in a plant cell; and then identifying resultant RNA or protein. The latter identification may be carried out with, for example, such methods that include Northern analysis, RT-PCR, microarray gene expression assays, reporter gene expression systems subtractive hybridization, differential display, representational differential analysis, or two-dimensional gel electrophoresis of one or more protein products.

The invention also provides a transgenic plant comprising a polynucleotide encoding a polypeptide with a conserved domain, wherein the conserved domain comprises consecutive amino acid residues Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Glu/Asp-Glu-Glu/Asp-Glu/Asp-Ala-Ala/Val-Arg-Ala/Ser-Tyr-Asp-Val/Ile-Ala/Val-Val/Ala-Xaa-Arg-Phe/Tyr-Arg-Arg/Gly-Arg-Asp-Ala-Val-Thr/Val-Asn-Phe-Lys/Arg of SEQ ID NO:170, wherein Xaa is any amino acid residue. The invention still further provides a transgenic plant comprising a polynucleotide wherein the polynucleotide sequence is selected from the group consisting of SEQ ID NO: 169, 369, 1159 through 1175, 1949, and 2071. In another embodiment, the invention also provides a transgenic plant comprising a polynucleotide encoding a polypeptide, wherein the polypeptide is selected from the group consisting of SEQ ID NO: 170, 370, 1176 through 1186, 1950, and 2072.

The invention also provides an expression cassette comprising a polynucleotide encoding a polypeptide with a conserved domain, wherein the conserved domain comprises consecutive amino acid residues Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Glu/Asp-Glu-Glu/Asp-Glu/Asp-Ala-Ala/Val-Arg-Ala/Ser-Tyr-Asp-Val/Ile-Ala/Val-Val/Ala-Xaa-Arg-Phe/Tyr-Arg-Arg/Gly-Arg-Asp-Ala-Val-Thr/Val-Asn-Phe-Lys/Arg of SEQ ID NO:170, wherein Xaa is any amino acid residue. The invention still further provides an expression cassette comprising a polynucleotide sequence is selected from the group consisting of SEQ ID NO: 169, 369, 1159 through 1175, 1949, and 2071. In another embodiment, the invention also provides an expression cassette comprising a polynucleotide encoding a polypeptide, wherein the polypeptide is selected from the group consisting of SEQ ID NO: 170, 370, 1176 through 1186, 1950, and 2072.

The invention also provides a method for producing a modified plant having a polynucleotide encoding a polypeptide with a conserved domain, wherein the conserved domain comprises consecutive amino acid residues Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Glu/Asp-Glu-Glu/Asp-Glu/Asp-Ala-Ala/Val-Arg-Ala/Ser-Tyr-Asp-Val/Ile-Ala/Val-Val/Ala-Xaa-Arg-Phe/Tyr-Arg-Arg/Gly-Arg-Asp-Ala-Val-Thr/Val-Asn-Phe-Lys/Arg of SEQ ID NO:170, wherein Xaa is any amino acid residue. The invention still further provides a method for producing a modified plant having a polynucleotide, wherein the polynucleotide sequence is selected from the group consisting of SEQ ID NO: 169, 369, 1159 through 1175, 1949, and 2071. In another embodiment, the invention also provides a method for producing a modified plant having a polynucleotide encoding a polypeptide, wherein the polypeptide is selected from the group consisting of SEQ ID NO: 170, 370, 1176 through 1186, 1950, and 2072.

BRIEF DESCRIPTION OF THE SEQUENCE LISTING AND DRAWINGS

The Sequence Listing provides exemplary polynucleotide and polypeptide sequences of the invention. The traits associated with the use of the sequences are included in the Examples.

A computer-readable format (CRF) of a Sequence Listing is provided in ASCII text format. The Sequence Listing is named "MBI0047-2DIV_ST25.txt", file creation date of Jun. 5, 2003, and is 6,258 kilobytes in size. The Sequence Listing is hereby incorporated by reference in their its entirety.

FIG. 1 shows a conservative estimate of phylogenetic relationships among the orders of flowering plants (modified from Angiosperm Phylogeny Group (1998) *Ann. Missouri Bot. Gard.* 84: 1-49). Those plants with a single cotyledon (monocots) are a monophyletic clade nested within at least two major lineages of dicots; the eudicots are further divided into rosids and asterids. *Arabidopsis* is a rosid eudicot classified within the order Brassicales; rice is a member of the monocot order Poales. FIG. 1 was adapted from Daly et al. (2001) *Plant Physiol.* 127: 1328-1333.

FIG. 2 shows a phylogenic dendogram depicting phylogenetic relationships of higher plant taxa, including clades containing tomato and *Arabidopsis*; adapted from Ku et al. (2000) *Proc. Natl. Acad. Sci.* 97: 9121-9126; and Chase et al. (1993) *Ann. Missouri Bot. Gard.* 80: 528-580.

FIGS. 3A, and 3B show an alignment of G682 (SEQ ID NO: 148) and polynucleotide sequences that are paralogous and orthologous to G682. The alignment was produced using MACVECTOR software (Accelrys, Inc., San Diego, Calif.).

FIGS. 4A, 4B, 4C and 4D show an alignment of G867 (SEQ ID NO: 170) and polynucleotide sequences that are paralogous and orthologous to G867. The alignment was produced using MACVECTOR software (Accelrys, Inc.).

FIGS. 5A, 5B, 5C, 5D, 5E and 5F show an alignment of G912 (SEQ ID NO: 186) and polynucleotide sequences that are paralogous and orthologous to G912. The alignment was produced using MACVECTOR software (Accelrys, Inc.).

DETAILED DESCRIPTION OF EXEMPLARY EMBODIMENTS

Figure 1:
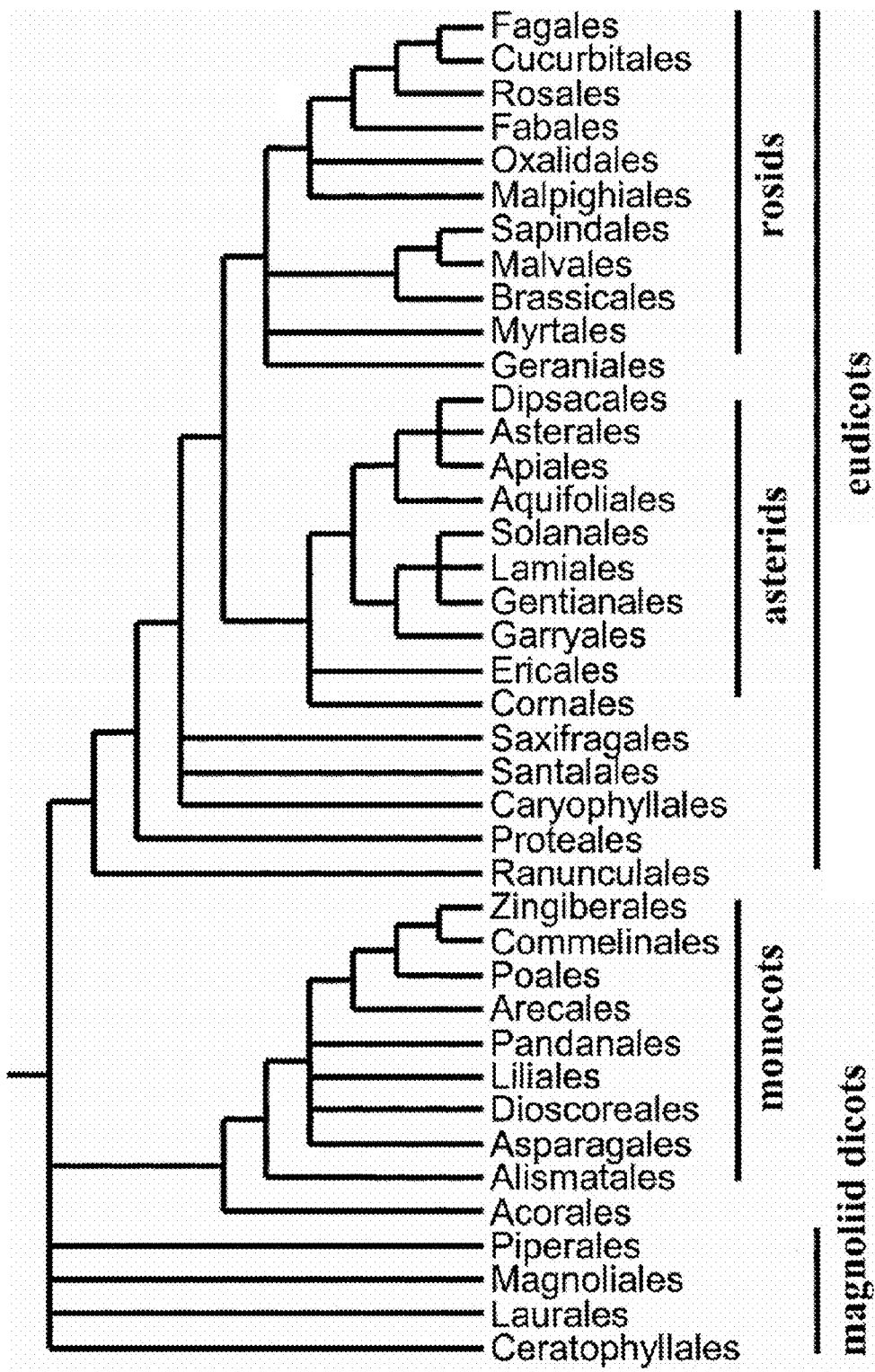

In an important aspect, the present invention relates to polynucleotides and polypeptides, for example, for modifying phenotypes of plants. Throughout this disclosure, various information sources are referred to and/or are specifically incorporated. The information sources include scientific journal articles, patent documents, textbooks, and World Wide Web browser-inactive page addresses, for example. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

It must be noted that as used herein and in the appended claims, the singular forms "a," "an," and "the" include plural reference unless the context clearly dictates otherwise. Thus, for example, a reference to "a plant" includes a plurality of such plants, and a reference to "a stress" is a reference to one or more stresses and equivalents thereof known to those skilled in the art, and so forth.

The polynucleotide sequences of the invention encode polypeptides that are members of well-known transcription factor families, including plant transcription factor families, as disclosed in Tables 4-5. Generally, the transcription factors encoded by the present sequences are involved in cellular metabolism, cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semi-synthetic or recombinant. The sequences of the invention may also include fragments of the present amino acid sequences. In this context, a "fragment" refers to a fragment of a polypeptide sequence which is at least 5 to about 15 amino acids in length, most preferably at least 14 amino acids, and which retain some biological activity of a transcription factor. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

As one of ordinary skill in the art recognizes, transcription factors can be identified by the presence of a region or domain of structural similarity or identity to a specific consensus sequence or the presence of a specific consensus DNA-binding site or DNA-binding site motif (see, for example, Riechmann et al. (2000) *Science* 290: 2105-2110). The plant transcription factors may belong to one of the following transcription factor families: the AP2 (APETALA2) domain transcription factor family (Riechmann and Meyerowitz (1998) *Biol. Chem.* 379: 633-646); the MYB transcription factor family (ENBib; Martin and Paz-Ares (1997) *Trends Genet.* 13: 67-73); the MADS domain transcription factor family (Riechmann and Meyerowitz (1997) *Biol. Chem.* 378: 1079-1101); the WRKY protein family (Ishiguro and Nakamura (1994) *Mol. Gen. Genet.* 244: 563-571); the ankyrin-repeat protein family (Zhang et al. (1992) *Plant Cell* 4: 1575-1588); the zinc finger protein (Z) family (Klug and Schwabe (1995) *FASEB J.* 9: 597-604); Takatsuji (1998) *Cell. Mol. Life Sci.* 54:582-596); the homeobox (HB) protein family (Buerglin (1994) in *Guidebook to the Homeobox Genes.* Duboule (ed.) Oxford University Press); the CAAT-element binding proteins (Forsburg and Guarente (1989) *Genes Dev.* 3: 1166-1178); the squamosa promoter binding proteins (SPB) (Klein et al. (1996) *Mol. Gen. Genet.* 1996 250: 7-16); the NAM protein family (Souer et al. (1996) *Cell* 85: 159-170); the IAA/AUX proteins (Abel et al. (1995) *J. Mol. Biol.* 251: 533-549); the HLH/MYC protein family (Littlewood et al. (1994) *Prot. Profile* 1: 639-709); the DNA-binding protein (DBP) family (Tucker et al. (1994) *EMBO J.* 13: 2994-3002); the bZIP family of transcription factors (Foster et al. (1994) *FASEB J.* 8: 192-200); the Box P-binding protein (the BPF-1) family (da Costa e Silva et al. (1993) *Plant J.* 4: 125-135); the high mobility group (HMG) family (Bustin and Reeves (1996) *Prog. Nucl. Acids Res. Mol. Biol.* 54: 35-100); the scarecrow (SCR) family (Di Laurenzio et al. (1996) *Cell* 86: 423-433); the GF14 family (Wu et al. (1997) *Plant Physiol.* 114: 1421-1431); the polycomb (PCOMB) family (Goodrich et al. (1997) *Nature* 386: 44-51); the teosinte branched (TEO) family (Luo et al. (1996) *Nature* 383: 794-799); the ABI3 family (Giraudat et al. (1992) *Plant Cell* 4: 1251-1261); the triple helix (TH) family (Dehesh et al. (1990) *Science* 250: 1397-1399); the EIL family (Chao et al. (1997) *Cell* 89:

1133-44); the AT-HOOK family (Reeves and Nissen (1990) *J. Biol. Chem.* 265: 8573-8582); the S1FA family (Zhou et al. (1995) *Nucleic Acids Res.* 23: 1165-1169); the bZIPT2 family (Lu and Ferl (1995) *Plant Physiol.* 109: 723); the YABBY family (Bowman et al. (1999) *Development* 126: 2387-96); the PAZ family (Bohmert et al. (1998) *EMBO J.* 17: 170-80); a family of miscellaneous (MISC) transcription factors including the DPBF family (Kim et al. (1997) *Plant J.* 11: 1237-1251) and the SPF1 family (Ishiguro and Nakamura (1994) *Mol. Gen. Genet.* 244: 563-571); the GARP family (Hall et al. (1998) *Plant Cell* 10: 925-936), the TUBBY family (Boggin et al (1999) *Science* 286: 2119-2125), the heat shock family (Wu (1995) *Annu. Rev. Cell Dev. Biol.* 11: 441-469), the ENBP family (Christiansen et al. (1996) *Plant Mol. Biol.* 32: 809-821), the RING-zinc family (Jensen et al. (1998) *FEBS Letters* 436: 283-287), the PDBP family (Janik et al. (1989) *Virology* 168: 320-329), the PCF family (Cubas et al. *Plant J.* (1999) 18: 215-22), the SRS(SHI-related) family (Fridborg et al. (1999) *Plant Cell* 11: 1019-1032), the CPP (cysteine-rich polycomb-like) family (Cvitanich et al. (2000) *Proc. Natl. Acad. Sci.* 97: 8163-8168), the ARF (auxin response factor) family (Ulmasov et al. (1999) *Proc. Natl. Acad. Sci.* 96: 5844-5849), the SWI/SNF family (Collingwood et al. (1999) *J. Mol. Endocrinol.* 23: 255-275), the ACBF family (Seguin et al. (1997) *Plant Mol. Biol.* 35: 281-291), PCGL (CG-1 like) family (da Costa e Silva et al. (1994) *Plant Mol. Biol.* 25: 921-924) the ARID family (Vazquez et al. (1999) *Development* 126: 733-742), the Jumonji family (Balciunas et al. (2000), *Trends Biochem. Sci.* 25: 274-276), the bZIP-NIN family (Schauser et al. (1999) *Nature* 402: 191-195), the E2F family (Kaelin et al. (1992) *Cell* 70: 351-364) and the GRF-like family (Knaap et al. (2000) *Plant Physiol.* 122: 695-704). As indicated by any part of the list above and as known in the art, transcription factors have been sometimes categorized by class, family, and sub-family according to their structural content and consensus DNA-binding site motif, for example. Many of the classes and many of the families and sub-families are listed here. However, the inclusion of one sub-family and not another, or the inclusion of one family and not another, does not mean that the invention does not encompass polynucleotides or polypeptides of a certain family or sub-family. The list provided here is merely an example of the types of transcription factors and the knowledge available concerning the consensus sequences and consensus DNA-binding site motifs that help define them as known to those of skill in the art (each of the references noted above are specifically incorporated herein by reference). A transcription factor may include, but is not limited to, any polypeptide that can activate or repress transcription of a single gene or a number of genes. This polypeptide group includes, but is not limited to, DNA-binding proteins, DNA-binding protein binding proteins, protein kinases, protein phosphatases, protein methyltransferases, GTP-binding proteins, and receptors, and the like.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the transcription factors. A "polynucleotide" is a nucleic acid molecule comprising a plurality of polymerized nucleotides, e.g., at least about 15 consecutive polymerized nucleotides, optionally at least about 30 consecutive nucleotides, at least about 50 consecutive nucleotides. A polynucleotide may be a nucleic acid, oligonucleotide, nucleotide, or any fragment thereof. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a PCR product, a cloned DNA, a synthetic DNA or RNA, or the like. The polynucleotide can be combined with carbohydrate, lipids, protein, or other materials to perform a particular activity such as transformation or form a useful composition such as a peptide nucleic acid (PNA). The polynucleotide can comprise a sequence in either sense or antisense orientations. "Oligonucleotide" is substantially equivalent to the terms amplimer, primer, oligomer, element, target, and probe and is preferably single stranded.

Definitions

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "polypeptide" is an amino acid sequence comprising a plurality of consecutive polymerized amino acid residues e.g., at least about 15 consecutive polymerized amino acid residues, optionally at least about 30 consecutive polymerized amino acid residues, at least about 50 consecutive polymerized amino acid residues. In many instances, a polypeptide comprises a polymerized amino acid residue sequence that is a transcription factor or a domain or portion or fragment thereof. A transcription factor can regulate gene expression and may increase or decrease gene expression in a plant. Additionally, the polypeptide may comprise 1) a localization domain, 2) an activation domain, 3) a repression domain, 4) an oligomerization domain, or 5) a DNA-binding domain, or the like. The polypeptide optionally comprises modified amino acid residues, naturally occurring amino acid residues not encoded by a codon, non-naturally occurring amino acid residues.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences.

Figure 4C:
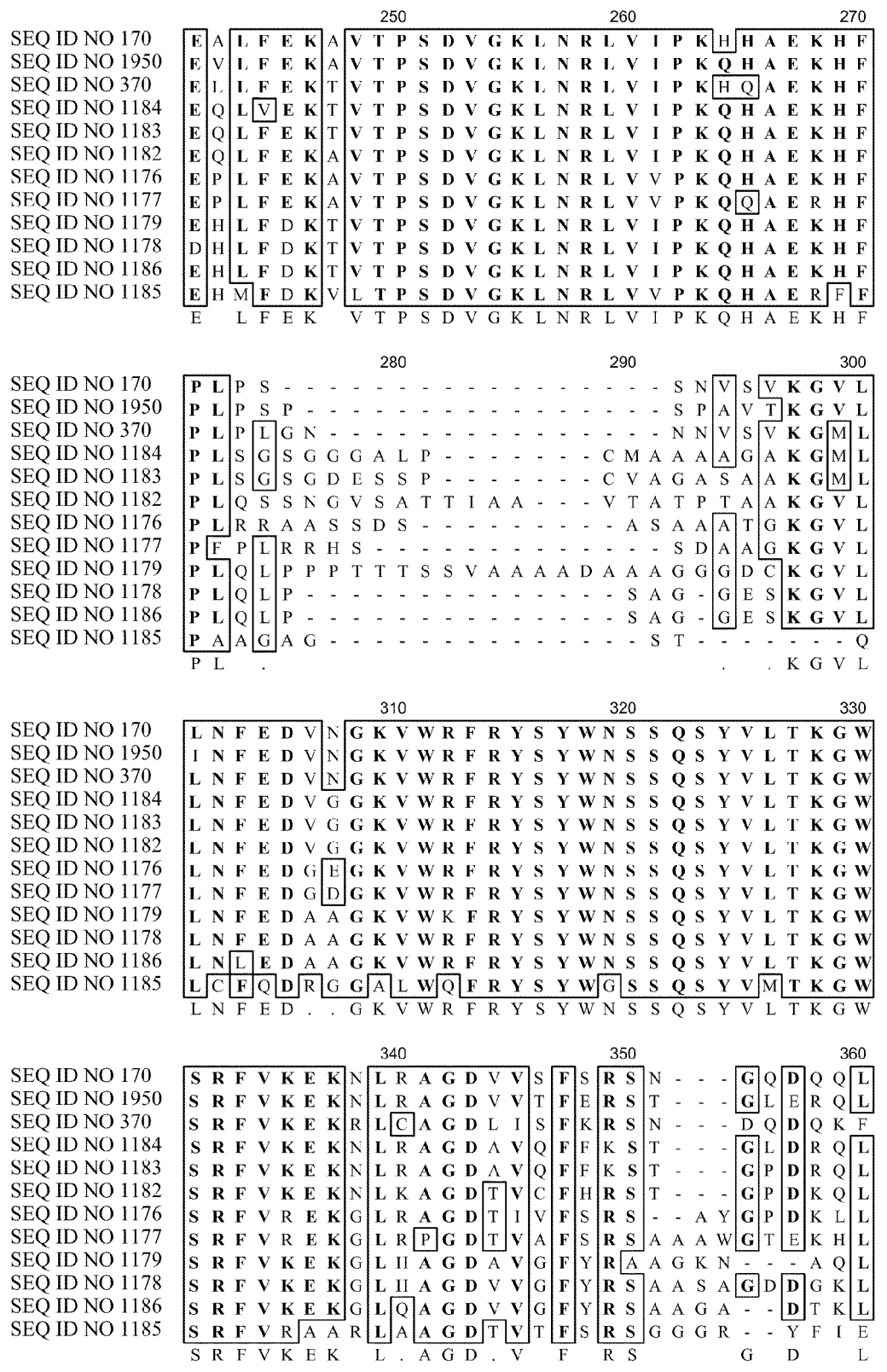

"Alignment" refers to a number of DNA or amino acid sequences aligned by lengthwise comparison so that components in common (i.e., nucleotide bases or amino acid residues) may be visually and readily identified. The fraction or percentage of components in common is related to the homology or identity between the sequences. Alignments such as those of FIG. 3, 4, or 5 may be used to identify conserved domains and relatedness within these domains. An alignment may suitably be determined by means of computer programs known in the art, such as MACVECTOR software (1999) (Accelrys, Inc., San Diego, Calif.).

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985) *Nature* 313:402-404, and Sambrook et al. (1989) *Molecular Cloning: A Laboratory Manual,* 2nd Ed., Cold Spring Harbor Laboratory, Cold Spring Harbor, N.Y. ("Sambrook"); and by Haymes et al., "Nucleic Acid Hybridization: A Practical Approach", IRL Press, Washington, D.C. (1985), which references are incorporated herein by reference.

In general, stringency is determined by the temperature, ionic strength, and concentration of denaturing agents (e.g., formamide) used in a hybridization and washing procedure (for a more detailed description of establishing and determining stringency, see below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, transcription factors having 60% identity, or more preferably greater than about 70% identity, most preferably 72% or greater identity with disclosed transcription factors.

The term "equivalog" describes members of a set of homologous proteins that are conserved with respect to function since their last common ancestor. Related proteins are grouped into equivalog families, and otherwise into protein families with other hierarchically defined homology types. This definition is provided at the Institute for Genomic Research (TIGR) website, www.tigr.org; "Terms associated with TIGRFAMs".

The term "variant", as used herein, may refer to polynucleotides or polypeptides that differ from the presently disclosed polynucleotides or polypeptides, respectively, in sequence from each other, and as set forth below.

With regard to polynucleotide variants, differences between presently disclosed polynucleotides and their variants are limited so that the nucleotide sequences of the former and the latter are closely similar overall and, in many regions, identical. The degeneracy of the genetic code dictates that many different variant polynucleotides can encode identical and/or substantially similar polypeptides in addition to those sequences illustrated in the Sequence Listing. Due to this degeneracy, differences between presently disclosed polynucleotides and variant nucleotide sequences may be silent in any given region or over the entire length of the polypeptide (i.e., the amino acids encoded by the polynucleotide are the same, and the variant polynucleotide sequence thus encodes the same amino acid sequence in that region or entire length of the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations result in polynucleotide variants encoding polypeptides that share at least one functional characteristic (i.e., a presently disclosed transcription factor and a variant will confer at least one of the same functions to a plant).

Within the scope of the invention is a variant of a nucleic acid listed in the Sequence Listing (except CBF polynucleotide sequences SEQ ID NOs: 1955, 1957, 1959, or 2203), that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code.

"Allelic variant" or "polynucleotide allelic variant" refers to any of two or more alternative forms of a gene occupying the same chromosomal locus. Allelic variation arises naturally through mutation, and may result in phenotypic polymorphism within populations. Gene mutations may be "silent" or may encode polypeptides having altered amino acid sequences. "Allelic variant" and "polypeptide allelic variant" may also be used with respect to polypeptides, and in this case the terms refer to a polypeptide encoded by an allelic variant of a gene.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. Thus, splice variants may encode polypeptides having different amino acid sequences, which, in the present context, will have at least one similar function in the organism (splice variation may also give rise to distinct polypeptides having different functions). "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. For more detail on conservative substitutions, see Table 2. More rarely, a variant may have "non-conservative" changes, e.g., replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/ or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

Figure 2:
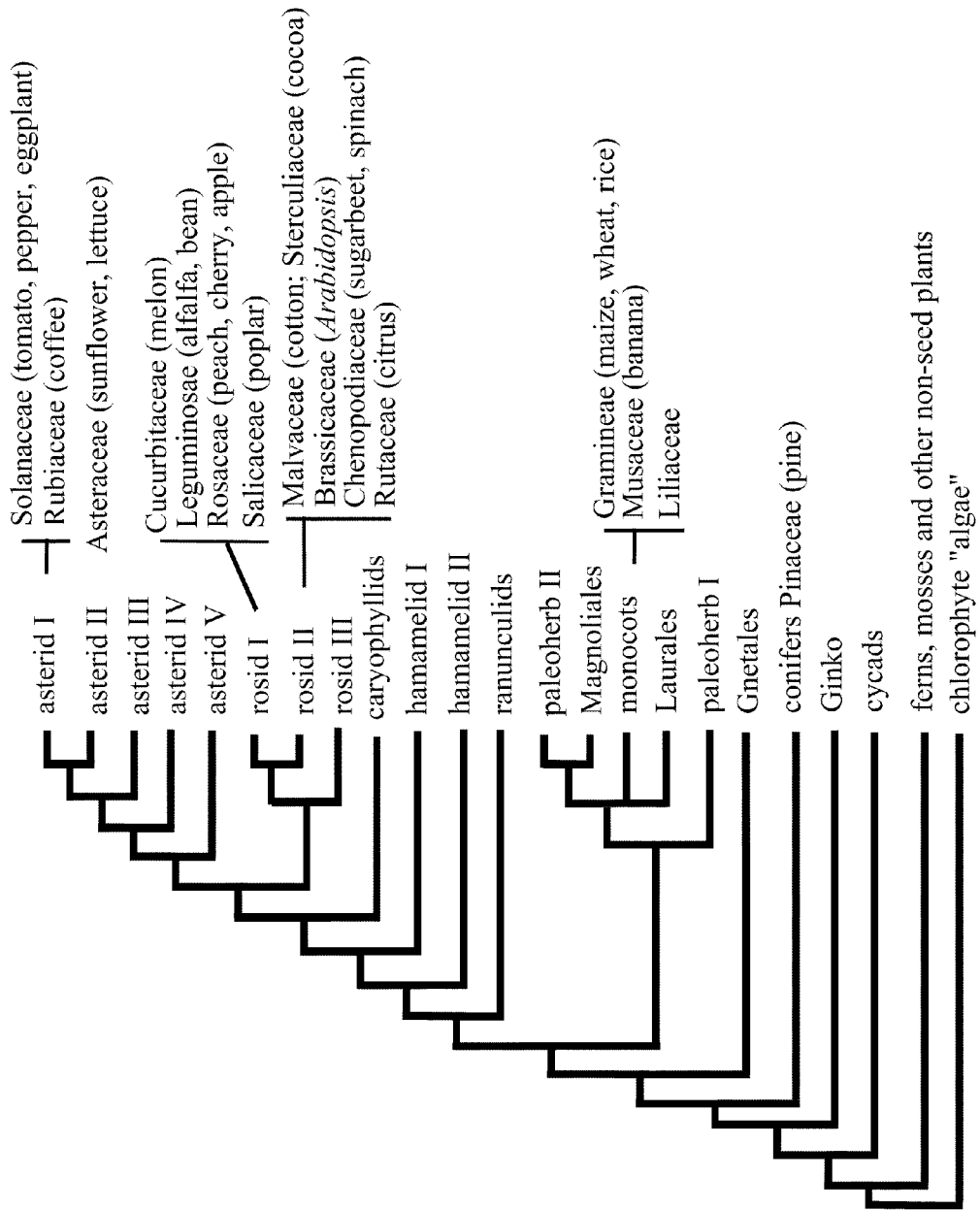

The term "plant" includes whole plants, shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like) and cells (e.g., guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae. (See for example, FIG. 1, adapted from Daly et al. (2001) *Plant Physiol.* 127: 1328-1333; FIG. 2, adapted from Ku et al. (2000) *Proc. Natl. Acad. Sci.* 97: 9121-9126; and see also Tudge, in *The Variety of Life*, Oxford University Press, New York, N.Y. (2000) pp. 547-606).

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the expression of polypeptide. The expression cassette can be introduced into a plant by transformation or by breeding after transformation of a parent plant. A plant refers to a whole plant, including seedlings and mature plants, as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A polynucleotide fragment" refers to any subsequence of a polynucleotide, typically, of at least about 9 consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments also include fragments that comprise a region that encodes a conserved domain of a transcription factor.

Fragments may also include subsequences of polypeptides and protein molecules, or a subsequence of the polypeptide. Fragments may have uses in that they may have antigenic potential. In some cases, the fragment or domain is a subsequence of the polypeptide that performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as 3 amino acids to the full length of the intact polypeptide, but are preferably at least about 30 amino acids in length and more preferably at least about 60 amino acids in length. Exemplary polypeptide fragments are the first twenty consecutive amino acids of a mammalian protein encoded by are the first twenty consecutive amino acids of the transcription factor polypeptides listed in the Sequence Listing.

Exemplary fragments also include fragments that comprise a conserved domain of a transcription factor. An example of such an exemplary fragment would include amino acid residues 59-124 of G867 (SEQ ID NO: 170), as noted in Table 5.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

A "conserved domain" or "conserved region" as used herein refers to a region in heterologous polynucleotide or polypeptide sequences where there is a relatively high degree of sequence identity between the distinct sequences.

With respect to polynucleotides encoding presently disclosed transcription factors, a conserved region is preferably at least 10 base pairs (bp) in length.

A "conserved domain", with respect to presently disclosed polypeptides refers to a domain within a transcription factor family that exhibits a higher degree of sequence homology, such as at least 26% sequence similarity, at least 16% sequence identity, preferably at least 40% sequence identity, preferably at least 65% sequence identity including conservative substitutions, and more preferably at least 80% sequence identity, and even more preferably at least 85%, or at least about 86%, or at least about 87%, or at least about 88%, or at least about 90%, or at least about 95%, or at least about 98% amino acid residue sequence identity of a polypeptide of consecutive amino acid residues. A fragment or domain can be referred to as outside a conserved domain, outside a consensus sequence, or outside a consensus DNA-binding site that is known to exist or that exists for a particular transcription factor class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains of transcription factors may be identified as regions or domains of identity to a specific consensus sequence (see, for example, Riechmann et al. (2000) supra). Thus, by using alignment methods well known in the art, the conserved domains of the plant transcription factors for each of the following may be determined: the AP2 (APETALA2) domain transcription factor family (Riechmann and Meyerowitz (1998) supra; the MYB transcription factor family (ENBib; Martin and Paz-Ares (1997) supra); the MADS domain transcription factor family (Riechmann and Meyerowitz (1997) supra); the WRKY protein family (Ishiguro and Nakamura (1994) supra); the ankyrin-repeat protein family (Zhang et al. (1992) supra); the zinc finger protein (Z) family (Klug and Schwabe (1995) supra; Takatsuji (1998) supra); the homeobox (HB) protein family (Buerglin (1994) supra); the CAAT-element binding proteins (Forsburg and Guarente (1989) supra); the squamosa promoter binding proteins (SPB) (Klein et al. (1996) supra); the NAM protein family (Souer et al. (1996) supra); the IAA/AUX proteins (Abel et al. (1995) supra); the HLH/MYC protein family (Littlewood et al. (1994) supra); the DNA-binding protein (DBP) family (Tucker et al. (1994) supra); the bZIP family of transcription factors (Foster et al. (1994) supra); the Box P-binding protein (the BPF-1) family (da Costa e Silva et al. (1993) supra); the high mobility group (HMG) family (Bustin and Reeves (1996) supra); the scarecrow (SCR) family (Di Laurenzio et al. (1996) supra); the GF14 family (Wu et al. (1997) supra); the polycomb (PCOMB) family (Goodrich et al. (1997) supra); the teosinte branched (TEO) family (Luo et al. (1996) supra); the ABI3 family (Giraudat et al. (1992) supra); the triple helix (TH) family (Dehesh et al. (1990) supra); the EIL family (Chao et al. (1997) *Cell* supra); the AT-HOOK family (Reeves and Nissen (1990) supra); the S1FA family (Zhou et al. (1995) supra); the bZIPT2 family (Lu and Ferl (1995) supra); the YABBY family (Bowman et al. (1999) supra); the PAZ family (Bohmert et al. (1998) supra); a family of miscellaneous (MISC) transcription factors including the DPBF family (Kim et al. (1997) supra) and the SPF1 family (Ishiguro and Nakamura (1994) supra); the GARP family (Hall et al. (1998) supra), the TUBBY family (Boggin et al. (1999) supra), the heat shock family (Wu (1995) supra), the ENBP family (Christiansen et al. (1996) supra), the RING-zinc family (Jensen et al. (1998) supra), the PDBP family (Janik et al. (1989) supra), the PCF family (Cubas et al. (1999) supra), the SRS(SHI-related) family (Fridborg et al. (1999) supra), the CPP (cysteine-rich polycomb-like) family (Cvitanich et al. (2000) supra), the ARF (auxin response factor) family (Ulmasov et al. (1999) supra), the SWI/SNF family (Collingwood et al. (1999) supra), the ACBF family (Seguin et al. (1997) supra), PCGL (CG-1 like) family (da Costa e Silva et al. (1994) supra) the ARID family (Vazquez et al. (1999) supra), the Jumonji family, (Balciunas et al. (2000) supra), the bZIP-NIN family (Schauser et al. (1999) supra), the E2F family Kaelin et al. (1992) supra) and the GRF-like family (Knaap et al (2000) supra).

The conserved domains for each of polypeptides of SEQ ID NO: 2N, wherein N=1-229, are listed in Table 5 as described in Example VII. Also, many of the polypeptides of Table 5 have conserved domains specifically indicated by start and stop sites. A comparison of the regions of the polypeptides in SEQ ID NO: 2N, wherein N=1-229, or of those in Table 5, allows one of skill in the art to identify conserved domain(s) for any of the polypeptides listed or referred to in this disclosure, including those in Tables 4-8.

As used herein, a "gene" is a functional unit of inheritance, and in physical terms is a particular segment or sequence of nucleotides along a molecule of DNA (or RNA, in the case of RNA viruses) involved in producing a functional RNA molecule, such as one used for a structural or regulatory role, or a polypeptide chain, such as one used for a structural or regulatory role (an example of the latter would be transcription regulation, as by a transcription factor polypeptide). Polypeptides may then be subjected to subsequent processing such as splicing and/or folding to obtain a functional polypeptide. A gene may be isolated, partially isolated, or be found with an organism's genome. By way of example, a transcription factor gene encodes a transcription factor polypeptide, which may be functional with or without additional processing to function as an initiator of transcription.

Operationally, genes may be defined by the cis-trans test, a genetic test that determines whether two mutations occur in the same gene and which may be used to determine the limits of the genetically active unit (Rieger et al. (1976) *Glossary of Genetics and Cytogenetics: Classical and Molecular*, 4th ed., Springer Verlag. Berlin). A gene generally includes regions preceding ("leaders"; upstream) and following ("trailers"; downstream) of the coding region. A gene may also include intervening, non-coded sequences, referred to as "introns", which are located between individual coding segments, referred to as "exons". Most genes have an identifiable associated promoter region, a regulatory sequence 5' or upstream of the transcription initiation codon. The function of a gene may also be regulated by enhancers, operators, and other regulatory elements.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease in an observed trait (difference), at least a 5% difference, at least about a 10% difference, at least about a 20% difference, at least about a 30%, at least about a 50%, at least about a 70%, or at least about a 100%, or an even greater difference compared with a wild-type plant. It is known that there can be a natural variation in the modified trait. Therefore, the trait modification observed entails a change of the normal distribution of the trait in the plants compared with the distribution observed in wild-type plant.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

"Wild type", as used herein, refers to a cell, tissue or plant that has not been genetically modified to knock out or overexpress one or more of the presently disclosed transcription factors. Wild-type cells, tissue or plants may be used as controls to compare levels of expression and the extent and nature of trait modification with modified (e.g., transgenic) cells, tissue or plants in which transcription factor expression is altered or ectopically expressed by, for example, knocking out or overexpressing a gene.

"Ectopic expression" or "altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. Altered expression may be achieved by, for example, transformation of a plant with an expression cassette having a constitutive or inducible promoter element associated with a transcription factor gene. The resulting expression pattern can thus constitutive or inducible, and be stable or transient. Altered or ectopic expression may also refer to altered expression patterns that are produced by lowering the levels of expression to below the detection level or completely abolishing expression by, for example, knocking out a gene's expression by disrupting expression or regulation of the gene with an insertion element.

In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong expression signal, such as one of the promoters described herein (e.g., the cauliflower mosaic virus 35S transcription initiation region). Overexpression may occur throughout a plant or in specific tissues of the plant, depending on the promoter used, as described below.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level than in the organism or tissues of the overexpressor. Overexpression thus results in a greater than normal production, or "overproduction" of the transcription factor in the plant, cell or tissue.

The term "phase change" refers to a plant's progression from embryo to adult, and, by some definitions, the transition wherein flowering plants gain reproductive competency. It is believed that phase change occurs either after a certain number of cell divisions in the shoot apex of a developing plant, or when the shoot apex achieves a particular distance from the roots. Thus, altering the timing of phase changes may affect a plant's size, which, in turn, may affect yield and biomass.

Traits that May be Modified in Overexpressing or Knock-Out Plants

Trait modifications of particular interest include those to seed (such as embryo or endosperm), fruit, root, flower, leaf, stem, shoot, seedling or the like, including: enhanced tolerance to environmental conditions including freezing, chilling, heat, drought, water saturation, radiation and ozone; improved tolerance to microbial, fungal or viral diseases; improved tolerance to pest infestations, including insects, nematodes, mollicutes, parasitic higher plants or the like; decreased herbicide sensitivity; improved tolerance of heavy metals or enhanced ability to take up heavy metals; improved growth under poor photoconditions (e.g., low light and/or short day length), or changes in expression levels of genes of interest. Other phenotype that can be modified relate to the production of plant metabolites, such as variations in the production of taxol, tocopherol, tocotrienol, sterols, phytosterols, vitamins, wax monomers, anti-oxidants, amino acids, lignins, cellulose, tannins, prenyllipids (such as chlorophylls and carotenoids), glucosinolates, and terpenoids, enhanced or compositionally altered protein or oil production (especially in seeds), or modified sugar (insoluble or soluble) and/or starch composition. Physical plant characteristics that can be modified include cell development (such as the number of trichomes), fruit and seed size and number, yields of plant parts such as stems, leaves, inflorescences, and roots, the stability of the seeds during storage, characteristics of the seed pod (e.g., susceptibility to shattering), root hair length and quantity, internode distances, or the quality of seed coat. Plant growth characteristics that can be modified include growth rate, germination rate of seeds, vigor of plants and seedlings, leaf and flower senescence, male sterility, apomixis, flowering time, flower abscission, rate of nitrogen uptake, osmotic sensitivity to soluble sugar concentrations, biomass or transpiration characteristics, as well as plant architecture characteristics such as apical dominance, branching patterns, number of organs, organ identity, organ shape or size.

Transcription Factors Modify Expression of Endogenous Genes

Expression of genes that encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) *Genes and Development* 11:3194-3205, and Peng et al. (1999) *Nature* 400: 256-261. In addition, many others have demonstrated that an *Arabidopsis* transcription factor expressed in an exogenous plant species elicits the same or very similar phenotypic response. See, for example, Fu et al. (2001) *Plant Cell* 13: 1791-1802; Nandi et al. (2000, *Curr. Biol.* 10: 215-218; Coupland (1995) *Nature* 377: 482-483; and Weigel and Nilsson (1995) *Nature* 377: 482-500.

In another example, Mandel et al. (1992) *Cell* 71-133-143 and Suzuki et al. (2001) *Plant J.* 28: 409-418, teach that a transcription factor expressed in another plant species elicits the same or very similar phenotypic response of the endogenous sequence, as often predicted in earlier studies of *Arabidopsis* transcription factors in *Arabidopsis* (see Mandel et al. (1992) supra; Suzuki et al. (2001) supra).

Other examples include Müller et al. (2001) *Plant J.* 28: 169-179; Kim et al. (2001) *Plant J.* 25: 247-259; Kyozuka and Shimamoto (2002) *Plant Cell Physiol.* 43: 130-135; Boss and Thomas (2002) *Nature* 416: 847-850; He et al. (2000) *Transgenic Res.* 9: 223-227; and Robson et al. (2001) *Plant J.* 28: 619-631.

In yet another example, Gilmour et al. (1998) *Plant J.* 16: 433-442, teach an *Arabidopsis* AP2 transcription factor, CBF1 (SEQ ID NO: 1956), which, when overexpressed in transgenic plants, increases plant freezing tolerance. Jaglo et al. (2001) *Plant Physiol.* 127: 910-917, further identified sequences in *Brassica napus* which encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues, PKK/RPAGRxKFxETRHP (SEQ ID NO: 2907) and DSAWR (SEQ ID NO: 2908), that bracket the AP2/EREBP DNA binding domains of the proteins and distinguish them from other members of the AP2/EREBP protein family. (See Jaglo et al. supra).

Gao et al. (2002) *Plant Molec. Biol.* 49: 459-471) have recently described four CBF transcription factors from *Brassica napus*: BNCBFs 5, 7, 16 and 17. They note that the first three CBFs (GenBank Accession Numbers AAM18958, AAM18959, and AAM18960, respectively) are very similar to *Arabidopsis* CBF1, whereas BNCBF17 (GenBank Accession Number AAM18961) is similar but contains two extra regions of 16 and 21 amino acids in its acidic activation domain. All four *B. napus* CBFs accumulate in leaves of the plants after cold-treatment, and BNCBFs 5, 7, 16 accumulated after salt stress treatment. The authors concluded that these BNCBFs likely function in low-temperature responses in *B. napus*.

In a functional study of CBF genes, Hsieh et al. ((2002) *Plant Physiol.* 129: 1086-1094) found that heterologous expression of *Arabidopsis* CBF1 in tomato plants confers increased tolerance to chilling and considerable tolerance to oxidative stress, which suggested to the authors that ectopic *Arabidopsis* CBF1 expression may induce several tomato stress responsive genes to protect the plants.

Polypeptides and Polynucleotides of the Invention

The present invention provides, among other things, transcription factors (TFs), and transcription factor homolog polypeptides, and isolated or recombinant polynucleotides encoding the polypeptides, or novel sequence variant polypeptides or polynucleotides encoding novel variants of transcription factors derived from the specific sequences provided here. These polypeptides and polynucleotides may be employed to modify a plant's characteristics.

Exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full-length cDNA was then recovered by a routine end-to-end polymerase chain reaction (PCR) using primers specific to the isolated 5' and 3' ends. Exemplary sequences are provided in the Sequence Listing.

The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants.

Producing Polypeptides

The polynucleotides of the invention include sequences that encode transcription factors and transcription factor homolog polypeptides and sequences complementary thereto, as well as unique fragments of coding sequence, or sequence complementary thereto. Such polynucleotides can be, e.g., DNA or RNA, e.g., mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homolog polypeptide, in isolation, in combination with additional coding sequences (e.g., a purification tag, a localization signal, as a fusion-protein, as a pre-protein, or the like), in combination with non-coding sequences (e.g., introns or inteins, regulatory elements such as promoters, enhancers, terminators, and the like), and/or in a vector or host environment in which the polynucleotide encoding a transcription factor or transcription factor homolog polypeptide is an endogenous or exogenous gene.

A variety of methods exist for producing the polynucleotides of the invention. Procedures for identifying and isolating DNA clones are well known to those of skill in the art, and are described in, e.g., Berger and Kimmel, *Guide to Molecular Cloning Techniques, Methods in Enzymology*, vol. 152 Academic Press, Inc., San Diego, Calif. ("Berger"); Sambrook et al. (1989) *Molecular Cloning—A Laboratory Manual* (2nd Ed.), Vol. 1-3, Cold Spring Harbor Laboratory, Cold Spring Harbor, N.Y., and *Current Protocols in Molecular Biology*, Ausubel et al. eds., Current Protocols, a joint venture between Greene Publishing Associates, Inc. and John Wiley & Sons, Inc., (supplemented through 2000) ("Ausubel").

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qbeta-replicase amplification and other RNA polymerase mediated techniques (e.g., NASBA), e.g., for the production of the homologous nucleic acids of the invention are found in Berger (supra), Sambrook (supra), and Ausubel (supra), as well as Mullis et al. (1987) *PCR Protocols A Guide to Methods and Applications* (Innis et al. eds) Academic Press Inc. San Diego, Calif. (1990) (Innis). Improved methods for cloning in vitro amplified nucleic acids are described in Wallace et al. U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) *Tetrahedron Letters* 22: 1859-1869; and Matthes et al. (1984) *EMBO J.* 3: 801-805. According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Homologous Sequences

Sequences homologous, i.e., that share significant sequence identity or similarity, to those provided in the Sequence Listing (except CBF sequences SEQ ID NOs: 1955-1960), derived from *Arabidopsis thaliana* or from other plants of choice, are also an aspect of the invention. Homologous sequences can be derived from any plant including monocots and dicots and in particular agriculturally important plant species, including but not limited to, crops such as soybean, wheat, corn (maize), potato, cotton, rice, rape, oil-seed rape (including canola), sunflower, alfalfa, clover, sugarcane, and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, tomatillo, watermelon, rosaceous fruits (such as apple, peach, pear, cherry and plum) and vegetable brassicas (such as broccoli, cabbage, cauliflower, Brussels sprouts, and kohlrabi). Other crops, including fruits and vegetables, whose phenotype can be changed and which comprise homologous sequences include barley; rye; millet; sorghum; currant; avocado; citrus fruits such as oranges, lemons, grapefruit and tangerines, artichoke, cherries; nuts such as the walnut and peanut; endive; leek; roots such as arrowroot, beet, cassava, turnip, radish, yam, and sweet potato; and beans. The homologous sequences may also be derived from woody species, such pine, poplar and *eucalyptus*, or mint or other labiates. In addition, homologous sequences may be derived from plants that are evolutionarily-related to crop plants, but which may not have yet been used as crop plants. Examples include deadly nightshade (*Atropa belladona*), related to tomato; jimson weed (*Datura strommium*), related to peyote; and teosinte (*Zea* species), related to corn (maize).

Orthologs and Paralogs

Homologous sequences as described above can comprise orthologous or paralogous sequences. Several different methods are known by those of skill in the art for identifying and defining these functionally homologous sequences. Three general methods for defining orthologs and paralogs are described; an ortholog or paralog, including equivalogs, may be identified by one or more of the methods described below.

Orthologs and paralogs are evolutionarily related genes that have similar sequence and similar functions. Orthologs are structurally related genes in different species that are derived by a speciation event. Paralogs are structurally related genes within a single species that are derived by a duplication event.

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994) Nucleic Acids Res. 22: 4673-4680; Higgins et al. (1996) Methods Enzymol. 266: 383-402). Groups of similar genes can also be identified with pair-wise BLAST analysis (Feng and Doolittle (1987) *J. Mol. Evol.* 25: 351-360). For example, a clade of very similar MADS domain transcription factors from *Arabidopsis* all share a common function in flowering time (Ratcliffe et al. (2001) *Plant Physiol.* 126: 122-132), and a group of very similar AP2 domain transcription factors from *Arabidopsis* are involved in tolerance of plants to freezing (Gilmour et al. (1998) Plant J. 16: 433-442). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount (2001), in *Bioinformatics: Sequence and Genome Analysis*, Cold Spring Harbor Laboratory Press, Cold Spring Harbor, N.Y., page 543.)

Speciation, the production of new species from a parental species, can also give rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994) Nucleic Acids Res. 22: 4673-4680; Higgins et al. (1996) supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

Transcription factor gene sequences are conserved across diverse eukaryotic species lines (Goodrich et al. (1993) *Cell* 75: 519-530; Lin et al. (1991) *Nature* 353: 569-571; Sadowski et al. (1988) *Nature* 335: 563-564). et al. Plants are no exception to this observation; diverse plant species possess transcription factors that have similar sequences and functions.

Orthologous genes from different organisms have highly conserved functions, and very often essentially identical functions (Lee et al. (2002) *Genome Res.* 12: 493-502; Remm et al. (2001) *J. Mol. Biol.* 314: 1041-1052). Paralogous genes, which have diverged through gene duplication, may retain similar functions of the encoded proteins. In such cases, paralogs can be used interchangeably with respect to certain embodiments of the instant invention (for example, transgenic expression of a coding sequence). An example of such highly related paralogs is the CBF family, with three well-defined members in *Arabidopsis* and at least one ortholog in *Brassica napus* (SEQ ID NOs: 1956, 1958, 1960, or 2204, respectively), all of which control pathways involved in both freezing and drought stress (Gilmour et al. (1998) *Plant J.* 16: 433-442; Jaglo et al. (1998) *Plant Physiol.* 127: 910-917).

The following references represent a small sampling of the many studies that demonstrate that conserved transcription factor genes from diverse species are likely to function similarly (i.e., regulate similar target sequences and control the same traits), and that transcription factors may be transformed into diverse species to confer or improve traits.

(1) The *Arabidopsis* NPR1 gene regulates systemic acquired resistance (SAR); over-expression of NPR1 leads to enhanced resistance in *Arabidopsis*. When either *Arabidopsis* NPR1 or the rice NPR1 ortholog was overexpressed in rice (which, as a monocot, is diverse from *Arabidopsis*), challenge with the rice bacterial blight pathogen *Xanthomonas oryzae* pv. *Oryzae*, the transgenic plants displayed enhanced resistance (Chern et al. (2001) *Plant J.* 27: 101-113). NPR1 acts through activation of expression of transcription factor genes, such as TGA2 (Fan and Dong (2002) *Plant Cell* 14: 1377-1389).

(2) E2F genes are involved in transcription of plant genes for proliferating cell nuclear antigen (PCNA). Plant E2Fs share a high degree of similarity in amino acid sequence between monocots and dicots, and are even similar to the conserved domains of the animal E2Fs. Such conservation indicates a functional similarity between plant and animal E2Fs. E2F transcription factors that regulate meristem development act through common cis-elements, and regulate related (PCNA) genes (Kosugi and Ohashi, (2002) *Plant J.* 29: 45-59).

(3) The ABI5 gene (abscisic acid (ABA) insensitive 5) encodes a basic leucine zipper factor required for ABA response in the seed and vegetative tissues. Co-transformation experiments with ABI5 cDNA constructs in rice protoplasts resulted in specific transactivation of the ABA-inducible wheat, *Arabidopsis*, bean, and barley promoters. These results demonstrate that sequentially similar ABI5 transcription factors are key targets of a conserved ABA signaling pathway in diverse plants. (Gampala et al. (2001) *J. Biol. Chem.* 277: 1689-1694).

(4) Sequences of three *Arabidopsis* GAMYB-like genes were obtained on the basis of sequence similarity to GAMYB genes from barley, rice, and *L. temulentum*. These three *Arabadopsis* genes were determined to encode transcription factors (AtMYB33, AtMYB65, and AtMYB101) and could substitute for a barley GAMYB and control alpha-amylase expression (Gocal et al. (2001) *Plant Physiol.* 127: 1682-1693).

(5) The floral control gene LEAFY from *Arabidopsis* can dramatically accelerate flowering in numerous dicotyledonous plants. Constitutive expression of *Arabidopsis* LEAFY also caused early flowering in transgenic rice (a monocot), with a heading date that was 26-34 days earlier than that of wild-type plants. These observations indicate that floral regulatory genes from *Arabidopsis* are useful tools for heading date improvement in cereal crops (He et al. (2000) *Transgenic Res.* 9: 223-227).

(6) Bioactive gibberellins (GAs) are essential endogenous regulators of plant growth. GA signaling tends to be conserved across the plant kingdom. GA signaling is mediated via GAI, a nuclear member of the GRAS family of plant transcription factors. *Arabidopsis* GAI has been shown to function in rice to inhibit gibberellin response pathways (Fu et al. (2001) *Plant Cell* 13: 1791-1802).

(7) The *Arabidopsis* gene SUPERMAN (SUP), encodes a putative transcription factor that maintains the boundary between stamens and carpels. By over-expressing *Arabidopsis* SUP in rice, the effect of the gene's presence on whorl boundaries was shown to be conserved. This demonstrated that SUP is a conserved regulator of floral whorl boundaries and affects cell proliferation (Nandi et al. (2000) *Curr. Biol.* 10: 215-218).

(8) Maize, petunia and *Arabidopsis* myb transcription factors that regulate flavonoid biosynthesis are very genetically similar and affect the same trait in their native species, therefore sequence and function of these myb transcription factors correlate with each other in these diverse species (Borevitz et al. (2000) *Plant Cell* 12: 2383-2394).

(9) Wheat reduced height-1 (Rht-B1/Rht-D1) and maize dwarf-8 (d8) genes are orthologs of the *Arabidopsis* gibberellin insensitive (GAI) gene. Both of these genes have been used to produce dwarf grain varieties that have improved grain yield. These genes encode proteins that resemble nuclear transcription factors and contain an SH2-like domain, indicating that phosphotyrosine may participate in gibberellin signaling. Transgenic rice plants containing a mutant GAI allele from *Arabidopsis* have been shown to produce reduced responses to gibberellin and are dwarfed, indicating that mutant GAI orthologs could be used to increase yield in a wide range of crop species (Peng et al. (1999) *Nature* 400: 256-261).

Transcription factors that are homologous to the listed sequences will typically share, in at least one conserved domain, at least about 70% amino acid sequence identity, and with regard to zinc finger transcription factors, at least about 50% amino acid sequence identity. More closely related transcription factors can share at least about 70%, or about 75% or about 80% or about 90% or about 95% or about 98% or more sequence identity with the listed sequences, or with the listed sequences but excluding or outside a known consensus sequence or consensus DNA-binding site, or with the listed sequences excluding one or all conserved domain. Factors that are most closely related to the listed sequences share, e.g., at least about 85%, about 90% or about 95% or more % sequence identity to the listed sequences, or to the listed sequences but excluding or outside a known consensus sequence or consensus DNA-binding site or outside one or all conserved domain. At the nucleotide level, the sequences will typically share at least about 40% nucleotide sequence identity, preferably at least about 50%, about 60%, about 70% or about 80% sequence identity, and more preferably about 85%, about 90%, about 95% or about 97% or more sequence identity to one or more of the listed sequences, or to a listed sequence but excluding or outside a known consensus sequence or consensus DNA-binding site, or outside one or all conserved domain. The degeneracy of the genetic code enables major variations in the nucleotide sequence of a polynucleotide while maintaining the amino acid sequence of the encoded protein. Conserved domains within a transcription factor family may exhibit a higher degree of sequence homology, such as at least 65% amino acid sequence identity including conservative substitutions, and preferably at least 80% sequence identity, and more preferably at least 85%, or at least about 86%, or at least about 87%, or at least about 88%, or at least about 90%, or at least about 95%, or at least about 98% sequence identity. Transcription factors that are homologous to the listed sequences should share at least 30%, or at least about 60%, or at least about 75%, or at least about 80%, or at least about 90%, or at least about 95% amino acid sequence identity over the entire length of the polypeptide or the homolog.

Percent identity can be determined electronically, e.g., by using the MEGALIGN program (DNASTAR, Inc. Madison, Wis.). The MEGALIGN program can create alignments between two or more sequences according to different methods, for example, the clustal method. (See, for example, Higgins and Sharp (1988) *Gene* 73: 237-244.) The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Other techniques for alignment are described in Doolittle, R. F. (1996) *Methods in Enzymology: Computer Methods for Macromolecular Sequence Analysis*, vol. 266, Academic Press, Orlando, Fla., USA. Preferably, an alignment program that permits gaps in the sequence is utilized to align the sequences. The Smith-Waterman is one type of algorithm that permits gaps in sequence alignments (see Shpaer (1997) *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method. (See, e.g., Hein (1990) *Methods Enzymol.* 183: 626-645.) Identity between sequences can also be determined by other methods known in the art, e.g., by varying hybridization conditions (see US Patent Application No. 20010010913).

The percent identity between two conserved domains of a transcription factor DNA-binding domain consensus polypeptide sequence can be as low as 16%, as exemplified in the case of GATA1 family of eukaryotic $Cys_2/Cys_2$-type zinc finger transcription factors. The DNA-binding domain consensus polypeptide sequence of the GATA1 family is $CX_2CX_{17}CX_2C$, where X is any amino acid residue. (See, for example, Takatsuji, supra.) Other examples of such conserved consensus polypeptide sequences with low overall percent sequence identity are well known to those of skill in the art.

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997) *Nucleic Acids Res.* 25: 217-221), PFAM, and other databases which contain previously identified and annotated motifs, sequences and gene functions. Methods that search for primary sequence patterns with secondary structure gap penalties (Smith et al. (1992) *Protein Engineering* 5: 35-51) as well as algorithms such as Basic Local Alignment Search Tool (BLAST; Altschul (1993) *J. Mol. Evol.* 36: 290-300; Altschul et al. (1990) supra), BLOCKS (Henikoff and Henikoff (1991) *Nucleic Acids Res.* 19: 6565-6572), Hidden Markov Models (HMM; Eddy (1996) *Curr. Opin. Str. Biol.* 6: 361-365; Sonnhammer et al. (1997) *Proteins* 28: 405-420), and the like, can be used to manipulate and analyze polynucleotide and polypeptide sequences encoded by polynucleotides. These databases, algorithms and other methods are well known in the art and are described in Ausubel et al. (1997; *Short Protocols in Molecular Biology*, John Wiley & Sons, New York, N.Y., unit 7.7) and in Meyers (1995; *Molecular Biology and Biotechnology*, Wiley VCH, New York, N.Y., p 856-853).

Furthermore, methods using manual alignment of sequences similar or homologous to one or more polynucleotide sequences or one or more polypeptides encoded by the polynucleotide sequences may be used to identify regions of similarity and conserved domains. Such manual methods are well-known of those of skill in the art and can include, for example, comparisons of tertiary structure between a polypeptide sequence encoded by a polynucleotide which comprises a known function with a polypeptide sequence encoded by a polynucleotide sequence which has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

Orthologs and paralogs of presently disclosed transcription factors may be cloned using compositions provided by the present invention according to methods well known in the art. cDNAs can be cloned using mRNA from a plant cell or tissue that expresses one of the present transcription factors. Appropriate mRNA sources may be identified by interrogating Northern blots with probes designed from the present transcription factor sequences, after which a library is prepared from the mRNA obtained from a positive cell or tissue. Transcription factor-encoding cDNA is then isolated using, for example, PCR, using primers designed from a presently disclosed transcription factor gene sequence, or by probing with a partial or complete cDNA or with one or more sets of degenerate probes based on the disclosed sequences. The cDNA library may be used to transform plant cells. Expression of the cDNAs of interest is detected using, for example, methods disclosed herein such as microarrays, Northern blots, quantitative PCR, or any other technique for monitoring changes in expression. Genomic clones may be isolated using similar techniques to those.

Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited above.

Encompassed by the invention are polynucleotide sequences that are capable of hybridizing to the claimed polynucleotide sequences, including any of the transcription factor polynucleotides within the Sequence Listing (excluding CBF sequences SEQ ID NOs: 1955, 1957, 1959, or 2203), and fragments thereof under various conditions of stringency (See, for example, Wahl and Berger (1987) *Methods Enzymol.* 152: 399-407; and Kimmel (1987) *Methods Enzymol.* 152: 507-511). In addition to the nucleotide sequences listed in Tables 4 and 5, full length cDNA, orthologs, and paralogs of the present nucleotide sequences may be identified and isolated using well-known methods. The cDNA libraries orthologs, and paralogs of the present nucleotide sequences may be screened using hybridization methods to determine their utility as hybridization target or amplification probes.

With regard to hybridization, conditions that are highly stringent, and means for achieving them, are well known in the art. See, for example, Sambrook et al. (1989) "*Molecular Cloning: A Laboratory Manual*" (2nd ed., Cold Spring Harbor Laboratory); Berger and Kimmel, eds., (1987) "Guide to Molecular Cloning Techniques", In *Methods in Enzymology*: 152: 467-469; and Anderson and Young (1985) "Quantitative Filter Hybridisation." In: Hames and Higgins, ed., *Nucleic Acid Hybridisation, A Practical Approach*. Oxford, IRL Press, 73-111.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equation:

$$\text{DNA-DNA: } T_m(°\text{C.}) = 81.5 + 16.6(\log[\text{Na}+]) + 0.41(\% \ G+C) - 0.62(\% \text{ formamide}) - 500/L \quad (1)$$

$$\text{DNA-RNA: } T_m(°\text{C.}) = 79.8 + 18.5(\log[\text{Na}+]) + 0.58(\% \ G+C) + 0.12(\% \ G+C)^2 - 0.5(\% \text{ formamide}) - 820/L \quad (2)$$

$$\text{RNA-RNA: } T_m(°\text{C.}) = 79.8 + 18.5(\log[\text{Na}+]) + 0.58(\% \ G+C) + 0.12(\% \ G+C)^2 - 0.35(\% \text{ formamide}) - 820/L \quad (3)$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1-% mismatch.

Hybridization experiments are generally conducted in a buffer of pH between 6.8 to 7.4, although the rate of hybridization is nearly independent of pH at ionic strengths likely to be used in the hybridization buffer (Anderson et al. (1985)

supra). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m$–5° C. to $T_m$–20° C., moderate stringency at $T_m$–20° C. to $T_m$–35° C. and low stringency at $T_m$–35° C. to $T_m$–50° C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m$–25° C. for DNA-DNA duplex and $T_m$–15° C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide. In a most preferred embodiment, hybridization will occur at 42° C. in 250 mM NaCl, 25 mM trisodium citrate, 1% SDS, 50% formamide. Useful variations on these conditions will be readily apparent to those skilled in the art.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate. For example, the wash conditions may be under conditions of 0.1×SSC to 2.0×SSC and 0.1% SDS at 50-65° C., with, for example, two steps of 10-30 min. One example of stringent wash conditions includes about 2.0×SSC, 0.1% SDS at 65° C. and washing twice, each wash step being about 30 min. A higher stringency wash is about 0.2×SSC, 0.1% SDS at 65° C. and washing twice for 30 min. A still higher stringency wash is about 0.1×SSC, 0.1% SDS at 65° C. and washing twice for 30 min. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homolog, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, U.S. Patent Application No. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a calorimetric label, a radioactive label, or the like. Labeled hybridization or PCR probes for detecting related polynucleotide sequences may be produced by oligolabeling, nick translation, end-labeling, or PCR amplification using a labeled nucleotide.

Identifying Polynucleotides or Nucleic Acids with Expression Libraries

In addition to hybridization methods, transcription factor homolog polypeptides can be obtained by screening an expression library using antibodies specific for one or more transcription factors. With the provision herein of the disclosed transcription factor, and transcription factor homolog nucleic acid sequences, the encoded polypeptide(s) can be expressed and purified in a heterologous expression system (e.g., *E. coli*) and used to raise antibodies (monoclonal or polyclonal) specific for the polypeptide(s) in question. Antibodies can also be raised against synthetic peptides derived from transcription factor, or transcription factor homolog, amino acid sequences. Methods of raising antibodies are well known in the art and are described in Harlow and Lane (1988), *Antibodies: A Laboratory Manual*, Cold Spring Harbor Laboratory, New York. Such antibodies can then be used to screen an expression library produced from the plant from which it is desired to clone additional transcription factor homologs, using the methods described above. The selected cDNAs can be confirmed by sequencing and enzymatic activity.

Sequence Variations

It will readily be appreciated by those of skill in the art, that any of a variety of polynucleotide sequences are capable of encoding the transcription factors and transcription factor homolog polypeptides of the invention. Due to the degeneracy of the genetic code, many different polynucleotides can encode identical and/or substantially similar polypeptides in addition to those sequences illustrated in the Sequence Listing (except CBF polypeptide sequences SEQ ID NOs: 1956, 1958, 1960, or 2204). Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the Sequence Listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms which may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that, for example, G28, SEQ ID NO: 10, represents a single transcription factor; allelic variation and alternative splicing may be expected to occur. Allelic variants of SEQ ID NO: 9 can be cloned by probing cDNA or genomic libraries from different individual organisms according to standard procedures. Allelic variants of the DNA sequence shown in SEQ ID NO: 9, including those containing silent mutations and those in which mutations result in amino acid sequence changes, are within the scope of the present invention, as are proteins which are allelic variants of SEQ ID NO: 10. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

Thus, in addition to the sequences set forth in the Sequence Listing (except CBF sequences), the invention also encompasses related nucleic acid molecules that include allelic or splice variants of SEQ ID NO: 2N−1, wherein N=1-229, SEQ ID NO: 459-466; 468-487; 491-500; 504; 506-511; 516-520; 523-524; 527; 529; 531-533; 538-539; 541-557; 560-568; 570-586; 595-596; 598-606; 610-620; 627-634; 640-664; 670-707; 714-719; 722-735; 740-741; 743-779; 808-823; 825-834; 838-850; 855-864; 868-889; 892-902; 908-909; 914-921; 924-925; 927-932; 935-942; 944-952; 961-965; 968-986; 989-993; 995-1010; 1012-1034; 1043-1063; 1074-1080; 1091-1104; 1111-1121; 1123-1128; 1134-1138; 1142-1156; 1159-1175; 1187-1190; 1192-1199; 1202-1220; 1249-1253; 1258-1262; 1264-1269; 1271-1287; 1292-1301; 1303-1309; 1315-1323; 1328-1337; 1340-1341; 1344-1361; 1365-1377; 1379-1390; 1393-1394; 1396-1398; 1419-1432; 1434-1452; 1455-1456; 1460-1465; 1468-1491; 1499; 1502; 1505-1521; 1523-1527; 1529-1532; 1536-1539; 1542-1562; 1567-1571; 1573-1582; 1587-1592; 1595-1620; 1625-1644; 1647-1654; 1659-1669; 1671-1673; 1675-1680; 1682-1686; 1688-1700; 1706-1709; 1714-1726; 1728-1734; 1738-1742; 1744-1753; 1757-1760; 1763-1764; 1766-1768; 1770-1780; 1782-1784; 1786-1789; 1791-1804; 1806-1812; 1814-1837; 1847-1856; 1858-1862; 1864-1873; 1876-1882; 1885-1896; 1902-1910; 1913-1916; 1921-1928; 1931-1936; 1940-1941; 1944-1946, or SEQ ID NO: 2N−1, wherein N=974-1101, and include sequences which are complementary to any of the above nucleotide sequences. Related nucleic acid molecules also include nucleotide sequences encoding a polypeptide comprising or consisting essentially of a substitution, modification, addition and/or deletion of one or more amino acid residues compared to the polypeptide as set forth in any of SEQ ID NO: 2N, wherein N=1-229, SEQ ID NO: 467; 488-490; 501-503; 505; 512-515; 521-522; 525-526; 528; 530; 534-537; 540; 558-559; 569; 587-594; 597; 607-609; 621-626; 635-639; 665-669; 708-713; 720-721; 736-739; 742; 780-807; 824; 835-837; 851-854; 865-867; 890-891; 903-907; 910-913; 922-923; 926; 933-934; 943; 953-960; 966-967; 987-988; 994; 1011; 1035-1042; 1064-1073; 1081-1090; 1105-1110; 1122; 1129-1133; 1139-1141; 1157-1158; 1176-1186; 1191; 1200-1201; 1221-1248; 1254-1257; 1263; 1270; 1288-1291; 1302; 1310-1314; 1324-1327; 1338-1339; 1342-1343; 1362-1364; 1378; 1391-1392; 1395; 1399-1418; 1433; 1453-1454; 1457-1459; 1466-1467; 1492-1498; 1500-1501; 1503-1504; 1522; 1528; 1533-1535; 1540-1541; 1563-

1566; 1572; 1583-1586; 1593-1594; 1621-1624; 1645-1646; 1655-1658; 1670; 1674; 1681; 1687; 1701-1705; 1710-1713; 1727; 1735-1737; 1743; 1754-1756; 1761-1762; 1765; 1769; 1781; 1785; 1790; 1805; 1813; 1838-1846; 1857; 1863; 1874-1875; 1883-1884; 1897-1901; 1911-1912; 1917-1920; 1929-1930; 1937-1939; 1942-1943; or SEQ ID NO: 2N, wherein N=974-1101. Such related polypeptides may comprise, for example, additions and/or deletions of one or more N-linked or O-linked glycosylation sites, or an addition and/or a deletion of one or more cysteine residues.

For example, Table 1 illustrates, e.g., that the codons AGC, AGT, TCA, TCC, TCG, and TCT all encode the same amino acid: serine. Accordingly, at each position in the sequence where there is a codon encoding serine, any of the above trinucleotide sequences can be used without altering the encoded polypeptide.

TABLE 1

| Amino acid | | | Possible Codons |
|---|---|---|---|
| Alanine | Ala | A | GCA GCC GCG GCU |
| Cysteine | Cys | C | TGC TGT |
| Aspartic acid | Asp | D | GAC GAT |
| Glutamic acid | Glu | E | GAA GAG |
| Phenylalanine | Phe | F | TTC TTT |
| Glycine | Gly | G | GGA GGC GGG GGT |
| Histidine | His | H | CAC CAT |
| Isoleucine | Ile | I | ATA ATC ATT |
| Lysine | Lys | K | AAA AAG |
| Leucine | Leu | L | TTA TTG CTA CTC CTG CTT |
| Methionine | Met | M | ATG |
| Asparagine | Asn | N | AAC AAT |
| Proline | Pro | P | CCA CCC CCG CCT |
| Glutamine | Gln | Q | CAA CAG |
| Arginine | Arg | R | AGA AGG CGA CGC CGG CGT |
| Serine | Ser | S | AGC AGT TCA TCC TCG TCT |
| Threonine | Thr | T | ACA ACC ACG ACT |
| Valine | Val | V | GTA GTC GTG GTT |
| Tryptophan | Trp | W | TGG |
| Tyrosine | Tyr | Y | TAC TAT |

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acids in the encoded polypeptide, can be made without altering the function of the polypeptide, these conservative variants are, likewise, a feature of the invention.

For example, substitutions, deletions and insertions introduced into the sequences provided in the Sequence Listing (except CBF polypeptide sequences SEQ ID NOs: 1956, 1958, 1960, or 2204, listed therein), are also envisioned by the invention. Such sequence modifications can be engineered into a sequence by site-directed mutagenesis (Wu (ed.) *Methods Enzymol.* (1993) vol. 217, Academic Press) or the other methods noted below. Amino acid substitutions are typically of single residues; insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 2 when it is desired to maintain the activity of the protein. Table 2 shows amino acids which can be substituted for an amino acid in a protein and which are typically regarded as conservative substitutions.

TABLE 2

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Similar substitutions are those in which at least one residue in the amino acid sequence has been removed and a different residue inserted in its place. Such substitutions generally are made in accordance with the Table 3 when it is desired to maintain the activity of the protein. Table 3 shows amino acids which can be substituted for an amino acid in a protein and which are typically regarded as structural and functional substitutions. For example, a residue in column 1 of Table 3 may be substituted with a residue in column 2; in addition, a residue in column 2 of Table 3 may be substituted with the residue of column 1.

TABLE 3

| Residue | Similar Substitutions |
|---|---|
| Ala | Ser; Thr; Gly; Val; Leu; Ile |
| Arg | Lys; His; Gly |
| Asn | Gln; His; Gly; Ser; Thr |

TABLE 3-continued

| Residue | Similar Substitutions |
| --- | --- |
| Asp | Glu, Ser; Thr |
| Gln | Asn; Ala |
| Cys | Ser; Gly |
| Glu | Asp |
| Gly | Pro; Arg |
| His | Asn; Gln; Tyr; Phe; Lys; Arg |
| Ile | Ala; Leu; Val; Gly; Met |
| Leu | Ala; Ile; Val; Gly; Met |
| Lys | Arg; His; Gln; Gly; Pro |
| Met | Leu; Ile; Phe |
| Phe | Met; Leu; Tyr; Trp; His; Val; Ala |
| Ser | Thr; Gly; Asp; Ala; Val; Ile; His |
| Thr | Ser; Val; Ala; Gly |
| Trp | Tyr; Phe; His |
| Tyr | Trp; Phe; His |
| Val | Ala; Ile; Leu; Gly; Thr; Ser; Glu |

Substitutions that are less conservative than those in Table 2 can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to chemically or enzymatically modify given sequences to change the properties of the nucleic acids or proteins.

Thus, in one embodiment, given nucleic acid sequences are modified, e.g., according to standard mutagenesis or artificial evolution methods to produce modified sequences. The modified sequences may be created using purified natural polynucleotides isolated from any organism or may be synthesized from purified compositions and chemicals using chemical means well know to those of skill in the art. For example, Ausubel, supra, provides additional details on mutagenesis methods. Artificial forced evolution methods are described, for example, by Stemmer (1994) Nature 370: 389-391, Stemmer (1994) Proc. Natl. Acad. Sci. 91:10747-10751, and U.S. Pat. Nos. 5,811,238, 5,837,500, and 6,242,568. Methods for engineering synthetic transcription factors and other polypeptides are described, for example, by Zhang et al. (2000) J. Biol. Chem. 275: 33850-33860, Liu et al. (2001) J. Biol. Chem. 276: 11323-11334, and Isalan et al. (2001) Nature Biotechnol. 19: 656-660. Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel, supra. Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for Saccharomyces cerevisiae and mammals are TAA and TGA, respectively. The preferred stop codon for monocotyledonous plants is TGA, whereas insects and E. coli prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998) Proc. Natl. Acad. Sci. 95: 376-381; Aoyama et al. (1995) Plant Cell 7: 1773-1785), peptides derived from bacterial sequences (Ma and Ptashne (1987) Cell 51: 113-119) and synthetic peptides (Giniger and Ptashne (1987) Nature 330: 670-672).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homolog.

The transgenic plants of the present invention comprising recombinant polynucleotide sequences are generally derived from parental plants, which may themselves be non-transformed (or non-transgenic) plants. These transgenic plants may either have a transcription factor gene "knocked out" (for example, with a genomic insertion by homologous recombination, an antisense or ribozyme construct) or expressed to a normal or wild-type extent. However, overexpressing transgenic "progeny" plants will exhibit greater mRNA levels, wherein the mRNA encodes a transcription factor, that is, a DNA-binding protein that is capable of binding to a DNA regulatory sequence and inducing transcription, and preferably, expression of a plant trait gene. Preferably, the mRNA expression level will be at least three-fold greater than that of the parental plant, or more preferably at least ten-fold greater mRNA levels compared to said parental plant, and most preferably at least fifty-fold greater compared to said parental plant.

Vectors, Promoters, and Expression Systems

The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger, Sambrook, supra and Ausubel, supra. Any of the identified sequences can be incorporated into a cassette or vector, e.g., for expression in plants. A number of expression vectors suitable for stable transformation of plant cells or for the establishment of transgenic plants have been described including those described in Weissbach and Weissbach (1989) *Methods for Plant Molecular Biology*, Academic Press, and Gelvin et al. (1990) *Plant Molecular Biology Manual*, Kluwer Academic Publishers. Specific examples include those derived from a Ti plasmid of *Agrobacterium tumefaciens*, as well as those disclosed by Herrera-Estrella et al. (1983) *Nature* 303: 209, Bevan (1984) *Nucleic Acids Res.* 12: 8711-8721, Klee (1985) *Bio/Technology* 3: 637-642, for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) *Bio/Technology* 9: 957-962) and corn (Gordon-Kamm (1990) *Plant Cell* 2: 603-618) can be produced. An immature embryo can also be a good target tissue for monocots for direct DNA delivery techniques by using the particle gun (Weeks et al. (1993) *Plant Physiol.* 102: 1077-1084; Vasil (1993) *Bio/Technology* 10: 667-674; Wan and Lemeaux (1994) *Plant Physiol.* 104: 37-48, and for *Agrobacterium*-mediated DNA transfer (Ishida et al. (1996) *Nature Biotechnol.* 14: 745-750).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally- or developmentally-regulated, or cell- or tissue-specific expression), a transcription initiation start site, an RNA processing signal (such as intron splice sites), a transcription termination site, and/or a polyadenylation signal.

A potential utility for the transcription factor polynucleotides disclosed herein is the isolation of promoter elements from these genes that can be used to program expression in plants of any genes. Each transcription factor gene disclosed herein is expressed in a unique fashion, as determined by promoter elements located upstream of the start of translation, and additionally within an intron of the transcription factor gene or downstream of the termination codon of the gene. As is well known in the art, for a significant portion of genes, the promoter sequences are located entirely in the region directly upstream of the start of translation. In such cases, typically the promoter sequences are located within 2.0 kb of the start of translation, or within 1.5 kb of the start of translation, frequently within 1.0 kb of the start of translation, and sometimes within 0.5 kb of the start of translation.

The promoter sequences can be isolated according to methods known to one skilled in the art.

Examples of constitutive plant promoters which can be useful for expressing the TF sequence include: the cauliflower mosaic virus (CaMV) 35S promoter, which confers constitutive, high-level expression in most plant tissues (see, e.g., Odell et al. (1985) *Nature* 313: 810-812); the nopaline synthase promoter (An et al. (1988) *Plant Physiol.* 88: 547-552); and the octopine synthase promoter (Fromm et al. (1989) *Plant Cell* 1: 977-984).

A variety of plant gene promoters that regulate gene expression in response to environmental, hormonal, chemical, developmental signals, and in a tissue-active manner can be used for expression of a TF sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) *Plant Mol. Biol.* 11: 651-662), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) *Plant Mol. Biol.* 37: 977-988), flower-specific (Kaiser et al. (1995) *Plant Mol. Biol.* 28: 231-243), pollen (Baerson et al. (1994) *Plant Mol. Biol.* 26: 1947-1959), carpels (Ohl et al. (1990) *Plant Cell* 2: 837-848), pollen and ovules (Baerson et al. (1993) *Plant Mol. Biol.* 22: 255-267), auxin-inducible promoters (such as that described in van der Kop et al. (1999) *Plant Mol. Biol.* 39: 979-990 or Baumann et al. (1999) *Plant Cell* 11: 323-334), cytokinin-inducible promoter (Guevara-Garcia (1998) *Plant Mol. Biol.* 38: 743-753), promoters responsive to gibberellin (Shi et al. (1998) *Plant Mol. Biol.* 38: 1053-1060, Willmott et al. (1998) 38: 817-825) and the like. Additional promoters are those that elicit expression in response to heat (Ainley et al. (1993) *Plant Mol. Biol.* 22: 13-23), light (e.g., the pea rbcS-3A promoter, Kuhlemeier et al. (1989) *Plant Cell* 1: 471-478, and the maize rbcS promoter, Schaffner and Sheen (1991) *Plant Cell* 3: 997-1012); wounding (e.g., wunI, Siebertz et al. (1989) *Plant Cell* 1: 961-968); pathogens (such as the PR-1 promoter described in Buchel et al. (1999) *Plant Mol. Biol.* 40: 387-396, and the PDF1.2 promoter described in Manners et al. (1998) *Plant Mol. Biol.* 38: 1071-1080), and chemicals such as methyl jasmonate or salicylic acid (Gatz (1997) *Annu. Rev. Plant Physiol. Plant Mol. Biol.* 48: 89-108). In addition, the timing of the expression can be controlled by using promoters such as those acting at senescence (Gan and Amasino (1995) *Science* 270: 1986-1988); or late seed development (Odell et al. (1994) *Plant Physiol.* 106: 447-458).

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Additional Expression Elements

Specific initiation signals can aid in efficient translation of coding sequences. These signals can include, e.g., the ATG initiation codon and adjacent sequences. In cases where a coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous transcriptional control signals including the ATG initiation codon can be separately provided. The initiation codon is provided in the correct reading frame to facilitate transcription. Exogenous transcriptional elements and initiation codons can be of various origins, both natural and synthetic. The efficiency of expression can be enhanced by the inclusion of enhancers appropriate to the cell system in use.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook, supra and Ausubel, supra.

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al. (1985) *Proc. Natl. Acad. Sci.* 82: 5824-5828, infection by viral vectors such as cauliflower mosaic virus (CaMV) (Hohn et al. (1982) *Molecular Biology of Plant Tumors* Academic Press, New York, N.Y., pp. 549-560; U.S. Pat. No. 4,407,956), high velocity ballistic penetration by small particles with the nucleic acid either within the matrix of small beads or particles, or on the surface (Klein et al. (1987) *Nature* 327: 70-73), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984) *Science* 233: 496-498; Fraley et al. (1983) *Proc. Natl. Acad. Sci.* 80: 4803-4807).

The cell can include a nucleic acid of the invention that encodes a polypeptide, wherein the cell expresses a polypeptide of the invention. The cell can also include vector sequences, or the like. Furthermore, cells and transgenic plants that include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like. Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

Identification of Additional Factors

A transcription factor provided by the present invention can also be used to identify additional endogenous or exogenous molecules that can affect a phenotype or trait of interest. On the one hand, such molecules include organic (small or large molecules) and/or inorganic compounds that affect expression of (i.e., regulate) a particular transcription factor. Alternatively, such molecules include endogenous molecules that are acted upon either at a transcriptional level by a transcription factor of the invention to modify a phenotype as desired. For example, the transcription factors can be employed to identify one or more downstream genes that are subject to a regulatory effect of the transcription factor. In one approach, a transcription factor or transcription factor homolog of the invention is expressed in a host cell, e.g., a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (such as binding sites on DNA sequences) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999) Nature Biotechnol. 17: 573-577).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. (1991) Proc. Natl. Acad. Sci. 88: 9578-9582, and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast Saccharomyces cerevisiae that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions can be preformed.

Identification of Modulators

In addition to the intracellular molecules described above, extracellular molecules that alter activity or expression of a transcription factor, either directly or indirectly, can be identified. For example, the methods can entail first placing a candidate molecule in contact with a plant or plant cell. The molecule can be introduced by topical administration, such as spraying or soaking of a plant, or incubating a plant in a solution containing the molecule, and then the molecule's effect on the expression or activity of the TF polypeptide or the expression of the polynucleotide monitored. Changes in the expression of the TF polypeptide can be monitored by use of polyclonal or monoclonal antibodies, gel electrophoresis or the like. Changes in the expression of the corresponding polynucleotide sequence can be detected by use of microarrays, Northerns, quantitative PCR, or any other technique for monitoring changes in mRNA expression. These techniques are exemplified in Ausubel et al. (eds.) Current Protocols in Molecular Biology, John Wiley & Sons (1998, and supplements through 2001). Changes in the activity of the transcription factor can be monitored, directly or indirectly, by assaying the function of the transcription factor, for example, by measuring the expression of promoters known to be controlled by the transcription factor (using promoter-reporter constructs), measuring the levels of transcripts using microarrays, Northern blots, quantitative PCR, etc. Such changes in the expression levels can be correlated with modified plant traits and thus identified molecules can be useful for soaking or spraying on fruit, vegetable and grain crops to modify traits in plants.

Essentially any available composition can be tested for modulatory activity of expression or activity of any nucleic acid or polypeptide herein. Thus, available libraries of compounds such as chemicals, polypeptides, nucleic acids and the like can be tested for modulatory activity. Often, potential modulator compounds can be dissolved in aqueous or organic (e.g., DMSO-based) solutions for easy delivery to the cell or plant of interest in which the activity of the modulator is to be tested. Optionally, the assays are designed to screen large modulator composition libraries by automating the assay steps and providing compounds from any convenient source to assays, which are typically run in parallel (e.g., in microtiter formats on microplates in robotic assays).

In one embodiment, high throughput screening methods involve providing a combinatorial library containing a large number of potential compounds (potential modulator compounds). Such "combinatorial chemical libraries" are then screened in one or more assays, as described herein, to identify those library members (particular chemical species or subclasses) that display a desired characteristic activity. The compounds thus identified can serve as target compounds.

A combinatorial chemical library can be, e.g., a collection of diverse chemical compounds generated by chemical synthesis or biological synthesis. For example, a combinatorial chemical library such as a polypeptide library is formed by combining a set of chemical building blocks (e.g., in one example, amino acids) in every possible way for a given compound length (i.e., the number of amino acids in a polypeptide compound of a set length). Exemplary libraries include peptide libraries, nucleic acid libraries, antibody libraries (see, e.g., Vaughn et al. (1996) Nature Biotechnol. 14: 309-314 and PCT/US96/10287), carbohydrate libraries (see, e.g., Liang et al. Science (1996) 274: 1520-1522 and U.S. Pat. No. 5,593,853), peptide nucleic acid libraries (see, e.g., U.S. Pat. No. 5,539,083), and small organic molecule libraries (see, e.g., benzodiazepines, in Baum Chem. & Engineering News Jan. 18, 1993, page 33; isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337) and the like.

Preparation and screening of combinatorial or other libraries is well known to those of skill in the art. Such combinatorial chemical libraries include, but are not limited to, peptide libraries (see, e.g., U.S. Pat. No. 5,010,175; Furka, (1991) Int. J. Pept. Prot. Res. 37: 487-493; and Houghton et al. (1991) Nature 354: 84-88). Other chemistries for generating chemical diversity libraries can also be used.

In addition, as noted, compound screening equipment for high-throughput screening is generally available, e.g., using any of a number of well known robotic systems that have also been developed for solution phase chemistries useful in assay systems. These systems include automated workstations including an automated synthesis apparatus and robotic systems utilizing robotic arms. Any of the above devices are suitable for use with the present invention, e.g., for high-throughput screening of potential modulators. The nature and implementation of modifications to these devices (if any) so that they can operate as discussed herein will be apparent to persons skilled in the relevant art.

Indeed, entire high-throughput screening systems are commercially available. These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization. Similarly, microfluidic implementations of screening are also commercially available.

The manufacturers of such systems provide detailed protocols the various high throughput. Thus, for example, Zymark Corp. provides technical bulletins describing screening systems for detecting the modulation of gene transcription, ligand binding, and the like. The integrated systems herein, in addition to providing for sequence alignment and, optionally, synthesis of relevant nucleic acids, can include such screening apparatus to identify modulators that have an effect on one or more polynucleotides or polypeptides according to the present invention.

In some assays it is desirable to have positive controls to ensure that the components of the assays are working properly. At least two types of positive controls are appropriate. That is, known transcriptional activators or inhibitors can be incubated with cells or plants, for example, in one sample of the assay, and the resulting increase/decrease in transcription can be detected by measuring the resulting increase in RNA levels and/or protein expression, for example, according to the methods herein. It will be appreciated that modulators can also be combined with transcriptional activators or inhibitors to find modulators that inhibit transcriptional activation or transcriptional repression. Either expression of the nucleic acids and proteins herein or any additional nucleic acids or proteins activated by the nucleic acids or proteins herein, or both, can be monitored.

In an embodiment, the invention provides a method for identifying compositions that modulate the activity or expression of a polynucleotide or polypeptide of the invention. For example, a test compound, whether a small or large molecule, is placed in contact with a cell, plant (or plant tissue or explant), or composition comprising the polynucleotide or polypeptide of interest and a resulting effect on the cell, plant, (or tissue or explant) or composition is evaluated by monitoring, either directly or indirectly, one or more of: expression level of the polynucleotide or polypeptide, activity (or modulation of the activity) of the polynucleotide or polypeptide. In some cases, an alteration in a plant phenotype can be detected following contact of a plant (or plant cell, or tissue or explant) with the putative modulator, e.g., by modulation of expression or activity of a polynucleotide or polypeptide of the invention. Modulation of expression or activity of a polynucleotide or polypeptide of the invention may also be caused by molecular elements in a signal transduction second messenger pathway and such modulation can affect similar elements in the same or another signal transduction second messenger pathway.

Subsequences

Also contemplated are uses of polynucleotides, also referred to herein as oligonucleotides, typically having at least 12 bases, preferably at least 15, more preferably at least 20, 30, or 50 bases, which hybridize under at least highly stringent (or ultra-high stringent or ultra-ultra-high stringent conditions) conditions to a polynucleotide sequence described above. The polynucleotides may be used as probes, primers, sense and antisense agents, and the like, according to methods as noted supra.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologs of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook, supra, and Ausubel, supra.

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that activates transcription, e.g., by binding to a specific DNA promoter region an activation domain, or a domain for protein-protein interactions.

Production of Transgenic Plants
Modification of Traits

The polynucleotides of the invention are favorably employed to produce transgenic plants with various traits, or characteristics, that have been modified in a desirable manner, e.g., to improve the seed characteristics of a plant. For example, alteration of expression levels or patterns (e.g., spatial or temporal expression patterns) of one or more of the transcription factors (or transcription factor homologs) of the invention, as compared with the levels of the same protein found in a wild-type plant, can be used to modify a plant's traits. An illustrative example of trait modification, improved characteristics, by altering expression levels of a particular transcription factor is described further in the Examples and the Sequence Listing.

*Arabidopsis* as a Model System

*Arabidopsis thaliana* is the object of rapidly growing attention as a model for genetics and metabolism in plants. *Arabidopsis* has a small genome, and well-documented studies are available. It is easy to grow in large numbers and mutants defining important genetically controlled mechanisms are either available, or can readily be obtained. Various methods to introduce and express isolated homologous genes are available (see Koncz et al. eds., et al. *Methods in Arabidopsis Research* (1992) et al. World Scientific, New Jersey, N.J., in "Preface"). Because of its small size, short life cycle, obligate autogamy and high fertility, *Arabidopsis* is also a choice organism for the isolation of mutants and studies in morphogenetic and development pathways, and control of these pathways by transcription factors (Koncz supra, p. 72). A number of studies introducing transcription factors into *A. thaliana* have demonstrated the utility of this plant for understanding the mechanisms of gene regulation and trait alteration in plants. (See, for example, Koncz supra, and U.S. Pat. No. 6,417,428).

*Arabidopsis* Genes in Transgenic Plants.

Expression of genes which encode transcription factors modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) et al. *Genes and Development* 11: 3194-3205, and Peng et al. (1999) *Nature* 400: 256-261. In addition, many others have demonstrated that an *Arabidopsis* transcription factor expressed in an exogenous plant species elicits the same or very similar phenotypic response. See, for example, Fu et al. (2001) *Plant Cell* 13: 1791-1802; Nandi et al. (2000) *Curr. Biol.* 10: 215-218; Coupland (1995) *Nature* 377: 482-483; and Weigel and Nilsson (1995) *Nature* 377: 482-500.

Homologous Genes Introduced into Transgenic Plants.

Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Consequently, transgenic plants may be produced that comprise a recombinant expression vector or cassette with a promoter operably linked to one or more sequences homologous to presently disclosed sequences. The promoter may be, for example, a plant or viral promoter.

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Transcription Factors of Interest for the Modification of Plant Traits

Currently, the existence of a series of maturity groups for different latitudes represents a major barrier to the introduction of new valuable traits. Any trait (e.g. disease resistance) has to be bred into each of the different maturity groups separately, a laborious and costly exercise. The availability of single strain, which could be grown at any latitude, would therefore greatly increase the potential for introducing new traits to crop species such as soybean and cotton.

For many of the specific effects, traits and utilities listed in Table 4 and Table 6 that may be conferred to plants, one or more transcription factor genes may be used to increase or decrease, advance or delay, or improve or prove deleterious to a given trait. Overexpressing or suppressing one or more genes can impart significant differences in production of plant products, such as different fatty acid ratios. For example, overexpression of G720 caused a plant to become more freezing tolerant, but knocking out the same transcription factor imparted greater susceptibility to freezing. Thus, suppressing a gene that causes a plant to be more sensitive to cold may improve a plant's tolerance of cold. More than one transcription factor gene may be introduced into a plant, either by transforming the plant with one or more vectors comprising two or more transcription factors, or by selective breeding of plants to yield hybrid crosses that comprise more than one introduced transcription factor.

A listing of specific effects and utilities that the presently disclosed transcription factor genes have on plants, as determined by direct observation and assay analysis, is provided in Table 4. Table 4 shows the polynucleotides identified by SEQ ID NO; Mendel Gene ID No. (GID); and if the polynucleotide was tested in a transgenic assay. The first column shows the polynucleotide SEQ ID NO; the second column shows the GID; the third column shows whether the gene was overexpressed (OE) or knocked out (KO) in plant studies; the fourth column shows the trait(s) resulting from the knock out or overexpression of the polynucleotide in the transgenic plant; the fifth column shows the category of the trait; and the sixth column ("Comment"), includes specific observations made with respect to the polynucleotide of the first column.

TABLE 4

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 1 | G8 | OE | Flowering time | Flowering time | Late flowering |
| 3 | G19 | OE | *Erysiphe* | Disease | Increased tolerance to *Erysiphe*; repressed by methyl jasmonate and induced by 1-aminocyclopropane 1-carboxylic acid (ACC) |
| 5 | G22 | OE | Sodium chloride | Abiotic stress | Increased tolerance to high salt |
| 7 | G24 | OE | Morphology: other | Dev and morph | Reduced size and necrotic patches |
| 9 | G28 | OE | *Botrytis* | Disease | Increased tolerance to *Botrytis* |
|  |  |  | *Sclerotinia* | Disease | Increased tolerance to *Sclerotinia* |
|  |  |  | *Erysiphe* | Disease | Increased resistance to *Erysiphe* |
| 11 | G47 | OE | Stem | Dev and morph | Altered structure of vascular tissues |
|  |  |  | Osmotic | Abiotic stress | Better root growth under osmotic stress |
|  |  |  | Flowering time | Flowering time | Late flowering |
|  |  |  | Architecture | Dev and morph | Altered architecture and inflorescence development |
|  |  |  | Architecture | Dev and morph | Reduced apical dominance |

TABLE 4-continued

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 13 | G156 | KO | Seed | Dev and morph | Seed color alteration |
| 15 | G157 | OE | Flowering time | Flowering time | Altered flowering time (modest level of overexpression triggers early flowering, whereas a larger increase delays flowering) |
| 17 | G162 | OE | Seed oil content | Seed biochemistry | Increased seed oil content |
|  |  |  | Seed protein content | Seed biochemistry | Increased seed protein content |
| 19 | G175 | OE | Osmotic | Abiotic stress | Increased tolerance to osmotic stress |
| 21 | G180 | OE | Seed oil content | Seed biochemistry | Decreased seed oil |
|  |  |  | Flowering time | Flowering time | Early flowering |
| 23 | G183 | OE | Flowering time | Flowering time | Early flowering |
|  |  |  | Light response | Dev and morph | Constitutive photomorphogenesis |
| 25 | G188 | KO | *Fusarium* | Disease | Increased susceptibility to *Fusarium* |
|  |  |  | Osmotic | Abiotic stress | Better germination under osmotic stress |
| 27 | G189 | OE | Size | Dev and morph | Increased leaf size |
| 29 | G192 | OE | Flowering time | Flowering time | Late flowering |
|  |  |  | Seed oil content | Seed biochemistry | Decreased seed oil content |
| 31 | G196 | OE | Sodium chloride | Abiotic stress | Increased tolerance to high salt |
| 33 | G211 | OE | Leaf insoluble sugars | Leaf biochemistry | Increase in leaf xylose |
|  |  |  | Architecture | Dev and morph | Reduced apical dominance |
|  |  |  | Leaf | Dev and morph | Altered leaf shape |
| 35 | G214 | OE | Flowering time | Flowering time | Late flowering |
|  |  |  | Leaf fatty acids | Leaf biochemistry | Increased leaf fatty acids |
|  |  |  | Seed prenyl lipids | Seed biochemistry | Increased seed lutein |
|  |  |  | Leaf prenyl lipids | Leaf biochemistry | Increased leaf chlorophyll and carotenoids |
| 37 | G226 | OE | Seed protein content | Seed biochemistry | Increased seed protein |
|  |  |  | Trichome | Dev and morph | Glabrous, lack of trichomes |
|  |  |  | Root | Dev and morph | Increased root hairs |
|  |  |  | Sodium chloride | Abiotic stress | Increased tolerance to high salt |
|  |  |  | Nutrient uptake | Abiotic stress | Increased tolerance to nitrogen-limited medium |
| 39 | G241 | KO | Seed protein content | Seed biochemistry | Increased seed protein content |
|  |  |  | Seed oil content | Seed biochemistry | Decreased seed oil |
|  |  |  | Sugar sensing | Sugar sensing | Decreased germination and growth on glucose medium |
| 41 | G248 | OE | *Botrytis* | Disease | Increased susceptibility to *Botrytis* |
| 43 | G254 | OE | Sugar sensing | Sugar sensing | Decreased germination and growth on glucose medium |
| 45 | G256 | OE | Cold, chilling | Abiotic stress | Better germination and growth in cold |
| 47 | G278 | OE | *Sclerotinia* | Disease | Increased susceptibility to *Sclerotinia* |
| 49 | G291 | OE | Seed oil content | Seed biochemistry | Increased seed oil content |
| 51 | G303 | OE | Osmotic | Abiotic stress | Better germination on high sucrose and high NaCl |
| 53 | G312 | OE | Sodium chloride | Abiotic stress | Better germination on high NaCl |
| 55 | G325 | OE | Osmotic | Abiotic stress | Better germination on high sucrose and NaCl |
| 57 | G343 | OE | Glyphosate | Herbicide sensitivity | Increased resistance to glyphosate |
|  |  |  | Size | Dev and morph | Small plant |
| 59 | G353 | OE | Osmotic | Abiotic stress | Increased seedling vigor on polyethylene glycol (PEG) |
|  |  |  | Size | Dev and morph | Reduced size |
|  |  |  | Leaf | Dev and morph | Altered leaf development |
|  |  |  | Flower | Dev and morph | Short pedicels, downward pointing siliques |
| 61 | G354 | OE | Size | Dev and morph | Reduced size |
|  |  |  | Light response | Dev and morph | Constitutive photomorphogenesis |
|  |  |  | Flower | Dev and morph | Short pedicels, downward pointing siliques |
| 63 | G361 | OE | Flowering time | Flowering time | Late flowering |
| 65 | G362 | OE | Flowering time | Flowering time | Late flowering |
|  |  |  | Size | Dev and morph | Reduced size |
|  |  |  | Trichome | Dev and morph | Ectopic trichome formation, increased trichome number |
|  |  |  | Morphology: other | Dev and morph | Increased pigmentation in seed and embryos, and in other organs |
| 67 | G371 | OE | *Botrytis* | Disease | Increased susceptibility to *Botrytis* |
| 69 | G390 | OE | Architecture | Dev and morph | Altered shoot development |
| 71 | G391 | OE | Architecture | Dev and morph | Altered shoot development |
| 73 | G409 | OE | *Erysiphe* | Disease | Increased tolerance to *Erysiphe* |

TABLE 4-continued

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 75 | G427 | OE | Seed oil content | Seed biochemistry | Increased oil content |
|   |   |   | Seed protein content | Seed biochemistry | Decreased protein content |
| 77 | G438 | KO | Stem | Dev and morph | Reduced lignin |
|   |   |   | Architecture | Dev and morph | Reduced branching |
| 79 | G450 | OE | Seed | Dev and morph | Increased seed size |
| 81 | G464 | OE | Heat | Abiotic stress | Better germination and growth in heat |
| 83 | G470 | OE | Fertility | Dev and morph | Short stamen filaments |
| 85 | G477 | OE | *Sclerotinia* | Disease | Increased susceptibility to *Sclerotinia* |
|   |   |   | Oxidative | Abiotic stress | Increased sensitivity to oxidative stress |
| 87 | G481 | OE | Sugar sensing | Sugar sensing | Better germination on sucrose media |
|   |   |   | Drought | Abiotic stress | Increased tolerance to drought |
| 89 | G482 | OE | Sodium chloride | Abiotic stress | Increased tolerance to high salt |
| 91 | G484 | KO | Seed glucosinolates | Seed biochemistry | Altered glucosinolate profile |
| 93 | G489 | OE | Osmotic | Abiotic stress | Increased tolerance to osmotic stress |
| 95 | G490 | OE | Flowering time | Flowering time | Early flowering |
| 97 | G504 | OE | Seed oil composition | Seed biochemistry | Decreased seed oil composition and content; increase in 18:2 fatty acid and decrease in 20:1 fatty acid |
| 99 | G509 | KO | Seed oil content | Seed biochemistry | Increased total seed oil and protein content |
|   |   |   | Seed protein content | Seed biochemistry |   |
| 101 | G519 | OE | Seed oil content | Seed biochemistry | Increased seed oil content |
| 103 | G545 | OE | Sodium chloride | Abiotic stress | Susceptible to high salt |
|   |   |   | *Erysiphe* | Disease | Increased susceptibility to *Erysiphe* |
|   |   |   | *Pseudomonas* | Disease | Increased susceptibility to *Pseudomonas* |
|   |   |   | *Fusarium* | Disease | Increased susceptibility to *Fusarium* |
|   |   |   | Nutrient uptake | Abiotic stress | Increased tolerance to phosphate-free medium |
| 105 | G546 | OE | Hormone sensitivity | Hormone sensitivity | Decreased sensitivity to abscisic acid (ABA) |
| 107 | G561 | OE | Seed oil content | Seed biochemistry | Increased seed oil content |
|   |   |   | Nutrient uptake | Abiotic stress | Increased tolerance to potassium-free medium |
| 109 | G562 | OE | Flowering time | Flowering time | Late flowering |
| 111 | G567 | OE | Seed oil content | Seed biochemistry | Increased total seed oil/protein content |
|   |   |   | Seed protein content | Seed biochemistry |   |
|   |   |   | Sugar sensing | Sugar sensing | Increased total seed oil/protein content |
|   |   |   |   |   | Decreased seedling vigor on high glucose |
| 113 | G568 | OE | Architecture | Dev and morph | Altered branching |
| 115 | G584 | OE | Seed | Dev and morph | Large seeds |
| 117 | G585 | OE | Trichome | Dev and morph | Reduced trichome density |
| 119 | G590 | KO | Seed oil content | Seed biochemistry | Increased seed oil content |
|   |   | OE | Flowering time | Flowering time | Early flowering |
| 121 | G594 | OE | *Sclerotinia* | Disease | Increased susceptibility to *Sclerotinia* |
| 123 | G597 | OE | Seed protein content | Seed biochemistry | Altered seed protein content |
| 125 | G598 | OE | Seed oil content | Seed biochemistry | Increased seed oil |
| 127 | G634 | OE | Trichome | Dev and morph | Increased trichome density and size |
| 129 | G635 | OE | Variegation | Dev and morph | Altered coloration |
| 131 | G636 | OE | Senescence | Dev and morph | Premature senescence |
| 133 | G638 | OE | Flower | Dev and morph | Altered flower development |
| 135 | G652 | KO | Seed prenyl lipids | Seed biochemistry | Increase in alpha-tocopherol |
| 137 | G663 | OE | Biochemistry: other | Biochem: misc | Increased anthocyanins in leaf, root, seed |
| 139 | G664 | OE | Cold, chilling | Abiotic stress | Better germination and growth in cold |
| 141 | G674 | OE | Leaf | Dev and morph | Dark green, upwardly oriented leaves |
| 143 | G676 | OE | Trichome | Dev and morph | Reduced trichome number, ectopic trichome formation |
| 145 | G680 | OE | Sugar sensing | Sugar sensing | Reduced germination on glucose medium |
| 147 | G682 | OE | Trichome | Dev and morph | Glabrous, lack of trichomes |
|   |   |   | Heat | Abiotic stress | Better germination and growth in heat |
|   |   |   | Root | Dev and morph | Increased root hairs |
| 149 | G715 | OE | Seed oil content | Seed biochemistry | Increased seed oil content |
| 151 | G720 | OE | Freezing | Abiotic stress | More freezing tolerant |
|   |   | KO | Freezing | Abiotic stress | Increased susceptibility to freezing |

TABLE 4-continued

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 153 | G736 | OE | Flowering time | Flowering time | Late flowering |
| | | | Leaf | Dev and morph | Altered leaf shape |
| 155 | G748 | OE | Seed prenyl lipids | Seed biochemistry | Increased lutein content |
| | | | Stem | Dev and morph | More vascular bundles in stem |
| | | | Flowering time | Flowering time | Late flowering |
| 157 | G779 | OE | Fertility | Dev and morph | Reduced fertility |
| | | | Flower | Dev and morph | Homeotic transformations |
| 159 | G789 | OE | Flowering time | Flowering time | Early flowering |
| 161 | G801 | OE | Sodium chloride | Abiotic stress | Better germination on high NaCl |
| 163 | G849 | KO | Seed oil content | Seed biochemistry | Increased seed oil content |
| | | | Seed protein content | Seed biochemistry | Altered seed protein content |
| 165 | G859 | OE | Flowering time | Flowering time | Late flowering |
| 167 | G864 | OE | Heat | Abiotic stress | Better germination in heat |
| 169 | G867 | OE | Sodium chloride | Abiotic stress | Better seedling vigor on high salt |
| | | | Sugar sensing | Sugar sensing | Better seedling vigor on high sucrose |
| 171 | G869 | OE | Seed oil composition | Seed biochemistry | Altered seed fatty acids |
| 173 | G877 | KO | Embryo lethal | Dev and morph | Embryo lethal phenotype: potential herbicide target |
| 175 | G881 | OE | *Erysiphe* | Disease | Increased susceptibility to *Erysiphe* |
| 177 | G892 | KO | Seed protein content | Seed biochemistry | Altered seed protein content |
| | | | Seed oil content | Seed biochemistry | Altered seed oil content |
| 179 | G896 | KO | *Fusarium* | Disease | Increased susceptibility to *Fusarium* |
| 181 | G910 | OE | Flowering time | Flowering time | Late flowering |
| 183 | G911 | OE | Nutrient uptake | Abiotic stress | Increased growth on potassium-free medium |
| 185 | G912 | OE | Freezing | Abiotic stress | Freezing tolerant |
| | | | Drought | Abiotic stress | Increased survival in drought conditions |
| | | | Morphology: other | Dev and morph | |
| | | | Sugar sensing | Sugar sensing | Dark green color |
| | | | | | Reduced cotyledon expansion in glucose |
| 187 | G913 | OE | Freezing | Abiotic stress | Increased tolerance to freezing |
| | | | Flowering time | Flowering time | Late flowering |
| | | | Drought | Abiotic stress | Increased tolerance to drought |
| 189 | G922 | OE | Osmotic | Abiotic stress | Better germination on high sucrose |
| | | | Sodium chloride | Abiotic stress | Better germination, increased root growth on high salt |
| 191 | G926 | KO | Hormone sensitivity | Hormone sensitivity | Reduced sensitivity to ABA |
| | | | Osmotic | Abiotic stress | Increased tolerance to osmotic stress (salt and sucrose) |
| 193 | G961 | KO | Seed oil content | Seed biochemistry | Increased seed oil content |
| 195 | G971 | OE | Flowering time | Flowering time | Late flowering |
| 197 | G974 | OE | Seed oil content | Seed biochemistry | Altered seed oil content |
| 199 | G975 | OE | Leaf fatty acids | Leaf biochemistry | Increased wax in leaves |
| 201 | G979 | KO | Seed | Dev and morph | Altered seed development, ripening, and germination |
| 203 | G987 | KO | Leaf fatty acids | Leaf biochemistry | Reduction in 16:3 fatty acids |
| | | | Leaf prenyl lipids | Leaf biochemistry | Altered chlorophyll, tocopherol, carotenoid |
| 205 | G988 | OE | Seed protein content | Seed biochemistry | Increased seed protein content |
| | | | Flower | Dev and morph | Enlarged floral organs, short pedicels |
| | | | Architecture | Dev and morph | Reduced lateral branching |
| | | | Stem | Dev and morph | Thicker stem, altered distribution of vascular bundles |
| 207 | G1040 | OE | Seed | Dev and morph | Smaller and more rounded seeds |
| 209 | G1047 | OE | *Fusarium* | Disease | Increased tolerance to *Fusarium* |
| 211 | G1051 | OE | Flowering time | Flowering time | Late flowering |
| 213 | G1052 | OE | Flowering time | Flowering time | Late flowering |
| 215 | G1062 | KO | Seed | Dev and morph | Altered seed shape |
| 217 | G1063 | OE | Leaf | Dev and morph | Altered leaf shape, dark green color |
| | | | Inflorescence | Dev and morph | Altered inflorescence development |
| | | | Flower | Dev and morph | Altered flower development, ectopic carpel tissue |
| 219 | G1064 | OE | *Botrytis* | Disease | Increased sensitivity to *Botrytis* |
| 221 | G1069 | OE | Hormone sensitivity | Hormone sensitivity | Reduced ABA sensitivity |
| | | | Osmotic | Abiotic stress | Better germination under osmotic stress |
| 223 | G1073 | OE | Size | Dev and morph | Substantially increased plant size |
| | | | Seed | Dev and morph | Increased seed yield |
| | | | Drought | Abiotic stress | Increased tolerance to drought |
| 225 | G1075 | OE | Flower | Dev and morph | Reduced or absent petals, sepals and stamens |

TABLE 4-continued

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 227 | G1084 | OE | *Botrytis* | Disease | Increased susceptibility to *Botrytis* |
| 229 | G1089 | KO | Osmotic | Abiotic stress | Better germination under osmotic stress |
| 231 | G1134 | OE | Hormone sensitivity | Hormone sensitivity | Altered response to ethylene: longer hypocotyls and lack of apical hook |
| 233 | G1140 | OE | Flower | Dev and morph | Altered flower development |
| 235 | G1143 | OE | Seed oil content | Seed biochemistry | Altered seed oil content |
| 237 | G1146 | OE | Leaf | Dev and morph | Altered leaf development |
| 239 | G1196 | KO | *Botrytis* | Disease | Increased susceptibility to *Botrytis* |
| 241 | G1198 | OE | Seed oil content | Seed biochemistry | Increased seed oil content |
| 243 | G1225 | OE | Flowering time | Flowering time | Early flowering |
|  |  |  | Sugar sensing | Sugar sensing | Better germination on sucrose and glucose media |
| 245 | G1226 | OE | Seed oil content | Seed biochemistry | Increased seed oil content |
| 247 | G1229 | OE | Seed oil content | Seed biochemistry | Decreased seed oil content |
| 249 | G1255 | OE | *Botrytis* | Disease | Increased susceptibility to *Botrytis* |
|  |  |  | Seed | Dev and morph | Increased seed size |
|  |  |  | Morphology: other | Dev and morph | Reduced apical dominance |
| 251 | G1266 | OE | *Erysiphe* | Disease | Increased tolerance to *Erysiphe* |
| 253 | G1275 | OE | Architecture | Dev and morph | Reduced apical dominance |
| 255 | G1305 | OE | Heat | Abiotic stress | Reduced chlorosis in heat |
| 257 | G1322 | OE | Chilling | Abiotic stress | Increased seedling vigor in cold |
|  |  |  | Size | Dev and morph | Reduced size |
|  |  |  | Leaf glucosinolates | Leaf biochemistry | Increase in M39480 |
|  |  |  | Light response | Dev and morph | Photomorphogenesis in the dark |
| 259 | G1323 | OE | Seed oil content | Seed biochemistry | Decreased seed oil |
|  |  |  | Seed protein content | Seed biochemistry | Increased seed protein |
| 261 | G1330 | OE | Hormone sensitivity | Hormone sensitivity | Ethylene insensitive when germinated in the dark on ACC |
| 263 | G1331 | OE | Light response | Dev and morph | Constitutive photomorphogenesis |
| 265 | G1332 | OE | Trichome | Dev and morph | Reduced trichome density |
| 267 | G1363 | OE | *Fusarium* | Disease | Increased tolerance to *Fusarium* |
| 269 | G1411 | OE | Architecture | Dev and morph | Loss of apical dominance |
| 271 | G1417 | KO | Seed oil composition | Seed biochemistry | Increase in 18:2, decrease in 18:3 fatty acids |
| 273 | G1419 | OE | Seed protein content | Seed biochemistry | Increased seed protein |
| 275 | G1449 | OE | Flower | Dev and morph | Altered flower structure |
| 277 | G1451 | OE | Morphology: other | Dev and morph | Increased plant size |
|  |  | OE | Leaf | Dev and morph | Large leaf size |
|  |  | KO | Seed oil content | Seed biochemistry | Altered seed oil content |
| 279 | G1452 | OE | Trichome | Dev and morph | Reduced trichome density |
|  |  |  | Leaf | Dev and morph | Altered leaf shape, dark green color |
|  |  |  | Hormone sensitivity | Hormone sensitivity | Reduced sensitivity to ABA |
|  |  |  | Osmotic | Abiotic stress | Better germination on sucrose and salt |
|  |  |  | Flowering time | Flowering time | Late flowering |
| 281 | G1463 | OE | Senescence | Dev and morph | Premature senescence |
| 283 | G1471 | OE | Seed oil content | Seed biochemistry | Increased seed oil content |
| 285 | G1478 | OE | Seed protein content | Seed biochemistry | Decreased seed protein content |
|  |  |  | Flowering time | Flowering time | Late flowering |
|  |  |  | Seed oil content | Seed biochemistry | Increased seed oil content |
| 287 | G1482 | KO | Biochemistry: other | Biochem: misc | Increased anthocyanins |
|  |  | OE | Root | Dev and morph | Increased root growth |
| 289 | G1488 | OE | Seed protein content | Seed biochemistry | Altered seed protein content |
|  |  |  | Light response | Dev and morph | Constitutive photomorphogenesis |
|  |  |  | Architecture | Dev and morph | Reduced apical dominance, shorter stems |
| 291 | G1494 | OE | Flowering time | Flowering time | Early flowering |
|  |  |  | Light response | Dev and morph | Long hypocotyls, altered leaf shape |
|  |  |  | Leaf | Dev and morph | Pale green leaves, altered leaf shape |
| 293 | G1496 | OE | Seed oil content | Seed biochemistry | Altered seed oil content |
| 295 | G1499 | OE | Morphology: other | Dev and morph | Dark green color |
|  |  |  | Architecture | Dev and morph | Altered plant architecture |
|  |  |  | Flower | Dev and morph | Altered floral organ identity and development |
| 297 | G1519 | KO | Embryo lethal | Dev and morph | Embryo lethal phenotype: potential herbicide target |
| 299 | G1526 | KO | Seed oil content | Seed biochemistry | Increased seed oil content |
| 301 | G1540 | OE | Morphology: other | Dev and morph | Reduced cell differentiation in meristem |
| 303 | G1543 | OE | Architecture | Dev and morph | Altered architecture, compact plant |
|  |  |  | Morphology: other | Dev and morph | Dark green color |
|  |  |  | Seed oil content | Seed biochemistry | Decreased seed oil |
|  |  |  | Leaf prenyl lipids | Leaf biochemistry | Increase in chlorophyll a and b |

TABLE 4-continued

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 305 | G1634 | OE | Seed oil content | Seed biochemistry | Increased seed oil content |
|  |  |  | Seed protein content |  | Decreased seed protein content |
| 307 | G1637 | OE | Seed protein content | Seed biochemistry | Altered seed protein content |
| 309 | G1640 | OE | Seed oil content | Seed biochemistry | Increased seed oil |
| 311 | G1645 | OE | Inflorescence | Dev and morph | Altered inflorescence structure |
| 313 | G1646 | OE | Seed oil content | Seed biochemistry | Increased seed oil content |
| 315 | G1652 | OE | Seed protein content | Seed biochemistry | Increased seed protein content |
| 317 | G1672 | OE | Seed oil content | Seed biochemistry | Altered seed oil content |
| 319 | G1677 | OE | Seed protein content | Seed biochemistry | Altered seed protein content |
|  |  |  | Seed oil content | Seed biochemistry | Altered seed oil content |
| 321 | G1749 | OE | Morphology: other | Dev and morph | Formation of necrotic lesions |
| 323 | G1750 | OE | Seed oil content | Seed biochemistry | Increased seed oil content |
| 325 | G1756 | OE | *Botrytis* | Disease | Increased susceptibility to *Botrytis* |
| 327 | G1765 | OE | Seed oil content | Seed biochemistry | Increased seed oil content |
| 329 | G1777 | OE | Seed oil content | Seed biochemistry | Increased seed oil content |
|  |  |  | Seed protein content | Seed biochemistry | Decreased seed protein content |
| 331 | G1792 | OE | Leaf | Dev and morph | Dark green, shiny leaves |
|  |  |  | *Erysiphe* | Disease | Increased resistance to *Erysiphe* |
|  |  |  | *Botrytis* | Disease | Increased resistance to *Botrytis* |
|  |  |  | *Fusarium* | Disease | Increased resistance to *Fusarium* |
|  |  |  | Nutrient uptake | Abiotic stress | Increased tolerance to nitrogen-limited medium |
| 333 | G1793 | OE | Seed oil content | Seed biochemistry | Increased seed oil content |
| 335 | G1794 | OE | Architecture | Dev and morph | Altered architecture, bushier plant |
|  |  |  | Architecture | Dev and morph | Reduced apical dominance |
|  |  |  | Light response | Dev and morph | Constitutive photomorphogenesis |
|  |  |  | Osmotic | Abiotic stress | Increased sensitivity to high PEG |
|  |  |  | Nutrient uptake | Abiotic stress | Reduced root growth |
| 337 | G1804 | OE | Flowering time | Flowering time | Late flowering |
|  |  |  | Sugar sensing | Sugar sensing | Altered sugar sensing: more sensitive to glucose in germination assays |
| 339 | G1818 | OE | Seed protein content | Seed biochemistry | Increased protein content |
| 341 | G1820 | OE | Flowering time | Flowering time | Early flowering |
|  |  |  | Hormone sensitivity | Hormone sensitivity | Reduced ABA sensitivity |
|  |  |  | Seed protein content | Seed biochemistry | Increased seed protein content |
|  |  |  | Osmotic | Abiotic stress | Better germination in high NaCl |
|  |  |  | Drought | Abiotic stress | Increased tolerance to drought |
| 343 | G1836 | OE | Sodium chloride | Abiotic stress | Better germination in high salt |
|  |  |  | Drought | Abiotic stress | Increased tolerance to drought |
| 345 | G1838 | OE | Seed oil content | Seed biochemistry | Increased seed oil content |
| 347 | G1841 | OE | Heat | Abiotic stress | Better germination under heat stress |
|  |  |  | Flowering time | Flowering time | Early flowering |
| 349 | G1842 | OE | Flowering time | Flowering time | Early flowering |
| 351 | G1843 | OE | Flowering time | Flowering time | Early flowering |
| 353 | G1852 | OE | Osmotic | Abiotic stress | Better root growth under osmotic stress |
| 355 | G1863 | OE | Leaf | Dev and morph | Altered leaf shape and coloration |
| 357 | G1880 | KO | *Botrytis* | Disease | Increased resistance to *Botrytis* |
| 359 | G1895 | OE | Flowering time | Flowering time | Late flowering |
| 361 | G1902 | OE | Seed oil content | Seed biochemistry | Increased seed oil content |
| 363 | G1903 | OE | Seed protein content | Seed biochemistry | Decreased seed protein content |
| 365 | G1919 | OE | *Botrytis* | Disease | Increased tolerance to *Botrytis* |
| 367 | G1927 | OE | *Sclerotinia* | Disease | Increased tolerance to *Sclerotinia* |
| 369 | G1930 | OE | Osmotic | Abiotic stress | Better germination under osmotic stress |
| 371 | G1936 | KO | *Sclerotinia* | Disease | Increased susceptibility to *Sclerotinia* |
|  |  |  | *Botrytis* | Disease | Increased susceptibility to *Botrytis* |
| 373 | G1944 | OE | Senescence | Dev and morph | Early senescence |
| 375 | G1946 | OE | Seed oil content | Seed biochemistry | Increased seed oil content |
|  |  |  | Seed protein content | Seed biochemistry | Decreased seed protein content |
|  |  |  | Flowering time | Flowering time | Early flowering |
|  |  |  | Nutrient uptake | Abiotic stress | Increased root growth on phosphate-free media |
| 377 | G1947 | KO | Fertility | Dev and morph | Reduced fertility |
| 379 | G1948 | OE | Seed oil content | Seed biochemistry | Increased seed oil content |
| 381 | G1950 | OE | *Botrytis* | Disease | Increased tolerance to *Botrytis* |
| 383 | G1958 | KO | Morphology: other | Dev and morph | Reduced size and root mass |
|  |  |  | Seed oil content | Seed biochemistry | Increased seed oil content |
|  |  |  | Seed protein content | Seed biochemistry | Increased seed protein content. |
| 385 | G2007 | OE | Flowering time | Flowering time | Late flowering |
| 387 | G2010 | OE | Flowering time | Flowering time | Early flowering |
| 389 | G2053 | OE | Osmotic | Abiotic stress | Increased root growth under osmotic stress |

TABLE 4-continued

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 391 | G2059 | OE | Seed oil content | Seed biochemistry | Altered seed oil content |
| | | | Seed protein content | Seed biochemistry | Altered seed protein content |
| 393 | G2085 | OE | Seed | Dev and morph | Increased seed size and altered seed color |
| 395 | G2105 | OE | Seed | Dev and morph | Large, pale seeds |
| 397 | G2110 | OE | Sodium chloride | Abiotic stress | Increased tolerance to high salt |
| 399 | G2114 | OE | Seed | Dev and morph | Increased seed size |
| 401 | G2117 | OE | Seed protein content | Seed biochemistry | Increased seed protein content |
| 403 | G2123 | OE | Seed oil content | Seed biochemistry | Increased seed oil content |
| 405 | G2130 | OE | Heat | Abiotic stress | Better germination in heat |
| 407 | G2133 | OE | Glyphosate | Herbicide sensitivity | Increased tolerance to glyphosate |
| | | | Flowering time | Flowering time | Late flowering |
| 409 | G2138 | OE | Seed oil content | Seed biochemistry | Increased seed oil content |
| 411 | G2140 | OE | Hormone sensitivity | Hormone sensitivity | Decreased sensitivity to ABA |
| | | | Osmotic | Abiotic stress | Better germination on high NaCl and sucrose |
| 413 | G2143 | OE | Inflorescence | Dev and morph | Altered inflorescence development |
| | | | Leaf | Dev and morph | Altered leaf shape, dark green color |
| | | | Flower | Dev and morph | Altered flower development, ectopic carpel tissue |
| 415 | G2144 | OE | Flowering time | Flowering time | Early flowering |
| | | | Leaf | Dev and morph | Pale green leaves, altered leaf shape |
| | | | Light response | Dev and morph | Long hypocotyls, altered leaf shape |
| 417 | G2153 | OE | Osmotic | Abiotic stress | Better germination under osmotic stress |
| 419 | G2155 | OE | Flowering time | Flowering time | Late flowering |
| 421 | G2192 | OE | Seed oil composition | Seed biochemistry | Altered seed fatty acid composition |
| 423 | G2295 | OE | Flowering time | Flowering time | Early flowering |
| 425 | G2340 | OE | Seed glucosinolates | Seed biochemistry | Altered glucosinolate profile |
| 427 | G2343 | OE | Seed oil content | Seed biochemistry | Increased seed oil content |
| 429 | G2346 | OE | Morphology: other | Dev and morph | Enlarged seedlings |
| 431 | G2347 | OE | Flowering time | Flowering time | Early flowering |
| 433 | G2379 | OE | Osmotic | Abiotic stress | Increased seedling vigor on high sucrose media |
| 435 | G2430 | OE | Heat | Abiotic stress | Increased tolerance to heat |
| | | | Size | Dev and morph | Increased leaf size, faster development |
| 437 | G2505 | OE | Drought | Abiotic stress | Increased tolerance to drought |
| 439 | G2509 | OE | Seed oil content | Seed biochemistry | Decreased seed oil content |
| | | | Seed protein content | Seed biochemistry | Increased seed protein content |
| | | | Seed prenyl lipids | Seed biochemistry | Increase in alpha-tocopherol |
| | | | Architecture | Dev and morph | Reduced apical dominance |
| | | | Flowering time | Flowering time | Early flowering |
| 441 | G2517 | OE | Glyphosate | Herbicide sensitivity | Increased tolerance to glyphosate |
| 443 | G2520 | OE | Seed prenyl lipids | Seed biochemistry | Altered tocopherol composition |
| 445 | G2555 | OE | Light response | Dev and morph | Constitutive photomorphogenesis |
| | | | Botrytis | Disease | Increased susceptibility to Botrytis |
| 447 | G2557 | OE | Leaf | Dev and morph | Altered leaf shape, dark green color |
| | | | Flower | Dev and morph | Altered flower development, ectopic carpel tissue |
| 449 | G2583 | OE | Leaf | Dev and morph | Glossy, shiny leaves |
| 451 | G2701 | OE | Osmotic | Abiotic stress | Better germination on high NaCl and sucrose |
| 453 | G2719 | OE | Osmotic | Abiotic stress | Increased seedling vigor on high sucrose |
| 455 | G2789 | OE | Osmotic | Abiotic stress | Better germination on high sucrose |
| | | | Hormone sensitivity | Hormone sensitivity | Reduced ABA sensitivity |
| 457 | G2830 | KO | Seed oil content | Seed biochemistry | Increased seed oil content |
| 1951 | G12 | KO | Hormone sensitivity | Hormone sensitivity | Increased sensitivity to ACC |
| | | OE | Morphology: other | Dev and morph | Leaf and hypocotyl necrosis |
| 1953 | G30 | OE | Leaf | Dev and morph | Glossy green leaves |
| | | | Light response | Dev and morph | Shade avoidance |
| 1975 | G231 | OE | Leaf fatty acids | Leaf biochemistry | Increased leaf unsaturated fatty acids |
| | | | Seed oil content | Seed biochemistry | Increased seed oil content |
| | | | Seed protein content | Seed biochemistry | Decreased seed protein content |
| 1979 | G247 | OE | Trichome | Dev and morph | Altered trichome distribution, reduced trichome density |
| 1991 | G370 | KO | Size | Dev and morph | Reduced size, shiny leaves |
| | | OE | Trichome | Dev and morph | Ectropic trichome formation |
| 2009 | G485 | OE | Flowering time | Flowering time | Early flowering |
| | | KO | Flowering time | Flowering time | Late flowering |
| 2061 | G839 | OE | Nutrient uptake | Abiotic stress | Increased tolerance to nitrogen-limited medium |

TABLE 4-continued

Traits, trait categories, and effects and utilities that transcription factor genes have on plants.

| Polynucleotide SEQ ID NO: | GID No. | OE/KO | Trait(s) | Category | Observations |
|---|---|---|---|---|---|
| 2099 | G1357 | OE | Leaf | Dev and morph | Altered leaf shape, dark green leaves |
|  |  |  | Chilling | Abiotic stress | Increased tolerance to cold |
|  |  |  | Hormone sensitivity | Hormone sensitivity | Insensitive to ABA |
|  |  |  | Flowering time | Flowering time | Late flowering |
| 2126 | G1646 | OE | Seed oil content | Seed oil content | Increased seed oil content |
| 2142 | G1816 | OE | Sugar sensing | Sugar sensing | Increased tolerance to glucose |
|  |  |  | Nutrient uptake | Abiotic stress | Altered C/N sensing; less anthocyanin on nitrogen-limited medium |
|  |  |  | Osmotic | Abiotic stress | Increased tolerance to osmotic stress |
|  |  |  | Root | Dev and morph | Increased root hairs |
|  |  |  | Trichome | Dev and morph | Glabrous leaves |
|  |  |  | Nutrient uptake | Abiotic stress | Increased tolerance to nitrogen-limited medium |
| 2147 | G1888 | OE | Size | Dev and morph | Reduced size, dark green leaves |
| 2153 | G1945 | OE | Flowering time | Flowering time | Late flowering |
|  |  |  | Leaf | Dev and morph | Altered leaf shape |
| 2195 | G2826 | OE | Flower | Dev and morph | Aerial rosettes |
|  |  |  | Trichome | Dev and morph | Ectropic trichome formation |
| 2197 | G2838 | OE | Trichome | Dev and morph | Increased trichome density |
|  |  |  | Flowering time | Flosering time | Late flowering |
|  |  |  | Flower | Dev and morph | Flower: multiple alterations |
|  |  |  | Flower | Dev and morph | Aerial rosettes |
|  |  |  | Leaves | Dev and morph | Dark green leaves |
|  |  |  | Size | Dev and morph | Increased seedling size |
| 2199 | G2839 | OE | Osmotic stress | Dev and morph | Better germination on high sucrose |
|  |  |  | Inflorescence | Dev and morph | Downward pedicels |
|  |  |  | Size | Abiotic stress | Reduced size |

Table 5 shows the polypeptides identified by SEQ ID NO; Mendel Gene ID (GID) No.; the transcription factor family to which the polypeptide belongs, and conserved domains of the polypeptide. The first column shows the polypeptide SEQ ID NO; the third column shows the transcription factor family to which the polynucleotide belongs; and the fourth column shows the amino acid residue positions of the conserved domain in amino acid (AA) co-ordinates.

TABLE 5

Gene families and conserved domains

| Polypeptide SEQ ID NO: | GID No. | Family | Conserved Domains in Amino Acid Coordinates |
|---|---|---|---|
| 2 | G8 | AP2 | 151-217, 243-296 |
| 4 | G19 | AP2 | 76-145 |
| 6 | G22 | AP2 | 89-157 |
| 8 | G24 | AP2 | 25-93 |
| 10 | G28 | AP2 | 145-213 |
| 12 | G47 | AP2 | 11-80 |
| 14 | G156 | MADS | 2-57 |
| 16 | G157 | MADS | 2-57 |
| 18 | G162 | MADS | 2-57 |
| 20 | G175 | WRKY | 178-234, 372-428 |
| 22 | G180 | WRKY | 118-174 |
| 24 | G183 | WRKY | 307-363 |
| 26 | G188 | WRKY | 175-222 |
| 28 | G189 | WRKY | 240-297 |
| 30 | G192 | WRKY | 128-185 |
| 32 | G196 | WRKY | 223-283 |
| 34 | G211 | MYB-R1 R2R3 | 24-137 |
| 36 | G214 | MYB-related | 22-71 |
| 38 | G226 | MYB-related | 28-78 |
| 40 | G241 | MYB-R1 R2R3 | 14-114 |
| 42 | G248 | MYB-R1 R2R3 | 264-332 |
| 44 | G254 | MYB-related | 62-106 |
| 46 | G256 | MYB-R1 R2R3 | 13-115 |
| 48 | G278 | AKR | 2-593 |

TABLE 5-continued

Gene families and conserved domains

| Polypeptide SEQ ID NO: | GID No. | Family | Conserved Domains in Amino Acid Coordinates |
|---|---|---|---|
| 50 | G291 | MISC | 132-160 |
| 52 | G303 | HLH/MYC | 92-161 |
| 54 | G312 | SCR | 320-336 |
| 56 | G325 | Z-CO-like | 5-28, 48-71 |
| 58 | G343 | GATA/Zn | 178-214 |
| 60 | G353 | Z-C2H2 | 41-61, 84-104 |
| 62 | G354 | Z-C2H2 | 42-62, 88-109 |
| 64 | G361 | Z-C2H2 | 43-63 |
| 66 | G362 | Z-C2H2 | 62-82 |
| 68 | G371 | RING/C3HC4 | 21-74 |
| 70 | G390 | HB | 18-81 |
| 72 | G391 | HB | 25-85 |
| 74 | G409 | HB | 64-124 |
| 76 | G427 | HB | 307-370 |
| 78 | G438 | HB | 22-85 |
| 80 | G450 | IAA | 6-14, 78-89, 112-128, 180-213 |
| 82 | G464 | IAA | 20-28, 71-82, 126-142, 187-224 |
| 84 | G470 | ARF | 61-393 |
| 86 | G477 | SBP | 108-233 |
| 88 | G481 | CAAT | 20-109 |
| 90 | G482 | CAAT | 25-116 |
| 92 | G484 | CAAT | 11-104 |
| 94 | G489 | CAAT | 57-156 |
| 96 | G490 | CAAT | 48-143 |
| 98 | G504 | NAC | 19-174 |
| 100 | G509 | NAC | 13-169 |
| 102 | G519 | NAC | 11-104 |
| 104 | G545 | Z-C2H2 | 82-102, 136-154 |
| 106 | G546 | RING/C3H2C3 | 114-155 |
| 108 | G561 | bZIP | 248-308 |
| 110 | G562 | bZIP | 253-315 |
| 112 | G567 | bZIP | 210-270 |
| 114 | G568 | bZIP | 215-265 |
| 116 | G584 | HLH/MYC | 401-494 |
| 118 | G585 | HLH/MYC | 436-501 |

TABLE 5-continued

Gene families and conserved domains

| Polypeptide SEQ ID NO: | GID No. | Family | Conserved Domains in Amino Acid Coordinates |
|---|---|---|---|
| 120 | G590 | HLH/MYC | 202-254 |
| 122 | G594 | HLH/MYC | 140-204 |
| 124 | G597 | AT-hook | 97-104, 137-144 |
| 126 | G598 | DBP | 205-263 |
| 128 | G634 | TH | 62-147, 189-245 |
| 130 | G635 | TH | 239-323 |
| 132 | G636 | TH | 55-145, 405-498 |
| 134 | G638 | TH | 119-206 |
| 136 | G652 | Z-CLDSH | 28-49, 137-151, 182-196 |
| 138 | G663 | MYB-R1 R2R3 | 9-111 |
| 140 | G664 | MYB-R1 R2R3 | 13-116 |
| 142 | G674 | MYB-R1 R2R3 | 20-120 |
| 144 | G676 | MYB-R1 R2R3 | 17-119 |
| 146 | G680 | MYB-related | 24-70 |
| 148 | G682 | MYB-related | 27-63 |
| 150 | G715 | CAAT | 60-132 |
| 152 | G720 | GARP | 301-349 |
| 154 | G736 | Z-Dof | 54-111 |
| 156 | G748 | Z-Dof | 112-140 |
| 158 | G779 | HLH/MYC | 126-182 |
| 160 | G789 | HLH/MYC | 253-313 |
| 162 | G801 | PCF | 32-93 |
| 164 | G849 | BPF-1 | 324-413, 504-583 |
| 166 | G859 | MADS | 3-56 |
| 168 | G864 | AP2 | 119-186 |
| 170 | G867 | AP2 | 59-124 |
| 172 | G869 | AP2 | 109-177 |
| 174 | G877 | WRKY | 272-328, 487-603 |
| 176 | G881 | WRKY | 176-233 |
| 178 | G892 | RING/C3H2C3 | 177-270 |
| 180 | G896 | Z-LSDlike | 18-39 |
| 182 | G910 | Z-CO-like | 14-37, 77-103 |
| 184 | G911 | RING/C3H2C3 | 86-129 |
| 186 | G912 | AP2 | 51-118 |
| 188 | G913 | AP2 | 62-128 |
| 190 | G922 | SCR | 225-242 |
| 192 | G926 | CAAT | 131-225 |
| 194 | G961 | NAC | 15-140 |
| 196 | G971 | AP2 | 120-186 |
| 198 | G974 | AP2 | 81-140 |
| 200 | G975 | AP2 | 4-71 |
| 202 | G979 | AP2 | 63-139, 165-233 |
| 204 | G987 | SCR | 428-432, 704-708 |
| 206 | G988 | SCR | 178-195 |
| 208 | G1040 | GARP | 109-158 |
| 210 | G1047 | bZIP | 129-180 |
| 212 | G1051 | bZIP | 189-250 |
| 214 | G1052 | bZIP | 201-261 |
| 216 | G1062 | HLH/MYC | 308-359 |
| 218 | G1063 | HLH/MYC | 131-182 |
| 220 | G1064 | PCF | 116-179 |
| 222 | G1069 | AT-hook | 67-74 |
| 224 | G1073 | AT-hook | 33-42, 78-175 |
| 226 | G1075 | AT-hook | 78-85 |
| 228 | G1084 | BZIPT2 | 1-53, 490-619 |
| 230 | G1089 | BZIPT2 | 425-500 |
| 232 | G1134 | HLH/MYC | 198-247 |
| 234 | G1140 | MADS | 2-57 |
| 236 | G1143 | HLH/MYC | 33-82 |
| 238 | G1146 | PAZ | 886-896 |
| 240 | G1196 | AKR | 179-254 |
| 242 | G1198 | bZIP | 173-223 |
| 244 | G1225 | HLH/MYC | 78-147 |
| 246 | G1226 | HLH/MYC | 115-174 |
| 248 | G1229 | HLH/MYC | 102-160 |
| 250 | G1255 | Z-CO-like | 18-56 |
| 252 | G1266 | AP2 | 79-147 |
| 254 | G1275 | WRKY | 113-169 |
| 256 | G1305 | MYB-R1 R2R3 | 15-118 |
| 258 | G1322 | MYB-R1 R2R3 | 26-130 |
| 260 | G1323 | MYB-R1 R2R3 | 15-116 |
| 262 | G1330 | MYB-R1 R2R3 | 28-134 |
| 264 | G1331 | MYB-R1 R2R3 | 8-109 |
| 266 | G1332 | MYB-R1 R2R3 | 13-116 |
| 268 | G1363 | CAAT | 174-226 |
| 270 | G1411 | AP2 | 87-154 |
| 272 | G1417 | WRKY | 239-296 |
| 274 | G1419 | AP2 | 69-137 |
| 276 | G1449 | IAA | 48-53, 74-107, 122-152 |
| 278 | G1451 | ARF | 22-357 |
| 280 | G1452 | NAC | 30-177 |
| 282 | G1463 | NAC | 9-156 |
| 284 | G1471 | Z-C2H2 | 49-70 |
| 286 | G1478 | Z-CO-like | 32-76 |
| 288 | G1482 | Z-CO-like | 5-63 |
| 290 | G1488 | GATA/Zn | 221-246 |
| 292 | G1494 | HLH/MYC | 261-311 |
| 294 | G1496 | HLH/MYC | 184-248 |
| 296 | G1499 | HLH/MYC | 118-181 |
| 298 | G1519 | RING/C3HC4 | 327-364 |
| 300 | G1526 | SWI/SNF | 493-620, 864-1006 |
| 302 | G1540 | HB | 35-98 |
| 304 | G1543 | HB | 135-195 |
| 306 | G1634 | MYB-related | 129-180 |
| 308 | G1637 | MYB-related | 109-173 |
| 310 | G1640 | MYB-R1 R2R3 | 14-115 |
| 312 | G1645 | MYB-R1 R2R3 | 90-210 |
| 314 | G1646 | CAAT | 72-162 |
| 316 | G1652 | HLH/MYC | 143-215 |
| 318 | G1672 | NAC | 41-194 |
| 320 | G1677 | NAC | 17-181 |
| 322 | G1749 | AP2 | 84-155 |
| 324 | G1750 | AP2 | 107-173 |
| 326 | G1756 | WRKY | 141-197 |
| 328 | G1765 | NAC | 20-140 |
| 330 | G1777 | RING/C3HC4 | 124-247 |
| 332 | G1792 | AP2 | 17-85 |
| 334 | G1793 | AP2 | 179-255, 281-349 |
| 336 | G1794 | AP2 | 182-249 |
| 338 | G1804 | bZIP | 357-407 |
| 340 | G1818 | CAAT | 36-113 |
| 342 | G1820 | CAAT | 70-133 |
| 344 | G1836 | CAAT | 30-164 |
| 346 | G1838 | AP2 | 229-305, 330-400 |
| 348 | G1841 | AP2 | 83-150 |
| 350 | G1842 | MADS | 2-57 |
| 352 | G1843 | MADS | 2-57 |
| 354 | G1852 | AKR | 1-600 |
| 356 | G1863 | GRF-like | 77-186 |
| 358 | G1880 | Z-C2H2 | 69-89, 111-139 |
| 360 | G1895 | Z-Dof | 55-110 |
| 362 | G1902 | Z-Dof | 31-59 |
| 364 | G1903 | Z-Dof | 134-180 |
| 366 | G1919 | RING/C3HC4 | 214-287 |
| 368 | G1927 | NAC | 17-188 |
| 370 | G1930 | AP2 | 59-124 |
| 372 | G1936 | PCF | 64-129 |
| 374 | G1944 | AT-hook | 87-100 |
| 376 | G1946 | HS | 32-130 |
| 378 | G1947 | HS | 37-120 |
| 380 | G1948 | AKR | 75-126, 120-148, 152-181, 186-215, 261-311, 312-363 |
| 382 | G1950 | AKR | 65-228 |
| 384 | G1958 | GARP | 230-278 |
| 386 | G2007 | MYB-R1 R2R3 | 14-116 |
| 388 | G2010 | SBP | 53-127 |
| 390 | G2053 | NAC | 10-149 |
| 392 | G2059 | AP2 | 184-254 |
| 394 | G2085 | RING/C3HC4 | 214-241 |
| 396 | G2105 | TH | 100-153 |
| 398 | G2110 | WRKY | 239-298 |
| 400 | G2114 | AP2 | 221-297, 323-393 |
| 402 | G2117 | bZIP | 46-106 |
| 404 | G2123 | GF14 | 99-109 |
| 406 | G2130 | AP2 | 93-160 |
| 408 | G2133 | AP2 | 11-83 |
| 410 | G2138 | AP2 | 76-148 |
| 412 | G2140 | HLH/MYC | 167-242 |
| 414 | G2143 | HLH/MYC | 128-179 |
| 416 | G2144 | HLH/MYC | 203-283 |

TABLE 5-continued

Gene families and conserved domains

| Polypeptide SEQ ID NO: | GID No. | Family | Conserved Domains in Amino Acid Coordinates |
|---|---|---|---|
| 418 | G2153 | AT-hook | 75-94, 162-206 |
| 420 | G2155 | AT-hook | 18-38 |
| 422 | G2192 | bZIP-NIN | 600-700 |
| 424 | G2295 | MADS | 2-57 |
| 426 | G2340 | MYB-R1 R2R3 | 14-120 |
| 428 | G2343 | MYB-R1 R2R3 | 14-116 |
| 430 | G2346 | SBP | 59-135 |
| 432 | G2347 | SBP | 60-136 |
| 434 | G2379 | TH | 19-110, 173-232 |
| 436 | G2430 | GARP | 425-478 |
| 438 | G2505 | NAC | 10-159 |
| 440 | G2509 | AP2 | 89-156 |
| 442 | G2517 | WRKY | 118-174 |
| 444 | G2520 | HLH/MYC | 135-206 |
| 446 | G2555 | HLH/MYC | 175-245 |
| 448 | G2557 | HLH/MYC | 278-328 |
| 450 | G2583 | AP2 | 4-71 |
| 452 | G2701 | MYB-related | 33-81, 129-183 |
| 454 | G2719 | MYB-R1 R2R3 | 56-154 |
| 456 | G2789 | AT-hook | 53-73, 121-165 |
| 458 | G2830 | Z-C2H2 | 245-266 |

Examples of some of the utilities that may be desirable in plants, and that may be provided by transforming the plants with the presently disclosed sequences, are listed in Table 6. Many of the transcription factors listed in Table 6 may be operably linked with a specific promoter that causes the transcription factor to be expressed in response to environmental, tissue-specific or temporal signals. For example, G362 induces ectopic trichomes on flowers but also produces small plants. The former may be desirable to produce insect or herbivore resistance, or increased cotton yield, but the latter may be undesirable in that it may reduce biomass. However, by operably linking G362 with a flower-specific promoter, one may achieve the desirable benefits of the gene without affecting overall biomass to a significant degree. For examples of flower specific promoters, see Kaiser et al. (supra). For examples of other tissue-specific, temporal-specific or inducible promoters, see the above discussion under the heading "Vectors, Promoters, and Expression Systems".

TABLE 6

Genes, traits and utilities that affect plant characteristics

| Trait Category | Phenotype(s) | Transcription factor genes that impact traits | Utility |
|---|---|---|---|
| Abiotic stress | Effect of chilling on plants | | |
| | Increased tolerance: | G256; G664; G1322 | Improved germination, growth rate, earlier planting, yield |
| | Germination in cold | | |
| | Increased tolerance: | G256; G664 | Earlier planting; improved survival, yield |
| | Freezing tolerance | G720 (G720 KO is more susceptible); G912; G913 | Earlier planting; improved quality, survival, yield |
| | Drought | | |
| | Increased tolerance: | G912; G913; G1820; G1836; G2505 | Improved survival, vigor, appearance, yield |
| | Heat | | |
| | Increased tolerance: | G464; G682; G864; G1305; G1841; G2130; G2430 | Improved germination, growth rate, later planting, yield |
| | Osmotic stress | | |
| | Increased sensitivity: | G1794 | Abiotic stress response manipulation |
| | Increased tolerance: | G47; G175; G188; G303; G325; G353; G489; G922; G926; G1069; G1089; G1452; G1816; G1820; G1852; G1930; G2053; G2140; G2153; G2379; G2701; G2719; G2789; G2839 | Improved germination rate, seedling vigor, survival, yield |
| | Salt tolerance | | |
| | More susceptible: | G545 | Manipulation of response to high salt conditions |
| | Increased tolerance: | G22; G196; G226; G312; G482; G801; G867; G922; G1836; G2110 | Improved germination rate, survival, yield; extended growth range |

TABLE 6-continued

Genes, traits and utilities that affect plant characteristics

| Trait Category | Phenotype(s) | Transcription factor genes that impact traits | Utility |
| --- | --- | --- | --- |
| | Nitrogen stress | | |
| | Sensitivity to N limitation: | G1794 | Manipulation of response to low nutrient conditions |
| | Tolerance to N limitation: | G225; G226; G839; G1792; G1816 | Improved yield and nutrient stress tolerance, decreased fertilizer usage |
| | Phosphate stress | | |
| | Tolerance to P limitation: | G545; G561; G911; G1946 | Improved yield and nutrient stress tolerance, decreased fertilizer usage |
| | Oxidative stress | G477 | Improved yield, quality, ultraviolet and chemical stress tolerance |
| Herbicide | Glyphosate | G343; G2133; G2517 | Generation of glyphosate-resistant plants to improve weed control |
| Hormone sensitivity | Abscisic acid (ABA) sensitivity | | |
| | Reduced sensitivity to ABA: | G546; G926; G1069; G1357; G1452; G1820; G2140; G2789 | Modification of seed development, improved seed dormancy, cold and dehydration tolerance |
| | Sensitivity to ethylene | | |
| | Altered response: | G1134 | Manipulation of fruit ripening |
| | Insensitive to ethylene: | G1330 | |
| Disease | *Botrytis* | | |
| | Increased susceptibility: | G248; G371; G1064; G1084; G1196; G1255; G1756; G1936; G2555 | Manipulation of response to disease organism |
| | Increased resistance or tolerance: | G28; G1792; G1880; G1919; G1950 | Improved yield, appearance, survival, extended range |
| | *Fusarium* | | |
| | Increased susceptibility: | G188; G545; G896 | Manipulation of response to disease organism |
| | Increased resistance or tolerance: | G1047; G1792 | Improved yield, appearance, survival, extended range |
| | *Erysiphe* | | |
| | Increased susceptibility: | G545; G881 | Manipulation of response to disease organism |
| | Increased resistance or tolerance: | G19; G28; G409; G1266; G1363; G1792 | Improved yield, appearance, survival, extended range |
| | *Pseudomonas* | | |
| | Increased susceptibility: | G545 | Manipulation of response to disease organism |
| | *Sclerotinia* | | |
| | Increased susceptibility: | G278; G477; G594; G1936 | Manipulation of response to disease organism |
| | Increased resistance or tolerance: | G28; G1927 | Improved yield, appearance, survival, extended range |

TABLE 6-continued

Genes, traits and utilities that affect plant characteristics

| Trait Category | Phenotype(s) | Transcription factor genes that impact traits | Utility |
|---|---|---|---|
| Growth regulator | Altered sugar sensing | | |
| | Decreased tolerance to sugars: | G241; G254; G567; G680; G912; G1804 | Alteration of energy balance, photosynthetic rate, carbohydrate accumulation, biomass production, source-sink relationships, senescence; alteration of storage compound accumulation in seeds |
| | Increased tolerance to sugars: | G481; G867; G1225; G1816 | |
| | Altered C/N sensing | G1816 | |
| Flowering time | Early flowering | G157; G180; G183; G485 (OE); G490; G590; G789; G1225; G1494; G1820; G1841; G1842; G1843; G1946; G2010; G2144; G2295; G2347; G2509 | Faster generation time; synchrony of flowering; additional harvests within a growing season, shortening of breeding programs |
| | Late flowering | G8; G47; G157; G192; G214; G231; G361; G362; G485 (KO); G562; G736; G748; G859; G910; G913; G971; G1051; G1052; G1357; G1452; G1478; G1804; G1895; G1945; G2007; G2133; G2155; G2838 | Increased yield or biomass, alleviate risk of transgenic pollen escape, synchrony of flowering |
| General development and morphology | Altered flower structure | | |
| | Stamen: | G988; G1075; G1140; G1499; G2557 | Ornamental modification of plant architecture, improved or reduced fertility to mitigate escape of transgenic pollen, improved fruit size, shape, number or yield |
| | Sepal: | G1075; G1140; G2557 | |
| | Petal: | G638; G1075; G1140; G1449; G1499; G2557 | |
| | Pedicel: | G353; G354; G988 | |
| | Carpel: | G1063; G1140; G2143; G2143; G2557 | |
| | Multiple alterations: | G638; G988; G1063; G1140; G1449; G1499; G2143; G2557 G988; G1449; G2838 | |
| | Enlarged floral organs: | G353; G354 | |
| | Siliques: | G470; G779; G988; G1075; G1140; G1499; G1947; G2143; G2557 | |
| | Reduced fertility: | G638; G779; G1140; G1499 | |
| | Aerial rosettes | G1995; G2826; G2838 | |
| | Inflorescence architectural change | | |
| | Altered branching pattern: | G47; G1063; G1645; G2143 | Ornamental modification of flower architecture; timing of flowering; altered plant habit for yield or harvestability benefit; reduction in pollen production of genetically modified plants; manipulation of seasonality and annual or perennial habit; manipulation of determinate vs. indeterminate growth |
| | Short internodes/bushy inflorescences: | G47 | |
| | Internode elongation: | G1063 | |
| | Lack of inflorescence: | G1499; G2143 | |
| | Altered shoot meristem development | | |
| | Stem bifurcations: | G390; G391 | Ornamental modification of plant architecture, manipulation of growth and development, increase in leaf numbers, modulation of branching patterns to provide improved yield or biomass |

TABLE 6-continued

Genes, traits and utilities that affect plant characteristics

| Trait Category | Phenotype(s) | Transcription factor genes that impact traits | Utility |
|---|---|---|---|
| | Altered branching pattern | G427; G568; G988; G1543; G1794 | Ornamental modification of plant architecture, improved lodging resistance |
| | Apical dominance | | |
| | Reduced apical dominance: | G47; G211; G1255; G1275; G1411; G1488; G1794; G2509 | Ornamental modification of plant architecture |
| | Altered trichome density; development, or structure | | |
| | Reduced or no trichomes: | G225; G226; G247; G585; G676; G682; G1332; G1452; G1816 | Ornamental modification of plant architecture, increased plant product (e.g., diterpenes, cotton) productivity, insect and herbivore resistance |
| | Ectopic trichomes/altered trichome development/cell fate: | G247; G362; G370; G676; G2826 | |
| | Increase in trichome number, size or density: | G362; G634; G838; G2838 | |
| | Stem morphology and altered vascular tissue structure | G47; G438; G748; G988; G1488 | Modulation of lignin content; improvement of wood, palatability of fruits and vegetables |
| | Root development | | |
| | Increased root growth and proliferation: | G1482 | Improved yield, stress tolerance; anchorage |
| | Increased root hairs: | G225; G226; G1816 | |
| | Altered seed development, ripening and germination | G979 | |
| | Cell differentiation and cell proliferation | G1540 | Increase in carpel or fruit development; improve regeneration of shoots from callus in transformation or micro-propagation systems |
| | Rapid development | G2430 | Promote faster development and reproduction in plants |
| | Senescence | | |
| | Premature senescence: | G636; G1463; G1944 | Improvement in response to disease, fruit ripening |
| | Lethality when overexpressed | G877; G1519 | Herbicide target; ablation of specific tissues or organs such as stamen to prevent pollen escape |
| | Necrosis | G12, G24 | Disease resistance |
| Plant size | Increased plant size | G1073; G1451 | Improved yield, biomass, appearance |
| | Larger seedlings | G2346; G2838 | Increased survival and vigor of seedlings, yield |
| | Dwarfed or more compact plants | G24; G343; G353; G354; G362; G370; G1008; G1277; G1543; G1794; G1958 | Dwarfism, lodging resistance, manipulation of gibberellin responses |
| Leaf morphology | Dark green leaves | G674; G912; G1063; G1357; G1452; G1482; G1499; G1792; G1863; G1888; G2143; G2557; G2838 | Increased photosynthesis, biomass, appearance, yield |
| | Change in leaf shape | G211; G353; G674; G736; G1063; G1146; G1357; G1452; G1494; G1543; G1863; G2143; G2144 | Ornamental applications |

TABLE 6-continued

Genes, traits and utilities that affect plant characteristics

| Trait Category | Phenotype(s) | Transcription factor genes that impact traits | Utility |
|---|---|---|---|
| | Altered leaf size: | | |
| | Increased leaf size, number or mass: | G189; G214; G1451; G2430 | Increased yield, ornamental applications |
| | Light green leaves | G1494; G2144 | Ornamental applications |
| | Variegation | G635 | Ornamental applications |
| | Glossy leaves | G30; G1792; G2583 | Ornamental applications, manipulation of wax composition, amount, or distribution |
| Seed morphology | Altered seed coloration Seed size and shape | G156; G2105; G2085 | Appearance |
| | Increased seed size: | G450; G584; G1255; G2085; G2105; G2114 | Yield, appearance |
| | Decreased seed size: | G1040 | Appearance |
| | Altered seed shape: | G1040; G1062 | Appearance |
| Leaf biochemistry | Increased leaf wax | G975; G1792; G2583 | Insect, pathogen resistance |
| | Leaf prenyl lipids | | |
| | Reduced chlorophyll: | G987 | |
| | Increase in tocopherols | G652; G987; G2509 | |
| | Increased lutein content | G748 | |
| | Increase in chlorophyll or carotenoids: | G214; G1543 | |
| | Leaf insoluble sugars | | |
| | Increase in leaf xylose | G211 | |
| | Increased leaf anthocyanins | G663; G1482; G1888 | |
| | Leaf fatty acids | | |
| | Reduction in leaf fatty acids: | G987 | |
| | Increase in leaf fatty acids: | G214 | |
| Seed | Seed oil content | | |
| biochemistry | Increased oil content: | G162; G291; G427; G509; G519; G561; G590; G598; G629; G715; G849; G961; G1198; G1226; G1471; G1478; G1526; G1640; G1646; G1750; G1765; G1777; G1793; G1838; G1902; G1946; G1948; G1958; G2123; G2138; G2343; G2830 | Improved oil yield Reduced caloric content |
| | Decreased oil content: | G180; G192; G241; G504; G1143; G1229; G1323; G1543; G2509 | |
| | Altered oil content: | G567; G892; G974; G1451; G1496; G1646; G1672; G1677 | |
| | Altered fatty acid content: Seed protein content | G869; G1417; G2192 | |
| | Increased protein content: | G162; G226; G241; G509; G988; G1323; G1419; G1652; G1818; G1820; G1958; G2117; G2509 | Improved protein yield, nutritional value Reduced caloric content |
| | Decreased protein content: | G427; G1478; G1777; G1903; G1946 | |
| | Altered protein content: | G162; G567; G597; G849; G892; G1634; G1637; G1677 | |
| | Altered seed prenyl lipid content or composition Seed glucosinolate | G652; G2509; G2520 | Improved antioxidant and vitamin E content |
| | Altered profile: | G484; G2340 | |
| | Increased seed anthocyanins | G362; G663 | |
| Root | Increased root anthocyanins | G663 | |
| Biochemistry | | | |
| Light response/shade avoidance | Altered cotyledon, hypocotyl, petiole development; altered leaf orientation; constitutive photomorphogenesis; photomorphogenesis in low light | G183; G354; G1322; G1331; G1488; G1494; G1794; G2144; G2555 | Potential for increased planting densities and yield enhancement |

TABLE 6-continued

Genes, traits and utilities that affect plant characteristics

| Trait Category | Phenotype(s) | Transcription factor genes that impact traits | Utility |
|---|---|---|---|
| Pigment | Increased anthocyanin level | G362; G663; G1482 | Enhanced health benefits, improved ornamental appearance, increased stress resistance, attraction of pollinating and seed-dispersing animals |

Abbreviations:
N = nitrogen
P = phosphate
ABA = abscisic acid
C/N = carbon/nitrogen balance Detailed Description of Genes, Traits and Utilities that Affect Plant Characteristics The following descriptions of traits and utilities associated with the present transcription factors offer a more comprehensive description than that provided in Table 6.

Abiotic Stress, General Considerations

Plant transcription factors can modulate gene expression, and, in turn, be modulated by the environmental experience of a plant. Significant alterations in a plant's environment invariably result in a change in the plant's transcription factor gene expression pattern. Altered transcription factor expression patterns generally result in phenotypic changes in the plant. Transcription factor gene product(s) in transgenic plants then differ(s) in amounts or proportions from that found in wild-type or non-transformed plants, and those transcription factors likely represent polypeptides that are used to alter the response to the environmental change. By way of example, it is well accepted in the art that analytical methods based on altered expression patterns may be used to screen for phenotypic changes in a plant far more effectively than can be achieved using traditional methods.

Abiotic stress: adult stage chilling. Enhanced chilling tolerance may extend the effective growth range of chilling sensitive crop species by allowing earlier planting or later harvest. Improved chilling tolerance may be conferred by increased expression of glycerol-3-phosphate acetyltransferase in chloroplasts (see, for example, Wolter et al. (1992) et al. *EMBO J.* 4685-4692, and Murata et al. (1992) *Nature* 356: 710-713).

Chilling tolerance could also serve as a model for understanding how plants adapt to water deficit. Both chilling and water stress share similar signal transduction pathways and tolerance/adaptation mechanisms. For example, acclimation to chilling temperatures can be induced by water stress or treatment with abscisic acid. Genes induced by low temperature include dehydrins (or LEA proteins). Dehydrins are also induced by salinity, abscisic acid, water stress, and during the late stages of embryogenesis.

Another large impact of chilling occurs during post-harvest storage. For example, some fruits and vegetables do not store well at low temperatures (for example, bananas, avocados, melons, and tomatoes). The normal ripening process of the tomato is impaired if it is exposed to cool temperatures. Transcription factor genes conferring resistance to chilling temperatures, including G256, G664, and G1322 may thus enhance tolerance during post-harvest storage.

Abiotic stress: cold germination. Several of the presently disclosed transcription factor genes confer better germination and growth in cold conditions. For example, the improved germination in cold conditions seen with G256 and G664 indicates a role in regulation of cold responses by these genes and their equivalogs. These genes might be engineered to manipulate the response to low temperature stress. Genes that would allow germination and seedling vigor in the cold would have highly significant utility in allowing seeds to be planted earlier in the season with a high rate of survival. Transcription factor genes that confer better survival in cooler climates allow a grower to move up planting time in the spring and extend the growing season further into autumn for higher crop yields. Germination of seeds and survival at temperatures significantly below that of the mean temperature required for germination of seeds and survival of non-transformed plants would increase the potential range of a crop plant into regions in which it would otherwise fail to thrive.

Abiotic stress: freezing tolerance and osmotic stress. Presently disclosed transcription factor genes, including G47, G175, G188, G303, G325, G353, G489, G922, G926, G1069, G1089, G1452, G1820, G1852, G1930, G2053, G2140, G2153, G2379, G2701, G2719, G2789, G2839 and their equivalogs, that increase germination rate and/or growth under adverse osmotic conditions, could impact survival and yield of seeds and plants. Osmotic stresses may be regulated by specific molecular control mechanisms that include genes controlling water and ion movements, functional and structural stress-induced proteins, signal perception and transduction, and free radical scavenging, and many others (Wang et al. (2001) *Acta Hort.* (ISHS) 560: 285-292). Instigators of osmotic stress include freezing, drought and high salinity, each of which are discussed in more detail below.

In many ways, freezing, high salt and drought have similar effects on plants, not the least of which is the induction of common polypeptides that respond to these different stresses. For example, freezing is similar to water deficit in that freezing reduces the amount of water available to a plant. Exposure to freezing temperatures may lead to cellular dehydration as water leaves cells and forms ice crystals in intercellular spaces (Buchanan, supra). As with high salt concentration and freezing, the problems for plants caused by low water availability include mechanical stresses caused by the withdrawal of cellular water. Thus, the incorporation of transcription factors that modify a plant's response to osmotic stress or improve tolerance to (e.g., by G720, G912, G913 or their equivalogs) into, for example, a crop or ornamental plant, may be useful in reducing damage or loss. Specific effects caused by freezing, high salt and drought are addressed below.

Abiotic stress: drought and low humidity tolerance. Exposure to dehydration invokes similar survival strategies in plants as does freezing stress (see, for example, Yelenosky (1989) *Plant Physiol* 89: 444-451) and drought stress induces freezing tolerance (see, for example, Siminovitch et al. (1982) *Plant Physiol* 69: 250-255; and Guy et al. (1992) *Planta* 188: 265-270). In addition to the induction of cold-acclimation proteins, strategies that allow plants to survive in low water conditions may include, for example, reduced surface area, or surface oil or wax production. A number of presently disclosed transcription factor genes, e.g., G912, G913, G1820, G1836 and G2505 increase a plant's tolerance to low water conditions and, along with their functional equivalogs, would provide the benefits of improved survival, increased yield and an extended geographic and temporal planting range.

Abiotic stress: heat stress tolerance. The germination of many crops is also sensitive to high temperatures. Presently disclosed transcription factor genes that provide increased heat tolerance, including G464, G682, G864, G1305, G1841, G2130, G2430 and their equivalogs, would be generally useful in producing plants that germinate and grow in hot conditions, may find particular use for crops that are planted late in the season, or extend the range of a plant by allowing growth in relatively hot climates.

Abiotic stress: salt. The genes in Table 6 that provide tolerance to salt may be used to engineer salt tolerant crops and trees that can flourish in soils with high saline content or under drought conditions. In particular, increased salt tolerance during the germination stage of a plant enhances survival and yield. Presently disclosed transcription factor genes, including G22, G196, G226, G312, G482, G801, G867, G922, G1836, G2110, and their equivalogs that provide increased salt tolerance during germination, the seedling stage, and throughout a plant's life cycle, would find particular value for imparting survival and yield in areas where a particular crop would not normally prosper.

Nutrient uptake and utilization: nitrogen and phosphorus. Presently disclosed transcription factor genes introduced into plants provide a means to improve uptake of essential nutrients, including nitrogenous compounds, phosphates, potassium, and trace minerals. The enhanced performance of, for example, G225, G226, G839, G1792, and other overexpressing lines under low nitrogen, and G545, G561, G911, G1946 under low phosphorous conditions indicate that these genes and their equivalogs can be used to engineer crops that could thrive under conditions of reduced nutrient availability. Phosphorus, in particular, tends to be a limiting nutrient in soils and is generally added as a component in fertilizers. Young plants have a rapid intake of phosphate and sufficient phosphate is important for yield of root crops such as carrot, potato and parsnip.

The effect of these modifications is to increase the seedling germination and range of ornamental and crop plants. The utilities of presently disclosed transcription factor genes conferring tolerance to conditions of low nutrients also include cost savings to the grower by reducing the amounts of fertilizer needed, environmental benefits of reduced fertilizer runoff into watersheds; and improved yield and stress tolerance. In addition, by providing improved nitrogen uptake capability, these genes can be used to alter seed protein amounts and/or composition in such a way that could impact yield as well as the nutritional value and production of various food products.

A number of the transcription factor-overexpressing lines make less anthocyanin on high sucrose plus glutamine indicates that these genes can be used to modify carbon and nitrogen status, and hence assimilate partitioning (assimilate partitioning refers to the manner in which an essential element, such as nitrogen, is distributed among different pools inside a plant, generally in a reduced form, for the purpose of transport to various tissues).

Increased tolerance of plants to oxidative stress. In plants, as in all living things, abiotic and biotic stresses induce the formation of oxygen radicals, including superoxide and peroxide radicals. This has the effect of accelerating senescence, particularly in leaves, with the resulting loss of yield and adverse effect on appearance. Generally, plants that have the highest level of defense mechanisms, such as, for example, polyunsaturated moieties of membrane lipids, are most likely to thrive under conditions that introduce oxidative stress (e.g., high light, ozone, water deficit, particularly in combination). Introduction of the presently disclosed transcription factor genes, including G477 and its equivalogs, that increase the level of oxidative stress defense mechanisms would provide beneficial effects on the yield and appearance of plants. One specific oxidizing agent, ozone, has been shown to cause significant foliar injury, which impacts yield and appearance of crop and ornamental plants. In addition to reduced foliar injury that would be found in ozone resistant plant created by transforming plants with some of the presently disclosed transcription factor genes, the latter have also been shown to have increased chlorophyll fluorescence (Yu-Sen Chang et al. (2001) *Bot. Bull. Acad. Sin.* 42: 265-272).

Decreased herbicide sensitivity. Presently disclosed transcription factor genes, including G343, G2133, G2517 and their equivalogs, that confer resistance or tolerance to herbicides (e.g., glyphosate) will find use in providing means to increase herbicide applications without detriment to desirable plants. This would allow for the increased use of a particular herbicide in a local environment, with the effect of increased detriment to undesirable species and less harm to transgenic, desirable cultivars.

Knockouts of a number of the presently disclosed transcription factor genes have been shown to be lethal to developing embryos. Thus, these genes are potentially useful as herbicide targets.

Hormone sensitivity. ABA plays regulatory roles in a host of physiological processes in all higher as well as in lower plants (Davies et al. (1991) Abscisic Acid: Physiology and Biochemistry. Bios Scientific Publishers, Oxford, UK; Zeevaart et al. (1988) *Ann Rev Plant Physiol. Plant Mol. Biol.* 49: 439-473; Shimizu-Sato et al. (2001) *Plant Physiol* 127: 1405-1413). ABA mediates stress tolerance responses in higher plants, is a key signal compound that regulates stomatal aperture and, in concert with other plant signaling compounds, is implicated in mediating responses to pathogens and wounding or oxidative damage (for example, see Larkindale et al. (2002) *Plant Physiol.* 128: 682-695). In seeds, ABA promotes seed development, embryo maturation, synthesis of storage products (proteins and lipids), desiccation tolerance, and is involved in maintenance of dormancy (inhibition of germination), and apoptosis (Zeevaart et al. (1988) *Ann Rev Plant Physiol. Plant Mol. Biol.* 49: 439-473; Davies (1991), supra; Thomas (1993) *Plant Cell* 5: 1401-1410; and Bethke et al. (1999) *Plant Cell* 11: 1033-1046). ABA also affects plant architecture, including root growth and morphology and root-to-shoot ratios. ABA action and metabolism is modulated not only by environmental signals but also by endogenous signals generated by metabolic feedback, transport, hormonal cross-talk and developmental stage. Manipulation of ABA levels, and hence by extension the sensitivity to ABA, has been described as a very promising means to improve productivity, performance and architecture in plants Zeevaart (1999) in: Biochemistry and Molecular Biology of Plant Hormones, Hooykaas et al. eds, Elsevier Science pp 189-207; and Cutler et al. (1999) *Trends Plant Sci.* 4: 472-478).

A number of the presently disclosed transcription factor genes affect plant abscisic acid (ABA) sensitivity, including G546, G926, 1069, G1357, G1452, G1820, G2140, G2789. Thus, by affecting ABA sensitivity, these introduced transcription factor genes and their equivalogs would affect cold, drought, oxidative and other stress sensitivities, plant architecture, and yield.

Several other of the present transcription factor genes have been used to manipulate ethylene signal transduction and response pathways. These genes can thus be used to manipulate the processes influenced by ethylene, such as seed germination or fruit ripening, and to improve seed or fruit quality.

Diseases, pathogens and pests. A number of the presently disclosed transcription factor genes have been shown to or are likely to affect a plants response to various plant diseases, pathogens and pests. The offending organisms include fungal pathogens *Fusarium oxysporum, Botrytis cinerea, Sclerotinia sclerotiorum,* and *Erysiphe orontii.* Bacterial pathogens to which resistance may be conferred include *Pseudomonas syringae.* Other problem organisms may potentially include nematodes, mollicutes, parasites, or herbivorous arthropods. In each case, one or more transformed transcription factor genes may provide some benefit to the plant to help prevent or overcome infestation, or be used to manipulate any of the various plant responses to disease. These mechanisms by which the transcription factors work could include increasing surface waxes or oils, surface thickness, or the activation of signal transduction pathways that regulate plant defense in response to attacks by herbivorous pests (including, for example, protease inhibitors). Another means to combat fungal and other pathogens is by accelerating local cell death or senescence, mechanisms used to impair the spread of pathogenic microorganisms throughout a plant. For instance, the best known example of accelerated cell death is the resistance gene-mediated hypersensitive response, which causes localized cell death at an infection site and initiates a systemic defense response. Because many defenses, signaling molecules, and signal transduction pathways are common to defense against different pathogens and pests, such as fungal, bacterial, oomycete, nematode, and insect, transcription factors that are implicated in defense responses against the fungal pathogens tested may also function in defense against other pathogens and pests. These transcription factors include, for example, G28, G1792, G1880, G1919, G1950 (improved resistance or tolerance to *Botrytis*), G1047, G1792 (improved resistance or tolerance to *Fusarium*), G19, G28, G409, G1266, G1363, G1792 (improved resistance or tolerance to *Erysiphe*), G545 (improved resistance or tolerance to *Pseudomonas*), G28, G1927 (improved resistance or tolerance to *Sclerotinia*), and their equivalogs.

Growth regulator: sugar sensing. In addition to their important role as an energy source and structural component of the plant cell, sugars are central regulatory molecules that control several aspects of plant physiology, metabolism and development (Hsieh et al. (1998) *Proc. Natl. Acad. Sci.* 95: 13965-13970). It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence. The mechanisms by which sugars control gene expression are not understood.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, the presently disclosed transcription factor genes that manipulate the sugar signal transduction pathway, including G241, G254, G567, G680, G912, G1804, G481, G867, G1225, along with their equivalogs, may lead to altered gene expression to produce plants with desirable traits. In particular, manipulation of sugar signal transduction pathways could be used to alter source-sink relationships in seeds, tubers, roots and other storage organs leading to increase in yield.

Growth regulator: C/N sensing. Nitrogen and carbon metabolism are tightly linked in almost every biochemical pathway in the plant. Carbon metabolites regulate genes involved in N acquisition and metabolism, and are known to affect germination and the expression of photosynthetic genes (Coruzzi et al. (2001) *Plant Physiol.* 125: 61-64) and hence growth. Early studies on nitrate reductase (R) in 1976 showed that NR activity could be affected by Glc/Suc (Crawford (1995) *Plant Cell* 7: 859-886; Daniel-Vedele et al. (1996) *CR Acad Sci Paris* 319: 961-968). Those observations were supported by later experiments that showed sugars induce NR mRNA in dark-adapted, green seedlings (Cheng C L, et al. (1992) *Proc Natl Acad Sci USA* 89: 1861-1864). C and N may have antagonistic relationships as signaling molecules; light induction of NR activity and mRNA levels can be mimicked by C metabolites and N-metabolites cause repression of NR induction in tobacco (Vincentz et al. (1992) *Plant J* 3: 315-324). Gene regulation by C/N status has been demonstrated for a number of N-metabolic genes (Stitt (1999) *Curr. Opin. Plant. Biol.* 2: 178-186); Coruzzi et al. (2001) supra). Thus, transcription factor genes that affect C/N sensing, such as G1816, can be used to alter or improve germination and growth under nitrogen-limiting conditions.

Flowering time: early and late flowering. Presently disclosed transcription factor genes that accelerate flowering, which include G157, G180, G183, G485, G490, G590, G789, G1225, G1494, G1820, G1841, G1842, G1843, G1946, G2010, G2144, G2295, G2347, G2509, and their functional equivalogs, could have valuable applications in such programs, since they allow much faster generation times. In a number of species, for example, broccoli, cauliflower, where the reproductive parts of the plants constitute the crop and the vegetative tissues are discarded, it would be advantageous to accelerate time to flowering. Accelerating flowering could shorten crop and tree breeding programs. Additionally, in some instances, a faster generation time would allow additional harvests of a crop to be made within a given growing season. A number of *Arabidopsis* genes have already been shown to accelerate flowering when constitutively expressed.

These include LEAFY, APETALA1 and CONSTANS (Mandel et al. (1995) *Nature* 377: 522-524; Weigel and Nilsson (1995) *Nature* 377:et al. 495-500; Simon et al. (1996) *Nature* 384: 59-62).

By regulating the expression of potential flowering using inducible promoters, flowering could be triggered by application of an inducer chemical. This would allow flowering to be synchronized across a crop and facilitate more efficient harvesting. Such inducible systems could also be used to tune the flowering of crop varieties to different latitudes. At present, species such as soybean and cotton are available as a series of maturity groups that are suitable for different latitudes on the basis of their flowering time (which is governed by day-length). A system in which flowering could be chemically controlled would allow a single high-yielding northern maturity group to be grown at any latitude. In southern regions such plants could be grown for longer periods before flowering was induced, thereby increasing yields. In more northern areas, the induction would be used to ensure that the crop flowers prior to the first winter frosts.

In a sizeable number of species, for example, root crops, where the vegetative parts of the plants constitute the crop and the reproductive tissues are discarded, it is advantageous to identify and incorporate transcription factor genes that delay or prevent flowering in order to prevent resources being diverted into reproductive development. For example, G8, G47, G157, G192, G214, G231; G361, G362, G562, G736, G748, G859, G910, G913, G971, G1051, G1052, G1357, G1452, G1478, G1804, G1895, G1945, G2007, G2133, G2155, G2838 and equivalogs, delay flowering time in transgenic plants. Extending vegetative development with presently disclosed transcription factor genes could thus bring about large increases in yields. Prevention of flowering can help maximize vegetative yields and prevent escape of genetically modified organism (GMO) pollen.

Presently disclosed transcription factors that extend flowering time have utility in engineering plants with longer-lasting flowers for the horticulture industry, and for extending the time in which the plant is fertile.

A number of the presently disclosed transcription factors may extend flowering time, and delay flower abscission, which would have utility in engineering plants with longer-lasting flowers for the horticulture industry. This would provide a significant benefit to the ornamental industry, for both cut flowers and woody plant varieties (of, for example, maize), as well as have the potential to lengthen the fertile period of a plant, which could positively impact yield and breeding programs.

General development and morphology: flower structure and inflorescence: architecture, altered flower organs, reduced fertility, multiple alterations, aerial rosettes, branching, internode distance, terminal flowers and phase change. Presently disclosed transgenic transcription factors such as G353; G354, G638; G779; G988; G1063; G1075; G1140; G1449; G1499; G2143; G2557, G2838, G2839 and their equivalogs, may be used to create plants with larger flowers or arrangements of flowers that are distinct from wild-type or non-transformed cultivars. This would likely have the most value for the ornamental horticulture industry, where larger flowers or interesting floral configurations are generally preferred and command the highest prices.

Flower structure may have advantageous or deleterious effects on fertility, and could be used, for example, to decrease fertility by the absence, reduction or screening of reproductive components. In fact, plants that overexpress a sizable number of the presently disclosed transcription factor genes e.g., G470, G779, G988, G1075, G1140, G1499, G1947, G2143, G2557 and their functional equivalogs, possess reduced fertility; flowers are infertile and fail to yield seed. These could be desirable traits, as low fertility could be exploited to prevent or minimize the escape of the pollen of genetically modified organisms (GMOs) into the environment.

The alterations in shoot architecture seen in the lines transformed with G47, G1063, G1645, G2143, and their functional equivalogs indicates that these genes and their equivalogs can be used to manipulate inflorescence branching patterns. This could influence yield and offer the potential for more effective harvesting techniques. For example, a "self pruning" mutation of tomato results in a determinate growth pattern and facilitates mechanical harvesting (Pnueli et al. (2001) *Plant Cell* 13(12): 2687-702).

One interesting application for manipulation of flower structure, for example, by introduced transcription factors could be in the increased production of edible flowers or flower parts, including saffron, which is derived from the stigmas of *Crocus sativus*.

Genes that later silique conformation in brassicates may be used to modify fruit ripening processes in brassicates and other plants, which may positively affect seed or fruit quality.

A number of the presently disclosed transcription factors may affect the timing of phase changes in plants. Since the timing or phase changes generally affects a plant's eventual size, these genes may prove beneficial by providing means for improving yield and biomass.

General development and morphology: shoot meristem and branching patterns. Several of the presently disclosed transcription factor genes, including G390 and G391, and G1794, when introduced into plants, have been shown to cause stem bifurcations in developing shoots in which the shoot meristems split to form two or three separate shoots. These transcription factors and their functional equivalogs may thus be used to manipulate branching. This would provide a unique appearance, which may be desirable in ornamental applications, and may be used to modify lateral branching for use in the forestry industry. A reduction in the formation of lateral branches could reduce knot formation. Conversely, increasing the number of lateral branches could provide utility when a plant is used as a view- or windscreen.

General development and morphology: apical dominance: The modified expression of presently disclosed transcription factors (e.g., G47, G211, G1255, G1275, G1411, G1488, G1794, G2509 and their equivalogs) that reduce apical dominance could be used in ornamental horticulture, for example, to modify plant architecture, for example, to produce a shorter, more bushy stature than wild type. The latter form would have ornamental utility as well as provide increased resistance to lodging.

General development and morphology: trichome density, development or structure. Several of the presently disclosed transcription factor genes have been used to modify trichome number, density, trichome cell fate, amount of trichome products produced by plants, or produce ectopic trichome formation. These include G225; G226, G247; G362, G370; G585, G634, G676, G682, G1332, G1452, G1995, G2826, and G2838. In most cases where the metabolic pathways are impossible to engineer, increasing trichome density or size on leaves may be the only way to increase plant productivity. Thus, by increasing trichome density, size or type, these trichome-affecting genes and their functional equivalogs would have profound utilities in molecular farming practices by making use of trichomes as a manufacturing system for complex secondary metabolites.

Trichome glands on the surface of many higher plants produce and secrete exudates that give protection from the elements and pests such as insects, microbes and herbivores. These exudates may physically immobilize insects and spores, may be insecticidal or ant-microbial or they may act as allergens or irritants to protect against herbivores. By modifying trichome location, density or activity with presently disclosed transcription factors that modify these plant characteristics, plants that are better protected and higher yielding may be the result.

A potential application for these trichome-affecting genes and their equivalogs also exists in cotton: cotton fibers are modified unicellular trichomes that develop from the outer ovule epidermis. In fact, only about 30% of these epidermal cells develop into trichomes, but all have the potential to develop a trichome fate. Trichome-affecting genes can trigger an increased number of these cells to develop as trichomes and thereby increase the yield of cotton fibers. Since the mallow family is closely related to the Brassica family, genes involved in trichome formation will likely have homologs in cotton or function in cotton.

If the effects on trichome patterning reflect a general change in heterochronic processes, trichome-affecting transcription factors or their equivalogs can be used to modify the way meristems and/or cells develop during different phases of the plant life cycle. In particular, altering the timing of phase changes could afford positive effects on yield and biomass production.

General development and morphology: stem morphology and altered vascular tissue structure. Plants transformed with transcription factor genes that modify stem morphology or lignin content may be used to affect overall plant architecture and the distribution of lignified fiber cells within the stem.

Modulating lignin content might allow the quality of wood used for furniture or construction to be improved. Lignin is energy rich; increasing lignin composition could therefore be valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production (Tzfira et al. (1998) *TIBTECH* 16: 439-446; Robinson (1999) *Nature Biotechnology* 17: 27-30). In addition to forest biotechnology applications, changing lignin content by selectively expressing or repressing transcription factors in fruits and vegetables might increase their palatability.

Transcription factors that modify stem structure, including G47, G438, G748, G988, G1488 and their equivalogs, may also be used to achieve reduction of higher-order shoot development, resulting in significant plant architecture modification. Overexpression of the genes that encode these transcription factors in woody plants might result in trees that lack side branches, and have fewer knots in the wood. Altering branching patterns could also have applications amongst ornamental and agricultural crops. For example, applications might exist in any species where secondary shoots currently have to be removed manually, or where changes in branching pattern could increase yield or facilitate more efficient harvesting.

General development and morphology: altered root development. By modifying the structure or development of roots by transforming into a plant one or more of the presently disclosed transcription factor genes, including G225, G226, G1482, and their equivalogs, plants may be produced that have the capacity to thrive in otherwise unproductive soils. For example, grape roots extending further into rocky soils would provide greater anchorage, greater coverage with increased branching, or would remain viable in waterlogged soils, thus increasing the effective planting range of the crop and/or increasing yield and survival. It may be advantageous to manipulate a plant to produce short roots, as when a soil in which the plant will be growing is occasionally flooded, or when pathogenic fungi or disease-causing nematodes are prevalent.

General development and morphology: seed development, ripening and germination rate. A number of the presently disclosed transcription factor genes (e.g., G979) have been shown to modify seed development and germination rate, including when the seeds are in conditions normally unfavorable for germination (e.g., cold, heat or salt stress, or in the presence of ABA), and may, along with functional equivalogs, thus be used to modify and improve germination rates under adverse conditions.

General development and morphology: cell differentiation and cell proliferation. Several of the disclosed transcription factors regulate cell proliferation and/or differentiation, including G1540 and its functional equivalogs. Control of these processes could have valuable applications in plant transformation, cell culture or micro-propagation systems, as well as in control of the proliferation of particular useful tissues or cell types. Transcription factors that induce the proliferation of undifferentiated cells can be operably linked with an inducible promoter to promote the formation of callus that can be used for transformation or production of cell suspension cultures. Transcription factors that prevent cells from differentiating, such as G1540 or its equivalogs, could be used to confer stem cell identity to cultured cells. Transcription factors that promote differentiation of shoots could be used in transformation or micro-propagation systems, where regeneration of shoots from callus is currently problematic. In addition, transcription factors that regulate the differentiation of specific tissues could be used to increase the proportion of these tissues in a plant. Genes that promote the differentiation of carpel tissue could be introduced into commercial species to induce formation of increased numbers of carpels or fruits. A particular application might exist in saffron, one of the world's most expensive spices. Saffron filaments, or threads, are actually the dried stigmas of the saffron flower, *Crocus sativus* Linneaus. Each flower contains only three stigmas, and more than 75,000 of these flowers are needed to produce just one pound of saffron filaments. An increase in carpel number would increase the quantity of stigmatic tissue and improve yield.

General development and morphology: cell expansion. Plant growth results from a combination of cell division and cell expansion. Transcription factors may be useful in regulation of cell expansion. Altered regulation of cell expansion could affect stem length, an important agronomic characteristic. For instance, short cultivars of wheat contributed to the Green Revolution, because plants that put fewer resources into stem elongation allocate more resources into developing seed and produce higher yield. These plants are also less vulnerable to wind and rain damage. These cultivars were found to be altered in their sensitivity to gibberellins, hormones that regulate stem elongation through control of both cell expansion and cell division. Altered cell expansion in leaves could also produce novel and ornamental plant forms.

General development and morphology: phase change and floral reversion. Transcription factors that regulate phase change can modulate the developmental programs of plants and regulate developmental plasticity of the shoot meristem. In particular, these genes might be used to manipulate seasonality and influence whether plants display an annual or perennial habit.

General development and morphology: rapid development. A number of the presently disclosed transcription factor genes, including G2430, have been shown to have significant effects on plant growth rate and development. These observations have included, for example, more rapid or delayed growth and development of reproductive organs. Thus, by causing more rapid development, G2430 and its functional equivalogs would prove useful for regions with short growing seasons; other transcription factors that delay development may be useful for regions with longer growing seasons. Accelerating plant growth would also improve early yield or increase biomass at an earlier stage, when such is desirable (for example, in producing forestry products or vegetable sprouts for consumption). Transcription factors that promote faster development such as G2430 and its functional equivalogs may also be used to modify the reproductive cycle of plants.

General development and morphology: slow growth rate. A number of the presently disclosed transcription factor genes, including G652 and G1335, have been shown to have significant effects on retarding plant growth rate and development. These observations have included, for example, delayed growth and development of reproductive organs. Slow growing plants may be highly desirable to ornamental horticulturists, both for providing house plants that display little change in their appearance over time, or outdoor plants for which wild-type or rapid growth is undesirable (e.g., ornamental palm trees). Slow growth may also provide for a prolonged fruiting period, thus extending the harvesting season, particularly in regions with long growing seasons. Slow growth could also provide a prolonged period in which pollen is available for improved self- or cross-fertilization, or cross-fertilization of cultivars that normally flower over non-overlapping time periods. The latter aspect may be particularly useful to plants comprising two or more distinct grafted cultivars (e.g., fruit trees) with normally non-overlapping flowering periods.

General development and morphology: senescence. Presently disclosed transcription factor genes may be used to alter senescence responses in plants. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. In an experimental setting, tobacco plants engineered to inhibit leaf senescence had a longer photosynthetic lifespan, and produced a 50% increase in dry weight and seed yield (Gan and Amasino (1995) *Science* 270: 1986-1988). Delayed flower senescence caused by overexpression of transcription factors may generate plants that retain their blossoms longer and this may be of potential interest to the ornamental horticulture industry, and delayed foliar and fruit senescence could improve post-harvest shelf-life of produce.

Premature senescence caused by, for example, G636, G1463, G1944 and their equivalogs may be used to improve a plant's response to disease and hasten fruit ripening.

Growth rate and development: lethality and necrosis. Overexpression of transcription factors, for example, G12, G24, G877, G1519 and their equivalogs that have a role in regulating cell death may be used to induce lethality in specific tissues or necrosis in response to pathogen attack. For example, if a transcription factor gene inducing lethality or necrosis was specifically active in gametes or reproductive organs, its expression in these tissues would lead to ablation and subsequent male or female sterility. Alternatively, under pathogen-regulated expression, a necrosis-inducing transcription factor can restrict the spread of a pathogen infection through a plant.

Plant size: large plants. Plants overexpressing G1073 and G1451, for example, have been shown to be larger than controls. For some ornamental plants, the ability to provide larger varieties with these genes or their equivalogs may be highly desirable. For many plants, including fruit-bearing trees, trees that are used for lumber production, or trees and shrubs that serve as view or wind screens, increased stature provides improved benefits in the forms of greater yield or improved screening. Crop species may also produce higher yields on larger cultivars, particularly those in which the vegetative portion of the plant is edible.

Plant size: large seedlings. Presently disclosed transcription factor genes, that produce large seedlings can be used to produce crops that become established faster. Large seedlings are generally hardier, less vulnerable to stress, and better able to out-compete weed species. Seedlings transformed with presently disclosed transcription factors, including G2346 and G2838, for example, have been shown to possess larger cotyledons and were more developmentally advanced than control plants. Rapid seedling development made possible by manipulating expression of these genes or their equivalogs is likely to reduce loss due to diseases particularly prevalent at the seedling stage (e.g., damping off) and is thus important for survivability of plants germinating in the field or in controlled environments.

Plant size: dwarfed plants. Presently disclosed transcription factor genes, including G24; G343, G353, G354, G362, G370; G1008, G1277, G1543, G1794, G1958 and their equivalogs, for example, that can be used to decrease plant stature are likely to produce plants that are more resistant to damage by wind and rain, have improved lodging resistance, or more resistant to heat or low humidity or water deficit. Dwarf plants are also of significant interest to the ornamental horticulture industry, and particularly for home garden applications for which space availability may be limited.

Plant size: fruit size and number. Introduction of presently disclosed transcription factor genes that affect fruit size will have desirable impacts on fruit size and number, which may comprise increases in yield for fruit crops, or reduced fruit yield, such as when vegetative growth is preferred (e.g., with bushy ornamentals, or where fruit is undesirable, as with ornamental olive trees).

Leaf morphology: dark leaves. Color-affecting components in leaves include chlorophylls (generally green), anthocyanins (generally red to blue) and carotenoids (generally yellow to red). Transcription factor genes that increase these pigments in leaves, including G674, G912, G1063, G1357, G1452, G1482, G1499, G1792, G1863, G1888, G2143, G2557, G2838 and their equivalogs, may positively affect a plant's value to the ornamental horticulture industry. Variegated varieties, in particular, would show improved contrast. Other uses that result from overexpression of transcription factor genes include improvements in the nutritional value of foodstuffs. For example, lutein is an important nutraceutical; lutein-rich diets have been shown to help prevent age-related macular degeneration (ARMD), the leading cause of blindness in elderly people. Consumption of dark green leafy vegetables has been shown in clinical studies to reduce the risk of ARMD.

Enhanced chlorophyll and carotenoid levels could also improve yield in crop plants. Lutein, like other xanthophylls such as zeaxanthin and violaxanthin, is an essential component in the protection of the plant against the damaging effects of excessive light. Specifically, lutein contributes, directly or indirectly, to the rapid rise of non-photochemical quenching in plants exposed to high light. Crop plants engineered to contain higher levels of lutein could therefore have improved photo-protection, leading to less oxidative damage and better growth under high light (e.g., during long summer days, or at higher altitudes or lower latitudes than those at which a non-transformed plant would survive). Additionally, elevated chlorophyll levels increases photosynthetic capacity.

Leaf morphology: changes in leaf shape. Presently disclosed transcription factors produce marked and diverse effects on leaf development and shape. The transcription factors include G211, G353, G674, G736, G1063, G1146, G1357, G1452, G1494, G1543, G1863, G2143, G2144, and their equivalogs. At early stages of growth, transgenic seedlings have developed narrow, upward pointing leaves with long petioles, possibly indicating a disruption in circadian-clock controlled processes or nyctinastic movements. Other transcription factor genes can be used to alter leaf shape in a significant manner from wild type, some of which may find use in ornamental applications.

Leaf morphology: altered leaf size. Large leaves, such as those produced in plants overexpressing G189, G1451, G2430 and their functional equivalogs, generally increase plant biomass. This provides benefit for crops where the vegetative portion of the plant is the marketable portion.

Leaf morphology: light green and variegated leaves. Transcription factor genes such as G635, G1494, G2144 and their equivalogs that provide an altered appearance may positively affect a plant's value to the ornamental horticulture industry.

Leaf morphology: glossy leaves. Transcription factor genes such as G30, G1792, G2583 and their equivalogs that induce the formation of glossy leaves generally do so by elevating levels of epidermal wax. Thus, the genes could be used to engineer changes in the composition and amount of leaf surface components, including waxes. The ability to manipulate wax composition, amount, or distribution could modify plant tolerance to drought and low humidity, or resistance to insects or pathogens. Additionally, wax may be a valuable commodity in some species, and altering its accumulation and/or composition could enhance yield.

Seed morphology: altered seed coloration. Presently disclosed transcription factor genes, including G156, G2105, G2085 have also been used to modify seed color, which, along with the equivalogs of these genes, could provide added appeal to seeds or seed products.

Seed morphology: altered seed size and shape. The introduction of presently disclosed transcription factor genes into plants that increase (e.g., G450; G584; G1255; G2085; G2105; G2114) or decrease (e.g., G1040). the size of seeds may have a significant impact on yield and appearance, particularly when the product is the seed itself (e.g., in the case of grains, legumes, nuts, etc.). Seed size, in addition to seed coat integrity, thickness and permeability, seed water content and a number of other components including antioxidants and oligosaccharides, also affects affect seed longevity in storage, with larger seeds often being more desirable for prolonged storage.

Transcription factor genes that alter seed shape, including G1040, G1062, G1255 and their equivalogs may have both ornamental applications and improve or broaden the appeal of seed products.

Leaf biochemistry: increased leaf wax. Overexpression of transcription factors genes, including G975, G1792 and G2085 and their equivalogs, which results in increased leaf wax could be used to manipulate wax composition, amount, or distribution. These transcription factors can improve yield in those plants and crops from which wax is a valuable product. The genes may also be used to modify plant tolerance to drought and/or low humidity or resistance to insects, as well as plant appearance (glossy leaves). The effect of increased wax deposition on leaves of a plant like may improve water use efficiency. Manipulation of these genes may reduce the wax coating on sunflower seeds; this wax fouls the oil extraction system during sunflower seed processing for oil. For the latter purpose or any other where wax reduction is valuable, antisense or cosuppression of the transcription factor genes in a tissue-specific manner would be valuable.

Leaf biochemistry: leaf prenyl lipids, including tocopherol. Prenyl lipids play a role in anchoring proteins in membranes or membranous organelles. Thus modifying the prenyl lipid content of seeds and leaves could affect membrane integrity and function. One important group of prenyl lipids, the tocopherols, have both anti-oxidant and vitamin E activity. A number of presently disclosed transcription factor genes, including G214, G652, G748, G987, G1543, and G2509, have been shown to modify the tocopherol composition of leaves in plants, and these genes and their equivalogs may thus be used to alter prenyl lipid content of leaves.

Leaf biochemistry: increased leaf insoluble sugars. Overexpression of a number of presently disclosed transcription factors, including G211, resulted in plants with altered leaf insoluble sugar content. This transcription factor and its equivalogs that alter plant cell wall composition have several potential applications including altering food digestibility, plant tensile strength, wood quality, pathogen resistance and in pulp production. In particular, hemicellulose is not desirable in paper pulps because of its lack of strength compared with cellulose. Thus modulating the amounts of cellulose vs. hemicellulose in the plant cell wall is desirable for the paper/lumber industry. Increasing the insoluble carbohydrate content in various fruits, vegetables, and other edible consumer products will result in enhanced fiber content. Increased fiber content would not only provide health benefits in food products, but might also increase digestibility of forage crops. In addition, the hemicellulose and pectin content of fruits and berries affects the quality of jam and catsup made from them. Changes in hemicellulose and pectin content could result in a superior consumer product.

Leaf biochemistry: increased leaf anthocyanin. Several presently disclosed transcription factor genes may be used to alter anthocyanin production in numerous plant species. Expression of presently disclosed transcription factor genes that increase flavonoid production in plants, including anthocyanins and condensed tannins, may be used to alter in pigment production for horticultural purposes, and possibly increasing stress resistance. G362, G663, G1482 and G1888 or their equivalogs, for example, could be used to alter anthocyanin production or accumulation. A number of flavonoids have been shown to have antimicrobial activity and could be used to engineer pathogen resistance. Several flavonoid compounds have health promoting effects such as inhibition of tumor growth, prevention of bone loss and prevention of the oxidation of lipids. Increased levels of condensed tannins, in forage legumes would be an important agronomic trait because they prevent pasture bloat by collapsing protein foams within the rumen. For a review on the utilities of flavonoids and their derivatives, refer to Dixon et al. (1999) *Trends Plant Sci.* 4: 394-400.

Leaf and seed biochemistry: altered fatty acid content. A number of the presently disclosed transcription factor genes have been shown to alter the fatty acid composition in plants, and seeds and leaves in particular. This modification suggests several utilities, including improving the nutritional value of seeds or whole plants. Dietary fatty acids ratios have been shown to have an effect on, for example, bone integrity and remodeling (see, for example, Weiler (2000) *Pediatr. Res.* 47:5 692-697). The ratio of dietary fatty acids may alter the precursor pools of long-chain polyunsaturated fatty acids that serve as precursors for prostaglandin synthesis. In mammalian connective tissue, prostaglandins serve as important signals regulating the balance between resorption and formation in bone and cartilage. Thus dietary fatty acid ratios altered in seeds may affect the etiology and outcome of bone loss.

Transcription factors that reduce leaf fatty acids, for example, 16:3 fatty acids, may be used to control thylakoid membrane development, including proplastid to chloroplast development. The genes that encode these transcription factors might thus be useful for controlling the transition from proplastid to chromoplast in fruits and vegetables. It may also be desirable to change the expression of these genes to prevent cotyledon greening in *Brassica napus* or *B. campestris* to avoid green oil due to early frost.

A number of transcription factor genes are involved in mediating an aspect of the regulatory response to temperature. These genes may be used to alter the expression of desaturases that lead to production of 18:3 and 16:3 fatty acids, the balance of which affects membrane fluidity and mitigates damage to cell membranes and photosynthetic structures at high and low temperatures.

Seed biochemistry: modified seed oil and fatty acid content. The composition of seeds, particularly with respect to seed oil amounts and/or composition, is very important for the nutritional and caloric value and production of various food and feed products. Several of the presently disclosed transcription factor genes in seed lipid saturation that alter seed oil content could be used to improve the heat stability of oils or to improve the nutritional quality of seed oil, by, for example, reducing the number of calories in seed by decreasing oil or fatty acid content (e.g., G180; G192; G241; G1229; G1323; G1543), increasing the number of calories in animal feeds by increasing oil or fatty acid content (e.g. G162; G291; G427; G590; G598; G629, G715; G849; G1198, G1471; G1526; G1640; G1646, G1750; G1777; G1793; G1838; G1902; G1946; G1948; G2123; G2138; G2830), altering seed oil content (G504; G509; G519; G561; G567; G892; G961; G974; G1143; G1226; G1451; G1478; G1496; G1672; G1677; G1765; G2509; G2343), or altering the ratio of saturated to unsaturated lipids comprising the oils (e.g. G869; G1417; G2192).

Seed biochemistry: modified seed protein content. As with seed oils, the composition of seeds, particularly with respect to protein amounts and/or composition, is very important for the nutritional value and production of various food and feed products. A number of the presently disclosed transcription factor genes modify the protein concentrations in seeds, including G162; G226; G1323; G1419; G1818, which increase seed protein, G427; G1777; G1903; G1946, which decrease seed protein, and G162; G241; G509; G567; G597; G849; G892; G988; G1478; G1634; G1637; G1652; G1677; G1820; G1958; G2509; G2117; G2509, which alter seed protein content, would provide nutritional benefits, and may be used to prolong storage, increase seed pest or disease resistance, or modify germination rates.

Seed biochemistry: seed prenyl lipids. Prenyl lipids play a role in anchoring proteins in membranes or membranous organelles. Thus, modifying the prenyl lipid content of seeds and leaves could affect membrane integrity and function. A number of presently disclosed transcription factor genes have been shown to modify the tocopherol composition of plants. α-Tocopherol is better known as vitamin E. Tocopherols such as α- and γ-tocopherol both have anti-oxidant activity.

Seed biochemistry: seed glucosinolates. A number of glucosinolates have been shown to have anti-cancer activity; thus, increasing the levels or composition of these compounds by introducing several of the presently disclosed transcription factors, including G484 and G2340, can have a beneficial effect on human diet.

Glucosinolates are undesirable components of the oilseeds used in animal feed since they produce toxic effects. Low-glucosinolate varieties of canola, for example, have been developed to combat this problem. Glucosinolates form part of a plant's natural defense against insects. Modification of glucosinolate composition or quantity by introducing transcription factors that affect these characteristics can therefore afford increased protection from herbivores. Furthermore, in edible crops, tissue specific promoters can be used to ensure that these compounds accumulate specifically in tissues, such as the epidermis, which are not taken for consumption.

Seed biochemistry: increased seed anthocyanin. Several presently disclosed transcription factor genes may be used to alter anthocyanin production in the seeds of plants. As with leaf anthocyanins, expression of presently disclosed transcription factor genes that increase flavonoid (anthocyanins and condensed tannins) production in seeds, including G663 and its equivalogs, may be used to alter in pigment production for horticultural purposes, and possibly increasing stress resistance, antimicrobial activity and health promoting effects such as inhibition of tumor growth, prevention of bone loss and prevention of the oxidation of lipids.

Leaf and seed biochemistry: production of seed and leaf phytosterols: Presently disclosed transcription factor genes that modify levels of phytosterols in plants may have at least two utilities. First, phytosterols are an important source of precursors for the manufacture of human steroid hormones. Thus, regulation of transcription factor expression or activity could lead to elevated levels of important human steroid precursors for steroid semi-synthesis. For example, transcription factors that cause elevated levels of campesterol in leaves, or sitosterols and stigmasterols in seed crops, would be useful for this purpose. Phytosterols and their hydrogenated derivatives phytostanols also have proven cholesterol-lowering properties, and transcription factor genes that modify the expression of these compounds in plants would thus provide health benefits.

Root biochemistry: increased root anthocyanin. Presently disclosed transcription factor genes, including G663, may be used to alter anthocyanin production in the root of plants. As described above for seed anthocyanins, expression of presently disclosed transcription factor genes that increase flavonoid (anthocyanins and condensed tannins) production in seeds, including G663 and its equivalogs, may be used to alter in pigment production for horticultural purposes, and possibly increasing stress resistance, antimicrobial activity and health promoting effects such as inhibition of tumor growth, prevention of bone loss and prevention of the oxidation of lipids.

Light response/shade avoidance: altered cotyledon, hypocotyl, petiole development, altered leaf orientation, constitutive photomorphogenesis, photomorphogenesis in low light. Presently disclosed transcription factor genes, including G183; G354; G1322; G1331; G1488; G1494; G1794; G2144; and G2555, that modify a plant's response to light may be useful for modifying plant growth or development, for example, photomorphogenesis in poor light, or accelerating flowering time in response to various light intensities, quality or duration to which a non-transformed plant would not similarly respond. Examples of such responses that have been demonstrated include leaf number and arrangement, and early flower bud appearances. Elimination of shading responses may lead to increased planting densities with subsequent yield enhancement. As these genes may also alter plant architecture, they may find use in the ornamental horticulture industry.

Pigment: increased anthocyanin level in various plant organs and tissues. In addition to seed, leaves and roots, as mentioned above, several presently disclosed transcription factor genes can be used to alter anthocyanin levels in one or more tissues. The potential utilities of these genes include alterations in pigment production for horticultural purposes, and possibly increasing stress resistance, antimicrobial activity and health promoting effects such as inhibition of tumor growth, prevention of bone loss and prevention of the oxidation of lipids.

Miscellaneous biochemistry: diterpenes in leaves and other plant parts. Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. Thus, the overexpression of genes that are used to produce diterpenes in plants may be accomplished by introducing transcription factor genes that induce said overexpression. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Miscellaneous biochemistry: production of miscellaneous secondary metabolites. Microarray data suggests that flux through the aromatic amino acid biosynthetic pathways and primary and secondary metabolite biosynthetic pathways are up-regulated. Presently disclosed transcription factors have been shown to be involved in regulating alkaloid biosynthesis, in part by up-regulating the enzymes indole-3-glycerol phosphatase and strictosidine synthase. Phenylalanine ammonia lyase, chalcone synthase and trans-cinnamate mono-oxygenase are also induced, and are involved in phenylpropenoid biosynthesis.

Antisense and Co-Suppression

In addition to expression of the nucleic acids of the invention as gene replacement or plant phenotype modification nucleic acids, the nucleic acids are also useful for sense and anti-sense suppression of expression, e.g., to down-regulate expression of a nucleic acid of the invention, e.g., as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g., as set forth in Lichtenstein and Nellen (1997) *Antisense Technology: A Practical Approach* IRL Press at Oxford University Press, Oxford, U.K. Antisense regulation is also described in Crowley et al. (1985) *Cell* 43: 633-641; Rosenberg et al. (1985) *Nature* 313: 703-706; Preiss et al. (1985) *Nature* 313: 27-32; Melton (1985) *Proc. Natl. Acad. Sci.* 82: 144-148; Izant and Weintraub (1985) *Science* 229: 345-352; and Kim and Wold (1985) *Cell* 42: 129-138. Additional methods for antisense regulation are known in the art. Antisense regulation has been used to reduce or inhibit expression of plant genes in, for example in European Patent Publication No. 271988. Antisense RNA may be used to reduce gene expression to produce a visible or biochemical phenotypic change in a plant (Smith et al. (1988) *Nature,* 334: 724-726; Smith et al. (1990) *Plant Mol. Biol.* 14: 369-379). In general, sense or anti-sense sequences are introduced into a cell, where they are optionally amplified, e.g., by transcription. Such sequences include both simple oligonucleotide sequences and catalytic sequences such as ribozymes.

For example, a reduction or elimination of expression (i.e., a "knock-out") of a transcription factor or transcription factor homolog polypeptide in a transgenic plant, e.g., to modify a plant trait, can be obtained by introducing an antisense construct corresponding to the polypeptide of interest as a cDNA. For antisense suppression, the transcription factor or homolog cDNA is arranged in reverse orientation (with respect to the coding sequence) relative to the promoter sequence in the expression vector. The introduced sequence need not be the full length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using a ribozyme. Ribozymes are RNA molecules that possess highly specific endoribonuclease activity. The production and use of ribozymes are disclosed in U.S. Pat. No. 4,987,071 and U.S. Pat. No. 5,543,508. Synthetic ribozyme sequences including antisense RNAs can be used to confer RNA cleaving activity on the antisense RNA, such that endogenous mRNA molecules that hybridize to the antisense RNA are cleaved, which in turn leads to an enhanced antisense inhibition of endogenous gene expression.

Vectors in which RNA encoded by a transcription factor or transcription factor homolog cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating its activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999) *Genes and Development* 13: 139-141). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homolog gene. Plants containing a single transgene insertion event at the desired gene can be crossed to generate homozygous plants for the mutation. Such methods are well known to those of skill in the art (See for example Koncz et al. (1992) *Methods in Arabidopsis Research*, World Scientific Publishing Co. Pte. Ltd., River Edge, N.J.).

Alternatively, a plant phenotype can be altered by eliminating an endogenous gene, such as a transcription factor or transcription factor homolog, e.g., by homologous recombination (Kempin et al. (1997) *Nature* 389: 802-803).

A plant trait can also be modified by using the Cre-lox system (for example, as described in U.S. Pat. No. 5,658,772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means, such as, for example, by ectopically expressing a gene by T-DNA activation tagging (Ichikawa et al. (1997) *Nature* 390 698-701; Kakimoto et al. (1996) *Science* 274: 982-985). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (See, e.g., PCT Publications WO 96/06166 and WO 98/53057 which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homolog, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledenous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al., Eds., (1984) Handbook of Plant Cell Culture—Crop Species, Macmillan Publ. Co., New York, N.Y.; Shimamoto et al. (1989) *Nature* 338: 274-276; Fromm et al. (1990) *Bio/Technol.* 8: 833-839; and Vasil et al. (1990) *Bio/Technol.* 8: 429-434.

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, e.g., a sequence comparison or other alignment program, e.g., an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Palo Alto, Calif.) can be searched.

Alignment of sequences for comparison can be conducted by the local homology algorithm of Smith and Waterman (1981) *Adv. Appl. Math.* 2: 482-489, by the homology alignment algorithm of Needleman and Wunsch (1970) *J. Mol. Biol.* 48: 443-453, by the search for similarity method of Pearson and Lipman (1988) *Proc. Natl. Acad. Sci.* 85: 2444-2448, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel et al. supra.

A variety of methods for determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. (1990) *J. Mol. Biol.* 215: 403-410. Software for performing BLAST analyses is publicly available, e.g., through the National Library of Medicine's National Center for Biotechnology Information (ncbi.nlm.nih; see at world wide web (www) National Institutes of Health US government (gov) website). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al. supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff (1992) *Proc. Natl. Acad. Sci.* 89: 10915-10919). Unless otherwise indicated, "sequence identity" here refers to the % sequence identity generated from a tblastx using the NCBI version of the algorithm at the default settings using gapped alignments with the filter "off" (see, for example, NIH NLM NCBI website at ncbi.nlm.nih, supra).

In addition to calculating percent sequence identity, the BLAST algorithm also performs a statistical analysis of the similarity between two sequences (see, e.g. Karlin and Altschul (1993) *Proc. Natl. Acad. Sci.* 90: 5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element that displays an alignment produced by the alignment instruction set.

The methods of this invention can be implemented in a localized or distributed computing environment. In a distributed environment, the methods may implemented on a single computer comprising multiple processors or on a multiplicity of computers. The computers can be linked, e.g. through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet.

Any sequence herein can be used to identify a similar, homologous, paralogous, or orthologous sequence in another plant. This provides means for identifying endogenous sequences in other plants that may be useful to alter a trait of progeny plants, which results from crossing two plants of different strain. For example, sequences that encode an ortholog of any of the sequences herein that naturally occur in a plant with a desired trait can be identified using the sequences disclosed herein. The plant is then crossed with a second plant of the same species but which does not have the desired trait to produce progeny which can then be used in further crossing experiments to produce the desired trait in the second plant. Therefore the resulting progeny plant contains no transgenes; expression of the endogenous sequence may also be regulated by treatment with a particular chemical or other means, such as EMR. Some examples of such compounds well known in the art include: ethylene; cytokinins; phenolic compounds, which stimulate the transcription of the genes needed for infection; specific monosaccharides and acidic environments which potentiate vir gene induction; acidic polysaccharides which induce one or more chromosomal genes; and opines; other mechanisms include light or dark treatment (for a review of examples of such treatments, see, Winans (1992) *Microbiol. Rev.* 56: 12-31; Eyal et al. (1992) *Plant Mol. Biol.* 19: 589-599; Chrispeels et al. (2000) *Plant Mol. Biol.* 42: 279-290; Piazza et al. (2002) *Plant Physiol.* 128: 1077-1086).

Table 7 lists sequences discovered to be orthologous to a number of representative transcription factors of the present invention. The column headings include the transcription factors listed by SEQ ID NO; corresponding Gene ID (GID) numbers; the species from which the orthologs to the transcription factors are derived; the type of sequence (i.e., DNA or protein) discovered to be orthologous to the transcription factors; and the SEQ ID NO of the orthologs, the latter corresponding to the ortholog SEQ ID NOs listed in the Sequence Listing.

TABLE 7

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 459 | | Glycine max | DNA | G8 | 1 |
| 460 | | Glycine max | DNA | G8 | 1 |
| 461 | | Glycine max | DNA | G8 | 1 |
| 462 | | Glycine max | DNA | G8 | 1 |
| 463 | | Oryza sativa | DNA | G8 | 1 |
| 464 | | Zea mays | DNA | G8 | 1 |
| 465 | | Zea mays | DNA | G8 | 1 |
| 466 | | Zea mays | DNA | G8 | 1 |
| 467 | | Oryza sativa | PRT | G8 | 1 |
| 468 | | Glycine max | DNA | G19 | 3 |
| 469 | | Glycine max | DNA | G19 | 3 |
| 470 | | Glycine max | DNA | G19 | 3 |
| 471 | | Glycine max | DNA | G19 | 3 |
| 472 | | Oryza sativa | DNA | G19 | 3 |
| 473 | | Oryza sativa | DNA | G19 | 3 |
| 474 | | Oryza sativa | DNA | G19 | 3 |
| 475 | | Zea mays | DNA | G19 | 3 |
| 476 | | Zea mays | DNA | G19 | 3 |
| 477 | | Glycine max | DNA | G22 | 5 |
| 478 | | Glycine max | DNA | G22 | 5 |
| 479 | | Glycine max | DNA | G24 | 7 |
| 480 | | Glycine max | DNA | G24 | 7 |
| 481 | | Glycine max | DNA | G24 | 7 |
| 482 | | Glycine max | DNA | G24 | 7 |
| 483 | | Glycine max | DNA | G24 | 7 |
| 484 | | Glycine max | DNA | G24 | 7 |
| 485 | | Glycine max | DNA | G24 | 7 |
| 486 | | Oryza sativa | DNA | G24 | 7 |
| 487 | | Zea mays | DNA | G24 | 7 |
| 488 | | Oryza sativa | PRT | G24 | 7 |
| 489 | | Oryza sativa | PRT | G24 | 7 |
| 490 | | Oryza sativa | PRT | G24 | 7 |
| 491 | | Glycine max | DNA | G28 | 9 |
| 492 | | Glycine max | DNA | G28 | 9 |
| 493 | | Glycine max | DNA | G28 | 9 |
| 494 | | Glycine max | DNA | G28 | 9 |
| 495 | | Glycine max | DNA | G28 | 9 |
| 496 | | Glycine max | DNA | G28 | 9 |
| 497 | | Glycine max | DNA | G28 | 9 |
| 498 | | Glycine max | DNA | G28 | 9 |
| 499 | | Oryza sativa | DNA | G28 | 9 |
| 500 | | Zea mays | DNA | G28 | 9 |
| 501 | | Oryza sativa | PRT | G28 | 9 |
| 502 | | Oryza sativa | PRT | G28 | 9 |
| 503 | | Mesembryanthemum crystallinum | PRT | G28 | 9 |
| 504 | | Glycine max | DNA | G47, G2133 | 11, 407 |
| 505 | | Oryza sativa | PRT | G47, G2133 | 11, 407 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 506 | | *Glycine max* | DNA | G157, G859, G1842, G1843 | 15, 165, 349, 351 |
| 507 | | *Glycine max* | DNA | G175, G877 | 19, 173 |
| 508 | | *Oryza sativa* | DNA | G175, G877 | 19, 173 |
| 509 | | *Zea mays* | DNA | G175, G877 | 19, 173 |
| 510 | | *Zea mays* | DNA | G175, G877 | 19, 173 |
| 511 | | *Zea mays* | DNA | G175, G877 | 19, 173 |
| 512 | | *Oryza sativa* | PRT | G175, G877 | 19, 173 |
| 513 | | *Oryza sativa* | PRT | G175, G877 | 19, 173 |
| 514 | | *Oryza sativa* | PRT | G175, G877 | 19, 173 |
| 515 | | *Nicotiana tabacum* | PRT | G175, G877 | 19, 173 |
| 516 | | *Glycine max* | DNA | G180 | 21 |
| 517 | | *Glycine max* | DNA | G180 | 21 |
| 518 | | *Oryza sativa* | DNA | G180 | 21 |
| 519 | | *Zea mays* | DNA | G180 | 21 |
| 520 | | *Solanum tuberosum* | DNA | G180 | 21 |
| 521 | | *Oryza sativa* | PRT | G180 | 21 |
| 522 | | *Capsella rubella* | PRT | G183 | 23 |
| 523 | | *Glycine max* | DNA | G188 | 25 |
| 524 | | *Zea mays* | DNA | G188 | 25 |
| 525 | | *Oryza sativa* | PRT | G188 | 25 |
| 526 | | *Oryza sativa* | PRT | G188 | 25 |
| 527 | | *Glycine max* | DNA | G189 | 27 |
| 528 | | *Nicotiana tabacum* | PRT | G189 | 27 |
| 529 | | *Glycine max* | DNA | G192 | 29 |
| 530 | | *Oryza sativa* | PRT | G192 | 29 |
| 531 | | *Glycine max* | DNA | G196 | 31 |
| 532 | | *Zea mays* | DNA | G196 | 31 |
| 533 | | *Zea mays* | DNA | G196 | 31 |
| 534 | | *Oryza sativa* | PRT | G196 | 31 |
| 535 | | *Oryza sativa* | PRT | G196 | 31 |
| 536 | | *Oryza sativa* | PRT | G196 | 31 |
| 537 | | *Oryza sativa* | PRT | G196 | 31 |
| 538 | | *Glycine max* | DNA | G211 | 33 |
| 539 | | *Oryza sativa* | DNA | G211 | 33 |
| 540 | | *Oryza sativa* | PRT | G211 | 33 |
| 541 | | *Glycine max* | DNA | G214, G680 | 35, 145 |
| 542 | | *Glycine max* | DNA | G214, G680 | 35, 145 |
| 543 | | *Glycine max* | DNA | G214, G680 | 35, 145 |
| 544 | | *Glycine max* | DNA | G214, G680 | 35, 145 |
| 545 | | *Oryza sativa* | DNA | G214, G680 | 35, 145 |
| 546 | | *Oryza sativa* | DNA | G214, G680 | 35, 145 |
| 547 | | *Zea mays* | DNA | G214, G680 | 35, 145 |
| 548 | | *Zea mays* | DNA | G214, G680 | 35, 145 |
| 549 | | *Zea mays* | DNA | G214, G680 | 35, 145 |
| 550 | | *Glycine max* | DNA | G226, G682 | 37, 147 |
| 551 | | *Glycine max* | DNA | G226 | 37 |
| 552 | | *Glycine max* | DNA | G226, G682 | 37, 147 |
| 553 | | *Glycine max* | DNA | G226, G682 | 37, 147 |
| 554 | | *Glycine max* | DNA | G226, G682 | 37, 147 |
| 555 | | *Oryza sativa* | DNA | G226, G682 | 37, 147 |
| 556 | | *Zea mays* | DNA | G226, G682 | 37, 147 |
| 557 | | *Zea mays* | DNA | G226, G682 | 37, 147 |
| 558 | | *Oryza sativa* | PRT | G226, G682 | 37, 147 |
| 559 | | *Oryza sativa* | PRT | G226, G682 | 37, 147 |
| 560 | | *Glycine max* | DNA | G241 | 39 |
| 561 | | *Glycine max* | DNA | G241 | 39 |
| 562 | | *Glycine max* | DNA | G241 | 39 |
| 563 | | *Oryza sativa* | DNA | G241 | 39 |
| 564 | | *Zea mays* | DNA | G241 | 39 |
| 565 | | *Zea mays* | DNA | G241 | 39 |
| 566 | | *Zea mays* | DNA | G241 | 39 |
| 567 | | *Zea mays* | DNA | G241 | 39 |
| 568 | | *Zea mays* | DNA | G241 | 39 |
| 569 | | *Nicotiana tabacum* | PRT | G241 | 39 |
| 570 | | *Glycine max* | DNA | G254 | 43 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 571 | | *Glycine max* | DNA | G256 | 45 |
| 572 | | *Glycine max* | DNA | G256 | 45 |
| 573 | | *Glycine max* | DNA | G256 | 45 |
| 574 | | *Glycine max* | DNA | G256 | 45 |
| 575 | | *Glycine max* | DNA | G256 | 45 |
| 576 | | *Glycine max* | DNA | G256 | 45 |
| 577 | | *Glycine max* | DNA | G256 | 45 |
| 578 | | *Oryza sativa* | DNA | G256 | 45 |
| 579 | | *Zea mays* | DNA | G256 | 45 |
| 580 | | *Zea mays* | DNA | G256 | 45 |
| 581 | | *Zea mays* | DNA | G256 | 45 |
| 582 | | *Zea mays* | DNA | G256 | 45 |
| 583 | | *Zea mays* | DNA | G256 | 45 |
| 584 | | *Zea mays* | DNA | G256 | 45 |
| 585 | G3500 | *Lycopersicon esculentum* | DNA | G256 | 45 |
| 586 | G3501 | *Lycopersicon esculentum* | DNA | G256 | 45 |
| 587 | G3385 | *Oryza sativa* | PRT | G256 | 45 |
| 588 | G3386 | *Oryza sativa* | PRT | G256 | 45 |
| 589 | | *Oryza sativa* | PRT | G256 | 45 |
| 590 | G3384 | *Oryza sativa* | PRT | G256 | 45 |
| 591 | | *Oryza sativa* | PRT | G256 | 45 |
| 592 | G3502 | *Oryza sativa japonica* | PRT | G256 | 45 |
| 593 | G3500 | *Lycopersicon esculentum* | PRT | G256 | 45 |
| 594 | G3501 | *Lycopersicon esculentum* | PRT | G256 | 45 |
| 595 | | *Oryza sativa* | DNA | G278 | 47 |
| 596 | | *Zea mays* | DNA | G278 | 47 |
| 597 | | *Oryza sativa* | PRT | G278 | 47 |
| 598 | | *Glycine max* | DNA | G312 | 53 |
| 599 | | *Zea mays* | DNA | G312 | 53 |
| 600 | | *Euphorbia esula* | DNA | G312 | 53 |
| 601 | | *Glycine max* | DNA | G325 | 55 |
| 602 | | *Glycine max* | DNA | G343 | 57 |
| 603 | | *Glycine max* | DNA | G343 | 57 |
| 604 | | *Glycine max* | DNA | G343 | 57 |
| 605 | | *Oryza sativa* | DNA | G343 | 57 |
| 606 | | *Oryza sativa* | DNA | G343 | 57 |
| 607 | | *Oryza sativa* | PRT | G343 | 57 |
| 608 | | *Oryza sativa* | PRT | G343 | 57 |
| 609 | | *Oryza sativa* | PRT | G343 | 57 |
| 610 | | *Glycine max* | DNA | G353, G354 | 59, 61 |
| 611 | | *Glycine max* | DNA | G353, G354 | 59, 61 |
| 612 | | *Glycine max* | DNA | G353, G354 | 59, 61 |
| 613 | | *Oryza sativa* | DNA | G353, G354 | 59, 61 |
| 614 | | *Zea mays* | DNA | G353, G354 | 59, 61 |
| 615 | | *Zea mays* | DNA | G353, G354 | 59, 61 |
| 616 | | *Zea mays* | DNA | G353, G354 | 59, 61 |
| 617 | | *Zea mays* | DNA | G353, G354 | 59, 61 |
| 618 | | *Zea mays* | DNA | G353, G354 | 59, 61 |
| 619 | | *Zea mays* | DNA | G353, G354 | 59, 61 |
| 620 | | *Zea mays* | DNA | G353, G354 | 59, 61 |
| 621 | | *Oryza sativa* | PRT | G353, G354 | 59, 61 |
| 622 | | *Oryza sativa* | PRT | G353, G354 | 59, 61 |
| 623 | | *Oryza sativa* | PRT | G353, G354 | 59, 61 |
| 624 | | *Oryza sativa* | PRT | G353, G354 | 59, 61 |
| 625 | | *Oryza sativa* | PRT | G353, G354 | 59, 61 |
| 626 | | *Oryza sativa* | PRT | G353, G354 | 59, 61 |
| 627 | | *Glycine max* | DNA | G361, G362 | 63, 65 |
| 628 | | *Glycine max* | DNA | G361, G362 | 63, 65 |
| 629 | | *Glycine max* | DNA | G361 | 63 |
| 630 | | *Glycine max* | DNA | G361, G362 | 63, 65 |
| 631 | | *Glycine max* | DNA | G361, G362 | 63, 65 |
| 632 | | *Oryza sativa* | DNA | G361, G362 | 63, 65 |
| 633 | | *Zea mays* | DNA | G361, G362 | 63, 65 |
| 634 | | *Zea mays* | DNA | G361, G362 | 63, 65 |
| 635 | | *Oryza sativa* | PRT | G361, G362 | 63, 65 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 636 | | *Oryza sativa* | PRT | G361, G362 | 63, 65 |
| 637 | | *Oryza sativa* | PRT | G361, G362 | 63, 65 |
| 638 | | *Oryza sativa* | PRT | G361, G362 | 63, 65 |
| 639 | | *Oryza sativa* | PRT | G361, G362 | 63, 65 |
| 640 | | *Glycine max* | DNA | G390, G391, G438 | 69, 71, 77 |
| 641 | | *Glycine max* | DNA | G390, G391, G438 | 69, 71, 77 |
| 642 | | *Glycine max* | DNA | G390, G391, G438 | 69, 71, 77 |
| 643 | | *Glycine max* | DNA | G390, G391, G438 | 69, 71, 77 |
| 644 | | *Glycine max* | DNA | G390, G391, G438 | 69, 71, 77 |
| 645 | | *Glycine max* | DNA | G390, G391, G438 | 69, 71, 77 |
| 646 | | *Glycine max* | DNA | G390, G391, G438 | 69, 71, 77 |
| 647 | | *Glycine max* | DNA | G390, G391 | 69, 71 |
| 648 | | *Glycine max* | DNA | G390, G391, G438 | 69, 71, 77 |
| 649 | | *Glycine max* | DNA | G390, G391, G438 | 69, 71, 77 |
| 650 | | *Oryza sativa* | DNA | G390 | 69 |
| 651 | | *Oryza sativa* | DNA | G390, G438 | 69, 77 |
| 652 | | *Zea mays* | DNA | G390, G391, G438 | 69, 71, 77 |
| 653 | | *Zea mays* | DNA | G390, G391, G438 | 69, 71, 77 |
| 654 | | *Zea mays* | DNA | G390, G391, G438 | 69, 71, 77 |
| 655 | | *Zea mays* | DNA | G390, G391 | 69, 71 |
| 656 | | *Zea mays* | DNA | G390, G391, G438 | 69, 71, 77 |
| 657 | | *Zea mays* | DNA | G390, G391, G438 | 69, 71, 77 |
| 658 | | *Zea mays* | DNA | G390, G391, G438 | 69, 71, 77 |
| 659 | | *Zea mays* | DNA | G390, G391, G438 | 69, 71, 77 |
| 660 | | *Zea mays* | DNA | G390, G391, G438 | 69, 71, 77 |
| 661 | | *Zea mays* | DNA | G390, G391, G438 | 69, 71, 77 |
| 662 | | *Zea mays* | DNA | G390, G391, G438 | 69, 71, 77 |
| 663 | | *Lycopersicon esculentum* | DNA | G390, G391, G438 | 69, 71, 77 |
| 664 | | *Oryza sativa* | DNA | G391, G438 | 71, 77 |
| 665 | | *Oryza sativa* | PRT | G390, G391, G438 | 69, 71, 77 |
| 666 | | *Oryza sativa* | PRT | G390, G391, G438 | 69, 71, 77 |
| 667 | | *Oryza sativa* | PRT | G390, G391, G438 | 69, 71, 77 |
| 668 | | *Oryza sativa* | PRT | G390, G391, G438 | 69, 71, 77 |
| 669 | | *Physcomitrella patens* | PRT | G391 | 71 |
| 670 | | *Glycine max* | DNA | G409 | 73 |
| 671 | | *Glycine max* | DNA | G409 | 73 |
| 672 | | *Glycine max* | DNA | G409 | 73 |
| 673 | | *Glycine max* | DNA | G409 | 73 |
| 674 | | *Glycine max* | DNA | G409 | 73 |
| 675 | | *Glycine max* | DNA | G409 | 73 |
| 676 | | *Glycine max* | DNA | G409 | 73 |
| 677 | | *Glycine max* | DNA | G409 | 73 |
| 678 | | *Oryza sativa* | DNA | G409 | 73 |
| 679 | | *Oryza sativa* | DNA | G409 | 73 |
| 680 | | *Oryza sativa* | DNA | G409 | 73 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 681 | | Zea mays | DNA | G409 | 73 |
| 682 | | Zea mays | DNA | G409 | 73 |
| 683 | | Zea mays | DNA | G409 | 73 |
| 684 | | Zea mays | DNA | G409 | 73 |
| 685 | | Zea mays | DNA | G409 | 73 |
| 686 | | Zea mays | DNA | G409 | 73 |
| 687 | | Zea mays | DNA | G409 | 73 |
| 688 | | Glycine max | DNA | G427 | 75 |
| 689 | | Glycine max | DNA | G427 | 75 |
| 690 | | Glycine max | DNA | G427 | 75 |
| 691 | | Glycine max | DNA | G427 | 75 |
| 692 | | Glycine max | DNA | G427 | 75 |
| 693 | | Glycine max | DNA | G427 | 75 |
| 694 | | Glycine max | DNA | G427 | 75 |
| 695 | | Glycine max | DNA | G427 | 75 |
| 696 | | Glycine max | DNA | G427 | 75 |
| 697 | | Glycine max | DNA | G427 | 75 |
| 698 | | Oryza sativa | DNA | G427 | 75 |
| 699 | | Zea mays | DNA | G427 | 75 |
| 700 | | Zea mays | DNA | G427 | 75 |
| 701 | | Zea mays | DNA | G427 | 75 |
| 702 | | Zea mays | DNA | G427 | 75 |
| 703 | | Zea mays | DNA | G427 | 75 |
| 704 | | Zea mays | DNA | G427 | 75 |
| 705 | | Zea mays | DNA | G427 | 75 |
| 706 | | Zea mays | DNA | G427 | 75 |
| 707 | | Zea mays | DNA | G427 | 75 |
| 708 | | Oryza sativa | PRT | G427 | 75 |
| 709 | | Oryza sativa | PRT | G427 | 75 |
| 710 | | Oryza sativa | PRT | G427 | 75 |
| 711 | | Malus x domestica | PRT | G427 | 75 |
| 712 | | Nicotiana tabacum | PRT | G427 | 75 |
| 713 | | Lycopersicon esculentum | PRT | G427 | 75 |
| 714 | | Glycine max | DNA | G438 | 77 |
| 715 | | Oryza sativa | DNA | G438 | 77 |
| 716 | | Oryza sativa | DNA | G438 | 77 |
| 717 | | Oryza sativa | DNA | G438 | 77 |
| 718 | | Oryza sativa | DNA | G438 | 77 |
| 719 | | Zea mays | DNA | G438 | 77 |
| 720 | | Physcomitrella patens | PRT | G438 | 77 |
| 721 | | Oryza sativa | PRT | G438 | 77 |
| 722 | | Glycine max | DNA | G450 | 79 |
| 723 | | Glycine max | DNA | G450 | 79 |
| 724 | | Glycine max | DNA | G450 | 79 |
| 725 | | Glycine max | DNA | G450 | 79 |
| 726 | | Glycine max | DNA | G450 | 79 |
| 727 | | Glycine max | DNA | G450 | 79 |
| 728 | | Glycine max | DNA | G450 | 79 |
| 729 | | Glycine max | DNA | G450 | 79 |
| 730 | | Glycine max | DNA | G450 | 79 |
| 731 | | Oryza sativa | DNA | G450 | 79 |
| 732 | | Oryza sativa | DNA | G450 | 79 |
| 733 | | Zea mays | DNA | G450 | 79 |
| 734 | | Zea mays | DNA | G450 | 79 |
| 735 | | Zea mays | DNA | G450 | 79 |
| 736 | | Oryza sativa | PRT | G450 | 79 |
| 737 | | Oryza sativa | PRT | G450 | 79 |
| 738 | | Oryza sativa | PRT | G450 | 79 |
| 739 | | Oryza sativa | PRT | G450 | 79 |
| 740 | | Oryza sativa | DNA | G464 | 81 |
| 741 | | Zea mays | DNA | G464 | 81 |
| 742 | | Oryza sativa | PRT | G464 | 81 |
| 743 | | Glycine max | DNA | G470 | 83 |
| 744 | | Oryza sativa | DNA | G470 | 83 |
| 745 | | Oryza sativa | DNA | G470 | 83 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 746 | | *Glycine max* | DNA | G481, G482 | 87, 89 |
| 747 | | *Glycine max* | DNA | G481, G482 | 87, 89 |
| 748 | | *Glycine max* | DNA | G481, G482 | 87, 89 |
| 749 | | *Glycine max* | DNA | G481, G482 | 87, 89 |
| 750 | | *Glycine max* | DNA | G481, G482 | 87, 89 |
| 751 | | *Glycine max* | DNA | G481, G482 | 87, 89 |
| 752 | | *Glycine max* | DNA | G481, G482 | 87, 89 |
| 753 | | *Glycine max* | DNA | G481, G482 | 87, 89 |
| 754 | | *Glycine max* | DNA | G481 | 87 |
| 755 | | *Glycine max* | DNA | G481 | 87 |
| 756 | | *Oryza sativa* | DNA | G481 | 87 |
| 757 | | *Oryza sativa* | DNA | G481, G482 | 87, 89 |
| 758 | | *Zea mays* | DNA | G481 | 87 |
| 759 | | *Zea mays* | DNA | G481, G482 | 87, 89 |
| 760 | | *Zea mays* | DNA | G481, G482 | 87, 89 |
| 761 | | *Zea mays* | DNA | G481, G482 | 87, 89 |
| 762 | | *Zea mays* | DNA | G481, G482 | 87, 89 |
| 763 | | *Zea mays* | DNA | G481, G482 | 87, 89 |
| 764 | | *Zea mays* | DNA | G481, G482 | 87, 89 |
| 765 | | *Zea mays* | DNA | G481, G482 | 87, 89 |
| 766 | | *Zea mays* | DNA | G481, G482 | 87, 89 |
| 767 | | *Zea mays* | DNA | G481, G482 | 87, 89 |
| 768 | | *Gossypium arboreum* | DNA | G481, G482 | 87, 89 |
| 769 | | *Glycine max* | DNA | G481, G482 | 87, 89 |
| 770 | | *Gossypium hirsutum* | DNA | G481, G482 | 87, 89 |
| 771 | | *Lycopersicon esculentum* | DNA | G481, G482 | 87, 89 |
| 772 | | *Lycopersicon esculentum* | DNA | G481, G482 | 87, 89 |
| 773 | | *Medicago truncatula* | DNA | G481, G482 | 87, 89 |
| 774 | | *Lycopersicon esculentum* | DNA | G481, G482 | 87, 89 |
| 775 | | *Solanum tuberosum* | DNA | G481, G482 | 87, 89 |
| 776 | | *Triticum aestivum* | DNA | G481, G482 | 87, 89 |
| 777 | | *Hordeum vulgare* | DNA | G481, G482 | 87, 89 |
| 778 | | *Triticum monococcum* | DNA | G481, G482 | 87, 89 |
| 779 | | *Glycine max* | DNA | G482 | 89 |
| 780 | | *Oryza sativa* | PRT | G481, G482 | 87, 89 |
| 781 | | *Oryza sativa* | PRT | G481, G482 | 87, 89 |
| 782 | | *Oryza sativa* | PRT | G481, G482 | 87, 89 |
| 783 | | *Oryza sativa* | PRT | G481, G482 | 87, 89 |
| 784 | | *Oryza sativa* | PRT | G481, G482 | 87, 89 |
| 785 | | *Zea mays* | PRT | G481, G482 | 87, 89 |
| 786 | | *Zea mays* | PRT | G481, G482 | 87, 89 |
| 787 | | *Oryza sativa* | PRT | G481, G482 | 87, 89 |
| 788 | | *Oryza sativa* | PRT | G481, G482 | 87, 89 |
| 789 | | *Oryza sativa* | PRT | G481, G482 | 87, 89 |
| 790 | | *Oryza sativa* | PRT | G481, G482 | 87, 89 |
| 791 | | *Oryza sativa* | PRT | G481, G482 | 87, 89 |
| 792 | | *Oryza sativa* | PRT | G481, G482 | 87, 89 |
| 793 | | *Oryza sativa* | PRT | G481, G482 | 87, 89 |
| 794 | | *Oryza sativa* | PRT | G481, G482 | 87, 89 |
| 795 | | *Oryza sativa* | PRT | G481, G482 | 87, 89 |
| 796 | | *Oryza sativa* | PRT | G481, G482 | 87, 89 |
| 797 | | *Glycine max* | PRT | G481, G482 | 87, 89 |
| 798 | | *Glycine max* | PRT | G481, G482 | 87, 89 |
| 799 | | *Glycine max* | PRT | G481, G482 | 87, 89 |
| 800 | | *Glycine max* | PRT | G481, G482 | 87, 89 |
| 801 | | *Glycine max* | PRT | G481, G482 | 87, 89 |
| 802 | | *Glycine max* | PRT | G481, G482 | 87, 89 |
| 803 | | *Glycine max* | PRT | G481, G482 | 87, 89 |
| 804 | | *Zea mays* | PRT | G481, G482 | 87, 89 |
| 805 | | *Zea mays* | PRT | G481, G482 | 87, 89 |
| 806 | | *Zea mays* | PRT | G481, G482 | 87, 89 |
| 807 | | *Zea mays* | PRT | G481, G482 | 87, 89 |
| 808 | | *Glycine max* | DNA | G484 | 91 |
| 809 | | *Glycine max* | DNA | G484 | 91 |
| 810 | | *Glycine max* | DNA | G484 | 91 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 811 | | *Glycine max* | DNA | G484 | 91 |
| 812 | | *Glycine max* | DNA | G484 | 91 |
| 813 | | *Glycine max* | DNA | G484 | 91 |
| 814 | | *Glycine max* | DNA | G484 | 91 |
| 815 | | *Glycine max* | DNA | G484 | 91 |
| 816 | | *Glycine max* | DNA | G484 | 91 |
| 817 | | *Glycine max* | DNA | G484 | 91 |
| 818 | | *Oryza sativa* | DNA | G484 | 91 |
| 819 | | *Zea mays* | DNA | G484 | 91 |
| 820 | | *Zea mays* | DNA | G484 | 91 |
| 821 | | *Zea mays* | DNA | G484 | 91 |
| 822 | | *Zea mays* | DNA | G484 | 91 |
| 823 | | *Zea mays* | DNA | G484 | 91 |
| 824 | | *Oryza sativa* | PRT | G484 | 91 |
| 825 | | *Glycine max* | DNA | G489 | 93 |
| 826 | | *Glycine max* | DNA | G489 | 93 |
| 827 | | *Glycine max* | DNA | G489 | 93 |
| 828 | | *Glycine max* | DNA | G489 | 93 |
| 829 | | *Glycine max* | DNA | G489 | 93 |
| 830 | | *Glycine max* | DNA | G489 | 93 |
| 831 | | *Glycine max* | DNA | G489 | 93 |
| 832 | | *Oryza sativa* | DNA | G489 | 93 |
| 833 | | *Oryza sativa* | DNA | G489 | 93 |
| 834 | | *Zea mays* | DNA | G489 | 93 |
| 835 | | *Oryza sativa* | PRT | G489 | 93 |
| 836 | | *Oryza sativa* | PRT | G489 | 93 |
| 837 | | *Oryza sativa* | PRT | G489 | 93 |
| 838 | | *Glycine max* | DNA | G504 | 97 |
| 839 | | *Glycine max* | DNA | G504 | 97 |
| 840 | | *Glycine max* | DNA | G504 | 97 |
| 841 | | *Glycine max* | DNA | G504 | 97 |
| 842 | | *Glycine max* | DNA | G504 | 97 |
| 843 | | *Glycine max* | DNA | G504 | 97 |
| 844 | | *Glycine max* | DNA | G504 | 97 |
| 845 | | *Oryza sativa* | DNA | G504 | 97 |
| 846 | | *Oryza sativa* | DNA | G504 | 97 |
| 847 | | *Zea mays* | DNA | G504 | 97 |
| 848 | | *Zea mays* | DNA | G504 | 97 |
| 849 | | *Zea mays* | DNA | G504 | 97 |
| 850 | | *Zea mays* | DNA | G504 | 97 |
| 851 | | *Oryza sativa* | PRT | G504 | 97 |
| 852 | | *Oryza sativa* | PRT | G504 | 97 |
| 853 | | *Oryza sativa* | PRT | G504 | 97 |
| 854 | | *Oryza sativa* | PRT | G504 | 97 |
| 855 | | *Lycopersicon esculentum* | DNA | G509 | 99 |
| 856 | | *Glycine max* | DNA | G509 | 99 |
| 857 | | *Glycine max* | DNA | G509 | 99 |
| 858 | | *Glycine max* | DNA | G509 | 99 |
| 859 | | *Oryza sativa* | DNA | G509 | 99 |
| 860 | | *Oryza sativa* | DNA | G509 | 99 |
| 861 | | *Zea mays* | DNA | G509 | 99 |
| 862 | | *Zea mays* | DNA | G509 | 99 |
| 863 | | *Zea mays* | DNA | G509 | 99 |
| 864 | | *Zea mays* | DNA | G509 | 99 |
| 865 | | *Oryza sativa* | PRT | G509 | 99 |
| 866 | | *Oryza sativa* | PRT | G509 | 99 |
| 867 | | *Oryza sativa* | PRT | G509 | 99 |
| 868 | | *Glycine max* | DNA | G519 | 101 |
| 869 | | *Glycine max* | DNA | G519 | 101 |
| 870 | | *Glycine max* | DNA | G519 | 101 |
| 871 | | *Glycine max* | DNA | G519 | 101 |
| 872 | | *Glycine max* | DNA | G519 | 101 |
| 873 | | *Glycine max* | DNA | G519 | 101 |
| 874 | | *Glycine max* | DNA | G519 | 101 |
| 875 | | *Glycine max* | DNA | G519 | 101 |
| 876 | | *Glycine max* | DNA | G519 | 101 |
| 877 | | *Oryza sativa* | DNA | G519 | 101 |
| 878 | | *Oryza sativa* | DNA | G519 | 101 |
| 879 | | *Oryza sativa* | DNA | G519 | 101 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 880 | | *Zea mays* | DNA | G519 | 101 |
| 881 | | *Zea mays* | DNA | G519 | 101 |
| 882 | | *Zea mays* | DNA | G519 | 101 |
| 883 | | *Zea mays* | DNA | G519 | 101 |
| 884 | | *Zea mays* | DNA | G519 | 101 |
| 885 | | *Zea mays* | DNA | G519 | 101 |
| 886 | | *Zea mays* | DNA | G519 | 101 |
| 887 | | *Zea mays* | DNA | G519 | 101 |
| 888 | | *Zea mays* | DNA | G519 | 101 |
| 889 | | *Zea mays* | DNA | G519 | 101 |
| 890 | | *Oryza sativa* | PRT | G519 | 101 |
| 891 | | *Oryza sativa* | PRT | G519 | 101 |
| 892 | | *Glycine max* | DNA | G545 | 103 |
| 893 | | *Glycine max* | DNA | G545 | 103 |
| 894 | | *Glycine max* | DNA | G545 | 103 |
| 895 | | *Glycine max* | DNA | G545 | 103 |
| 896 | | *Glycine max* | DNA | G545 | 103 |
| 897 | | *Glycine max* | DNA | G545 | 103 |
| 898 | | *Glycine max* | DNA | G545 | 103 |
| 899 | | *Oryza sativa* | DNA | G545 | 103 |
| 900 | | *Zea mays* | DNA | G545 | 103 |
| 901 | | *Zea mays* | DNA | G545 | 103 |
| 902 | | *Zea mays* | DNA | G545 | 103 |
| 903 | | *Oryza sativa* | PRT | G545 | 103 |
| 904 | | *Oryza sativa* | PRT | G545 | 103 |
| 905 | | *Oryza sativa* | PRT | G545 | 103 |
| 906 | | *Oryza sativa* | PRT | G545 | 103 |
| 907 | | *Datisca glomerata* | PRT | G545 | 103 |
| 908 | | *Oryza sativa* | DNA | G546 | 105 |
| 909 | | *Zea mays* | DNA | G561 | 107 |
| 910 | | *Sinapis alba* | PRT | G561 | 107 |
| 911 | | *Raphanus sativus* | PRT | G561 | 107 |
| 912 | | *Brassica napus* | PRT | G561 | 107 |
| 913 | | *Brassica napus* | PRT | G561 | 107 |
| 914 | | *Glycine max* | DNA | G562 | 109 |
| 915 | | *Glycine max* | DNA | G562 | 109 |
| 916 | | *Glycine max* | DNA | G562 | 109 |
| 917 | | *Glycine max* | DNA | G562 | 109 |
| 918 | | *Glycine max* | DNA | G562 | 109 |
| 919 | | *Zea mays* | DNA | G562 | 109 |
| 920 | | *Zea mays* | DNA | G562 | 109 |
| 921 | | *Zea mays* | DNA | G562 | 109 |
| 922 | | *Oryza sativa* | PRT | G562 | 109 |
| 923 | | *Oryza sativa* | PRT | G562 | 109 |
| 924 | | *Glycine max* | DNA | G567 | 111 |
| 925 | | *Oryza sativa* | DNA | G567 | 111 |
| 926 | | *Oryza sativa* | PRT | G567 | 111 |
| 927 | | *Glycine max* | DNA | G568 | 113 |
| 928 | | *Glycine max* | DNA | G568 | 113 |
| 929 | | *Oryza sativa* | DNA | G568 | 113 |
| 930 | | *Oryza sativa* | DNA | G568 | 113 |
| 931 | | *Oryza sativa* | DNA | G568 | 113 |
| 932 | | *Zea mays* | DNA | G568 | 113 |
| 933 | | *Oryza sativa* | PRT | G568 | 113 |
| 934 | | *Populus balsamifera* subsp. *trichocarpa* x *Populus deltoides* | PRT | G568 | 113 |
| 935 | | *Glycine max* | DNA | G584 | 115 |
| 936 | | *Glycine max* | DNA | G584 | 115 |
| 937 | | *Glycine max* | DNA | G584 | 115 |
| 938 | | *Glycine max* | DNA | G584 | 115 |
| 939 | | *Glycine max* | DNA | G584 | 115 |
| 940 | | *Zea mays* | DNA | G584 | 115 |
| 941 | | *Zea mays* | DNA | G584 | 115 |
| 942 | | *Zea mays* | DNA | G584 | 115 |
| 943 | | *Oryza sativa* | PRT | G584 | 115 |
| 944 | | *Glycine max* | DNA | G585 | 117 |
| 945 | | *Glycine max* | DNA | G585 | 117 |
| 946 | | *Glycine max* | DNA | G585 | 117 |
| 947 | | *Glycine max* | DNA | G585 | 117 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 948 | | *Oryza sativa* | DNA | G585 | 117 |
| 949 | | *Zea mays* | DNA | G585 | 117 |
| 950 | | *Zea mays* | DNA | G585 | 117 |
| 951 | | *Zea mays* | DNA | G585 | 117 |
| 952 | | *Zea mays* | DNA | G585 | 117 |
| 953 | | *Oryza sativa* | PRT | G585 | 117 |
| 954 | | *Oryza sativa* | PRT | G585 | 117 |
| 955 | | *Oryza sativa* | PRT | G585 | 117 |
| 956 | | *Oryza sativa* | PRT | G585 | 117 |
| 957 | | *Oryza sativa* | PRT | G585 | 117 |
| 958 | | *Oryza sativa* | PRT | G585 | 117 |
| 959 | | *Gossypium hirsutum* | PRT | G585 | 117 |
| 960 | | *Antirrhinum majus* | PRT | G585 | 117 |
| 961 | | *Glycine max* | DNA | G590 | 119 |
| 962 | | *Glycine max* | DNA | G590 | 119 |
| 963 | | *Glycine max* | DNA | G590 | 119 |
| 964 | | *Oryza sativa* | DNA | G590 | 119 |
| 965 | | *Zea mays* | DNA | G590 | 119 |
| 966 | | *Oryza sativa* | PRT | G590 | 119 |
| 967 | | *Oryza sativa* | PRT | G590 | 119 |
| 968 | | *Oryza sativa* | DNA | G597 | 123 |
| 969 | | *Oryza sativa* | DNA | G597 | 123 |
| 970 | | *Oryza sativa* | DNA | G597 | 123 |
| 971 | | *Zea mays* | DNA | G597 | 123 |
| 972 | | *Zea mays* | DNA | G597 | 123 |
| 973 | | *Zea mays* | DNA | G597 | 123 |
| 974 | | *Zea mays* | DNA | G597 | 123 |
| 975 | | *Zea mays* | DNA | G597 | 123 |
| 976 | | *Zea mays* | DNA | G597 | 123 |
| 977 | | *Zea mays* | DNA | G597 | 123 |
| 978 | | *Zea mays* | DNA | G597 | 123 |
| 979 | | *Zea mays* | DNA | G597 | 123 |
| 980 | | *Zea mays* | DNA | G597 | 123 |
| 981 | | *Oryza sativa* | DNA | G634 | 127 |
| 982 | | *Oryza sativa* | DNA | G634 | 127 |
| 983 | | *Oryza sativa* | DNA | G634 | 127 |
| 984 | | *Zea mays* | DNA | G634 | 127 |
| 985 | | *Zea mays* | DNA | G634 | 127 |
| 986 | | *Zea mays* | DNA | G634 | 127 |
| 987 | | *Oryza sativa* | PRT | G634 | 127 |
| 988 | | *Oryza sativa* | PRT | G634 | 127 |
| 989 | | *Glycine max* | DNA | G635 | 129 |
| 990 | | *Glycine max* | DNA | G635 | 129 |
| 991 | | *Oryza sativa* | DNA | G635 | 129 |
| 992 | | *Oryza sativa* | DNA | G635 | 129 |
| 993 | | *Zea mays* | DNA | G635 | 129 |
| 994 | | *Oryza sativa* | PRT | G635 | 129 |
| 995 | | *Glycine max* | DNA | G636 | 131 |
| 996 | | *Glycine max* | DNA | G636 | 131 |
| 997 | | *Glycine max* | DNA | G636 | 131 |
| 998 | | *Glycine max* | DNA | G636 | 131 |
| 999 | | *Glycine max* | DNA | G636 | 131 |
| 1000 | | *Glycine max* | DNA | G636 | 131 |
| 1001 | | *Glycine max* | DNA | G636 | 131 |
| 1002 | | *Glycine max* | DNA | G636 | 131 |
| 1003 | | *Oryza sativa* | DNA | G636 | 131 |
| 1004 | | *Oryza sativa* | DNA | G636 | 131 |
| 1005 | | *Oryza sativa* | DNA | G636 | 131 |
| 1006 | | *Oryza sativa* | DNA | G636 | 131 |
| 1007 | | *Zea mays* | DNA | G636 | 131 |
| 1008 | | *Zea mays* | DNA | G636 | 131 |
| 1009 | | *Zea mays* | DNA | G636 | 131 |
| 1010 | | *Zea mays* | DNA | G636 | 131 |
| 1011 | | *Pisum sativum* | PRT | G636 | 131 |
| 1012 | | *Glycine max* | DNA | G638 | 133 |
| 1013 | | *Glycine max* | DNA | G638 | 133 |
| 1014 | | *Glycine max* | DNA | G638 | 133 |
| 1015 | | *Glycine max* | DNA | G638 | 133 |
| 1016 | | *Medicago truncatula* | DNA | G638 | 133 |
| 1017 | | *Glycine max* | DNA | G652 | 135 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1018 | | *Glycine max* | DNA | G652 | 135 |
| 1019 | | *Glycine max* | DNA | G652 | 135 |
| 1020 | | *Glycine max* | DNA | G652 | 135 |
| 1021 | | *Glycine max* | DNA | G652 | 135 |
| 1022 | | *Glycine max* | DNA | G652 | 135 |
| 1023 | | *Glycine max* | DNA | G652 | 135 |
| 1024 | | *Glycine max* | DNA | G652 | 135 |
| 1025 | | *Oryza sativa* | DNA | G652 | 135 |
| 1026 | | *Oryza sativa* | DNA | G652 | 135 |
| 1027 | | *Oryza sativa* | DNA | G652 | 135 |
| 1028 | | *Zea mays* | DNA | G652 | 135 |
| 1029 | | *Zea mays* | DNA | G652 | 135 |
| 1030 | | *Zea mays* | DNA | G652 | 135 |
| 1031 | | *Zea mays* | DNA | G652 | 135 |
| 1032 | | *Zea mays* | DNA | G652 | 135 |
| 1033 | | *Zea mays* | DNA | G652 | 135 |
| 1034 | | *Zea mays* | DNA | G652 | 135 |
| 1035 | | *Oryza sativa* | PRT | G652 | 135 |
| 1036 | | *Oryza sativa* | PRT | G652 | 135 |
| 1037 | | *Oryza sativa* | PRT | G652 | 135 |
| 1038 | | *Oryza sativa* | PRT | G652 | 135 |
| 1039 | | *Oryza sativa* | PRT | G652 | 135 |
| 1040 | | *Oryza sativa* | PRT | G652 | 135 |
| 1041 | | *Oryza sativa* | PRT | G652 | 135 |
| 1042 | | *Oryza sativa* | PRT | G652 | 135 |
| 1043 | | *Glycine max* | DNA | G663 | 137 |
| 1044 | | *Glycine max* | DNA | G664 | 139 |
| 1045 | | *Glycine max* | DNA | G664 | 139 |
| 1046 | | *Glycine max* | DNA | G664 | 139 |
| 1047 | | *Glycine max* | DNA | G664 | 139 |
| 1048 | | *Glycine max* | DNA | G664 | 139 |
| 1049 | | *Glycine max* | DNA | G664 | 139 |
| 1050 | | *Glycine max* | DNA | G664 | 139 |
| 1051 | | *Oryza sativa* | DNA | G664 | 139 |
| 1052 | | *Oryza sativa* | DNA | G664 | 139 |
| 1053 | | *Oryza sativa* | DNA | G664 | 139 |
| 1054 | | *Oryza sativa* | DNA | G664 | 139 |
| 1055 | | *Zea mays* | DNA | G664 | 139 |
| 1056 | | *Zea mays* | DNA | G664 | 139 |
| 1057 | | *Zea mays* | DNA | G664 | 139 |
| 1058 | | *Zea mays* | DNA | G664 | 139 |
| 1059 | | *Zea mays* | DNA | G664 | 139 |
| 1060 | | *Zea mays* | DNA | G664 | 139 |
| 1061 | | *Zea mays* | DNA | G664 | 139 |
| 1062 | | *Zea mays* | DNA | G664 | 139 |
| 1063 | G3509 | *Lycopersicon esculentum* | DNA | G664 | 139 |
| 1064 | G3506 | *Oryza sativa* | PRT | G664 | 139 |
| 1065 | G3504 | *Oryza sativa* | PRT | G664 | 139 |
| 1066 | | *Oryza sativa* | PRT | G664 | 139 |
| 1067 | | *Oryza sativa* | PRT | G664 | 139 |
| 1068 | G3503 | *Oryza sativa indica* | PRT | G664 | 139 |
| 1069 | G3505 | *Oryza sativa japonica* | PRT | G664 | 139 |
| 1070 | G3507 | *Oryza sativa japonica* | PRT | G664 | 139 |
| 1071 | G3508 | *Oryza sativa japonica* | PRT | G664 | 139 |
| 1072 | G3509 | *Lycopersicon esculentum* | PRT | G664 | 139 |
| 1073 | | *Hordeum vulgare* subsp. *vulgare* | PRT | G664 | 139 |
| 1074 | | *Oryza sativa* | DNA | G680 | 145 |
| 1075 | | *Zea mays* | DNA | G680 | 145 |
| 1076 | | *Glycine max* | DNA | G682 | 147 |
| 1077 | | *Hordeum vulgare* subsp. *vulgare* | DNA | G682 | 147 |
| 1078 | | *Populus tremula* x *Populus tremuloides* | DNA | G682 | 147 |
| 1079 | | *Triticum aestivum* | DNA | G682 | 147 |
| 1080 | | *Gossypium arboreum* | DNA | G682 | 147 |
| 1081 | | *Oryza sativa* | PRT | G682 | 147 |
| 1082 | | *Oryza sativa* | PRT | G682 | 147 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1083 | | *Glycine max* | PRT | G682 | 147 |
| 1084 | | *Glycine max* | PRT | G682 | 147 |
| 1085 | | *Glycine max* | PRT | G682 | 147 |
| 1086 | | *Glycine max* | PRT | G682 | 147 |
| 1087 | | *Glycine max* | PRT | G682 | 147 |
| 1088 | | *Glycine max* | PRT | G682 | 147 |
| 1089 | | *Zea mays* | PRT | G682 | 147 |
| 1090 | | *Zea mays* | PRT | G682 | 147 |
| 1091 | | *Glycine max* | DNA | G715, G1646 | 149, 313 |
| 1092 | | *Glycine max* | DNA | G715, G1646 | 149, 313 |
| 1093 | | *Glycine max* | DNA | G715, G1646 | 149, 313 |
| 1094 | | *Oryza sativa* | DNA | G715, G1646 | 149, 313 |
| 1095 | | *Oryza sativa* | DNA | G715, G1646 | 149, 313 |
| 1096 | | *Zea mays* | DNA | G715, G1646 | 149, 313 |
| 1097 | | *Zea mays* | DNA | G715, G1646 | 149, 313 |
| 1098 | | *Zea mays* | DNA | G715, G1646 | 149, 313 |
| 1099 | | *Zea mays* | DNA | G715, G1646 | 149, 313 |
| 1100 | | *Zea mays* | DNA | G715, G1646 | 149, 313 |
| 1101 | | *Zea mays* | DNA | G715, G1646 | 149, 313 |
| 1102 | | *Zea mays* | DNA | G715, G1646 | 149, 313 |
| 1103 | | *Zea mays* | DNA | G715, G1646 | 149, 313 |
| 1104 | | *Zea mays* | DNA | G715, G1646 | 149, 313 |
| 1105 | | *Oryza sativa* | PRT | G715, G1646 | 149, 313 |
| 1106 | | *Oryza sativa* | PRT | G715, G1646 | 149, 313 |
| 1107 | | *Oryza sativa* | PRT | G715, G1646 | 149, 313 |
| 1108 | | *Oryza sativa* | PRT | G715, G1646 | 149, 313 |
| 1109 | | *Oryza sativa* | PRT | G715, G1646 | 149, 313 |
| 1110 | | *Oryza sativa* | PRT | G715, G1646 | 149, 313 |
| 1111 | | *Glycine max* | DNA | G720 | 151 |
| 1112 | | *Glycine max* | DNA | G720 | 151 |
| 1113 | | *Glycine max* | DNA | G720 | 151 |
| 1114 | | *Glycine max* | DNA | G720 | 151 |
| 1115 | | *Medicago truncatula* | DNA | G720 | 151 |
| 1116 | | *Lycopersicon esculentum* | DNA | G720 | 151 |
| 1117 | | *Lycopersicon esculentum* | DNA | G720 | 151 |
| 1118 | | *Lycopersicon esculentum* | DNA | G720 | 151 |
| 1119 | | *Solanum tuberosum* | DNA | G720 | 151 |
| 1120 | | *Glycine max* | DNA | G736 | 153 |
| 1121 | | *Glycine max* | DNA | G736 | 153 |
| 1122 | | *Oryza sativa* | PRT | G736 | 153 |
| 1123 | | *Glycine max* | DNA | G748 | 155 |
| 1124 | | *Glycine max* | DNA | G748 | 155 |
| 1125 | | *Glycine max* | DNA | G748 | 155 |
| 1126 | | *Oryza sativa* | DNA | G748 | 155 |
| 1127 | | *Oryza sativa* | DNA | G748 | 155 |
| 1128 | | *Zea mays* | DNA | G748 | 155 |
| 1129 | | *Oryza sativa* | PRT | G748 | 155 |
| 1130 | | *Oryza sativa* | PRT | G748 | 155 |
| 1131 | | *Oryza sativa* | PRT | G748 | 155 |
| 1132 | | *Oryza sativa* | PRT | G748 | 155 |
| 1133 | | *Cucurbita maxima* | PRT | G748 | 155 |
| 1134 | | *Glycine max* | DNA | G789, G1494 | 159, 291 |
| 1135 | | *Glycine max* | DNA | G789, G1494 | 159, 291 |
| 1136 | | *Oryza sativa* | DNA | G789 | 159 |
| 1137 | | *Oryza sativa* | DNA | G789, G1494 | 159, 291 |
| 1138 | | *Zea mays* | DNA | G789, G1494 | 159, 291 |
| 1139 | | *Oryza sativa* | PRT | G789, G1494 | 159, 291 |
| 1140 | | *Oryza sativa* | PRT | G789, G1494 | 159, 291 |
| 1141 | | *Oryza sativa* | PRT | G789, G1494 | 159, 291 |
| 1142 | | *Glycine max* | DNA | G801 | 161 |
| 1143 | | *Glycine max* | DNA | G801 | 161 |
| 1144 | | *Zea mays* | DNA | G801 | 161 |
| 1145 | | *Glycine max* | DNA | G849 | 163 |
| 1146 | | *Glycine max* | DNA | G849 | 163 |
| 1147 | | *Glycine max* | DNA | G849 | 163 |
| 1148 | | *Glycine max* | DNA | G849 | 163 |
| 1149 | | *Glycine max* | DNA | G849 | 163 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1150 | | *Glycine max* | DNA | G849 | 163 |
| 1151 | | *Zea mays* | DNA | G849 | 163 |
| 1152 | | *Zea mays* | DNA | G849 | 163 |
| 1153 | | *Zea mays* | DNA | G849 | 163 |
| 1154 | | *Glycine max* | DNA | G864 | 167 |
| 1155 | | *Glycine max* | DNA | G864 | 167 |
| 1156 | | *Zea mays* | DNA | G864 | 167 |
| 1157 | | *Oryza sativa* | PRT | G864 | 167 |
| 1158 | | *Oryza sativa* | PRT | G864 | 167 |
| 1159 | | *Glycine max* | DNA | G867, G1930 | 169, 369 |
| 1160 | | *Glycine max* | DNA | G867, G1930 | 169, 369 |
| 1161 | | *Glycine max* | DNA | G867, G1930 | 169, 369 |
| 1162 | | *Glycine max* | DNA | G867, G1930 | 169, 369 |
| 1163 | | *Glycine max* | DNA | G867, G1930 | 169, 369 |
| 1164 | | *Glycine max* | DNA | G867 | 169 |
| 1165 | | *Oryza sativa* | DNA | G867 | 169 |
| 1166 | | *Oryza sativa* | DNA | G867, G1930 | 169, 369 |
| 1167 | | *Zea mays* | DNA | G867, G1930 | 169, 369 |
| 1168 | | *Zea mays* | DNA | G867, G1930 | 169, 369 |
| 1169 | | *Zea mays* | DNA | G867, G1930 | 169, 369 |
| 1170 | | *Zea mays* | DNA | G867, G1930 | 169, 369 |
| 1171 | | *Glycine max* | DNA | G867, G1930 | 169, 369 |
| 1172 | | *Mesembryanthemum crystallinum* | DNA | G867, G1930 | 169, 369 |
| 1173 | | *Lycopersicon esculentum* | DNA | G867, G1930 | 169, 369 |
| 1174 | | *Solanum tuberosum* | DNA | G867, G1930 | 169, 369 |
| 1175 | | *Hordeum vulgare* | DNA | G867, G1930 | 169, 369 |
| 1176 | | *Oryza sativa* | PRT | G867, G1930 | 169, 369 |
| 1177 | | *Oryza sativa* | PRT | G867, G1930 | 169, 369 |
| 1178 | | *Oryza sativa* | PRT | G867, G1930 | 169, 369 |
| 1179 | | *Oryza sativa* | PRT | G867, G1930 | 169, 369 |
| 1180 | | *Oryza sativa* | PRT | G867, G1930 | 169, 369 |
| 1181 | | *Oryza sativa* | PRT | G867, G1930 | 169, 369 |
| 1182 | | *Glycine max* | PRT | G867, G1930 | 169, 369 |
| 1183 | | *Glycine max* | PRT | G867, G1930 | 169, 369 |
| 1184 | | *Glycine max* | PRT | G867, G1930 | 169, 369 |
| 1185 | | *Zea mays* | PRT | G867, G1930 | 169, 369 |
| 1186 | | *Zea mays* | PRT | G867, G1930 | 169, 369 |
| 1187 | | *Glycine max* | DNA | G869 | 171 |
| 1188 | | *Glycine max* | DNA | G869 | 171 |
| 1189 | | *Oryza sativa* | DNA | G869 | 171 |
| 1190 | | *Zea mays* | DNA | G869 | 171 |
| 1191 | | *Oryza sativa* | PRT | G869 | 171 |
| 1192 | | *Oryza sativa* | DNA | G877 | 173 |
| 1193 | | *Glycine max* | DNA | G881 | 175 |
| 1194 | | *Oryza sativa* | DNA | G881 | 175 |
| 1195 | | *Oryza sativa* | DNA | G881 | 175 |
| 1196 | | *Zea mays* | DNA | G881 | 175 |
| 1197 | | *Zea mays* | DNA | G881 | 175 |
| 1198 | | *Zea mays* | DNA | G881 | 175 |
| 1199 | | *Zea mays* | DNA | G881 | 175 |
| 1200 | | *Oryza sativa* | PRT | G881 | 175 |
| 1201 | | *Oryza sativa* | PRT | G892 | 177 |
| 1202 | | *Mentha* x *piperita* | DNA | G896 | 179 |
| 1203 | | *Glycine max* | DNA | G910 | 181 |
| 1204 | | *Glycine max* | DNA | G912 | 185 |
| 1205 | | *Glycine max* | DNA | G912 | 185 |
| 1206 | | *Glycine max* | DNA | G912 | 185 |
| 1207 | | *Glycine max* | DNA | G912 | 185 |
| 1208 | | *Glycine max* | DNA | G912 | 185 |
| 1209 | | *Glycine max* | DNA | G912 | 185 |
| 1210 | | *Glycine max* | DNA | G912 | 185 |
| 1211 | | *Oryza sativa* | DNA | G912 | 185 |
| 1212 | | *Oryza sativa* | DNA | G912, G913 | 185, 187 |
| 1213 | | *Zea mays* | DNA | G912 | 185 |
| 1214 | | *Zea mays* | DNA | G912 | 185 |
| 1215 | | *Zea mays* | DNA | G912, G913 | 185, 187 |
| 1216 | | *Zea mays* | DNA | G912 | 185 |
| 1217 | | *Zea mays* | DNA | G912 | 185 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1218 | | *Brassica napus* | DNA | G912, G913 | 185, 187 |
| 1219 | | *Solanum tuberosum* | DNA | G912 | 185 |
| 1220 | | *Descurainia sophia* | DNA | G912 | 185 |
| 1221 | | *Oryza sativa* | PRT | G912 | 185 |
| 1222 | | *Oryza sativa* | PRT | G912, G913 | 185, 187 |
| 1223 | | *Oryza sativa* | PRT | G912, G913 | 185, 187 |
| 1224 | | *Oryza sativa* | PRT | G912 | 185 |
| 1225 | | *Brassica napus* | PRT | G912 | 185 |
| 1226 | | *Nicotiana tabacum* | PRT | G912 | 185 |
| 1227 | | *Oryza sativa* | PRT | G912 | 185 |
| 1228 | | *Oryza sativa* | PRT | G912 | 185 |
| 1229 | | *Oryza sativa* | PRT | G912 | 185 |
| 1230 | | *Oryza sativa* | PRT | G912 | 185 |
| 1231 | | *Oryza sativa* | PRT | G912 | 185 |
| 1232 | | *Oryza sativa* | PRT | G912 | 185 |
| 1233 | | *Oryza sativa* | PRT | G912 | 185 |
| 1234 | | *Oryza sativa* | PRT | G912 | 185 |
| 1235 | | *Oryza sativa* | PRT | G912 | 185 |
| 1236 | | *Oryza sativa* | PRT | G912 | 185 |
| 1237 | | *Glycine max* | PRT | G912 | 185 |
| 1238 | | *Glycine max* | PRT | G912 | 185 |
| 1239 | | *Glycine max* | PRT | G912 | 185 |
| 1240 | | *Glycine max* | PRT | G912 | 185 |
| 1241 | | *Glycine max* | PRT | G912 | 185 |
| 1242 | | *Glycine max* | PRT | G912 | 185 |
| 1243 | | *Glycine max* | PRT | G912 | 185 |
| 1244 | | *Zea mays* | PRT | G912 | 185 |
| 1245 | | *Zea mays* | PRT | G912 | 185 |
| 1246 | | *Zea mays* | PRT | G912 | 185 |
| 1247 | | *Zea mays* | PRT | G912 | 185 |
| 1248 | | *Zea mays* | PRT | G912 | 185 |
| 1249 | | *Glycine max* | DNA | G922 | 189 |
| 1250 | | *Glycine max* | DNA | G922 | 189 |
| 1251 | | *Glycine max* | DNA | G922 | 189 |
| 1252 | | *Oryza sativa* | DNA | G922 | 189 |
| 1253 | | *Oryza sativa* | DNA | G922 | 189 |
| 1254 | | *Oryza sativa* | PRT | G922 | 189 |
| 1255 | | *Oryza sativa* | PRT | G922 | 189 |
| 1256 | | *Oryza sativa* | PRT | G922 | 189 |
| 1257 | | *Oryza sativa* | PRT | G922 | 189 |
| 1258 | | *Glycine max* | DNA | G926 | 191 |
| 1259 | | *Glycine max* | DNA | G926 | 191 |
| 1260 | | *Oryza sativa* | DNA | G926 | 191 |
| 1261 | | *Oryza sativa* | DNA | G926 | 191 |
| 1262 | | *Zea mays* | DNA | G926 | 191 |
| 1263 | | *Brassica napus* | PRT | G926 | 191 |
| 1264 | | *Glycine max* | DNA | G961 | 193 |
| 1265 | | *Glycine max* | DNA | G961 | 193 |
| 1266 | | *Oryza sativa* | DNA | G961 | 193 |
| 1267 | | *Zea mays* | DNA | G961 | 193 |
| 1268 | | *Zea mays* | DNA | G961 | 193 |
| 1269 | | *Zea mays* | DNA | G961 | 193 |
| 1270 | | *Oryza sativa* | PRT | G961 | 193 |
| 1271 | | *Glycine max* | DNA | G974 | 197 |
| 1272 | | *Glycine max* | DNA | G974 | 197 |
| 1273 | | *Glycine max* | DNA | G974 | 197 |
| 1274 | | *Glycine max* | DNA | G974 | 197 |
| 1275 | | *Glycine max* | DNA | G974 | 197 |
| 1276 | | *Glycine max* | DNA | G974 | 197 |
| 1277 | | *Oryza sativa* | DNA | G974 | 197 |
| 1278 | | *Zea mays* | DNA | G974 | 197 |
| 1279 | | *Zea mays* | DNA | G974 | 197 |
| 1280 | | *Zea mays* | DNA | G974 | 197 |
| 1281 | | *Zea mays* | DNA | G974 | 197 |
| 1282 | | *Lycopersicon esculentum* | DNA | G974 | 197 |
| 1283 | | *Glycine max* | DNA | G974 | 197 |
| 1284 | | *Solanum tuberosum* | DNA | G974 | 197 |
| 1285 | | *Poplar xylem* | DNA | G974 | 197 |
| 1286 | | *Medicago truncatula* | DNA | G974 | 197 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1287 | | Sorghum bicolor | DNA | G974 | 197 |
| 1288 | | Oryza sativa | PRT | G974 | 197 |
| 1289 | | Oryza sativa | PRT | G974 | 197 |
| 1290 | | Oryza sativa | PRT | G974 | 197 |
| 1291 | | Atriplex hortensis | PRT | G974 | 197 |
| 1292 | | Glycine max | DNA | G975, G2583 | 199, 449 |
| 1293 | | Glycine max | DNA | G975, G2583 | 199, 449 |
| 1294 | | Glycine max | DNA | G975, G2583 | 199, 449 |
| 1295 | | Glycine max | DNA | G975, G2583 | 199, 449 |
| 1296 | | Glycine max | DNA | G975, G2583 | 199, 449 |
| 1297 | | Oryza sativa | DNA | G975 | 199 |
| 1298 | | Oryza sativa | DNA | G975, G2583 | 199, 449 |
| 1299 | | Zea mays | DNA | G975, G2583 | 199, 449 |
| 1300 | | Zea mays | DNA | G975, G2583 | 199, 449 |
| 1301 | | Brassica rapa | DNA | G975, G2583 | 199, 449 |
| 1302 | | Oryza sativa | PRT | G975, G2583 | 199, 449 |
| 1303 | | Glycine max | DNA | G979 | 201 |
| 1304 | | Glycine max | DNA | G979 | 201 |
| 1305 | | Glycine max | DNA | G979 | 201 |
| 1306 | | Oryza sativa | DNA | G979 | 201 |
| 1307 | | Zea mays | DNA | G979 | 201 |
| 1308 | | Zea mays | DNA | G979 | 201 |
| 1309 | | Zea mays | DNA | G979 | 201 |
| 1310 | | Oryza sativa | PRT | G979 | 201 |
| 1311 | | Oryza sativa | PRT | G979 | 201 |
| 1312 | | Oryza sativa | PRT | G979 | 201 |
| 1313 | | Oryza sativa | PRT | G979 | 201 |
| 1314 | | Oryza sativa | PRT | G979 | 201 |
| 1315 | | Glycine max | DNA | G987 | 203 |
| 1316 | | Glycine max | DNA | G987 | 203 |
| 1317 | | Glycine max | DNA | G987 | 203 |
| 1318 | | Glycine max | DNA | G987 | 203 |
| 1319 | | Glycine max | DNA | G987 | 203 |
| 1320 | | Glycine max | DNA | G987 | 203 |
| 1321 | | Oryza sativa | DNA | G987 | 203 |
| 1322 | | Oryza sativa | DNA | G987 | 203 |
| 1323 | | Zea mays | DNA | G987 | 203 |
| 1324 | | Oryza sativa | PRT | G987 | 203 |
| 1325 | | Oryza sativa | PRT | G988 | 205 |
| 1326 | | Oryza sativa | PRT | G988 | 205 |
| 1327 | | Capsella rubella | PRT | G988 | 205 |
| 1328 | | Glycine max | DNA | G1040 | 207 |
| 1329 | | Glycine max | DNA | G1040 | 207 |
| 1330 | | Glycine max | DNA | G1040 | 207 |
| 1331 | | Glycine max | DNA | G1040 | 207 |
| 1332 | | Glycine max | DNA | G1040 | 207 |
| 1333 | | Zea mays | DNA | G1040 | 207 |
| 1334 | | Zea mays | DNA | G1040 | 207 |
| 1335 | | Zea mays | DNA | G1040 | 207 |
| 1336 | | Zea mays | DNA | G1040 | 207 |
| 1337 | | Zea mays | DNA | G1040 | 207 |
| 1338 | | Oryza sativa | PRT | G1040 | 207 |
| 1339 | | Oryza sativa | PRT | G1040 | 207 |
| 1340 | | Glycine max | DNA | G1047 | 209 |
| 1341 | | Zea mays | DNA | G1047 | 209 |
| 1342 | | Oryza sativa | PRT | G1047 | 209 |
| 1343 | | Oryza sativa | PRT | G1047 | 209 |
| 1344 | | Glycine max | DNA | G1051, G1052 | 211, 213 |
| 1345 | | Glycine max | DNA | G1051, G1052 | 211, 213 |
| 1346 | | Glycine max | DNA | G1051, G1052 | 211, 213 |
| 1347 | | Glycine max | DNA | G1051, G1052 | 211, 213 |
| 1348 | | Glycine max | DNA | G1051, G1052 | 211, 213 |
| 1349 | | Glycine max | DNA | G1051, G1052 | 211, 213 |
| 1350 | | Glycine max | DNA | G1051, G1052 | 211, 213 |
| 1351 | | Oryza sativa | DNA | G1051, G1052 | 211, 213 |
| 1352 | | Zea mays | DNA | G1051, G1052 | 211, 213 |
| 1353 | | Zea mays | DNA | G1051, G1052 | 211, 213 |
| 1354 | | Zea mays | DNA | G1051, G1052 | 211, 213 |
| 1355 | | Zea mays | DNA | G1051, G1052 | 211, 213 |
| 1356 | | Zea mays | DNA | G1051, G1052 | 211, 213 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1357 | | Zea mays | DNA | G1051, G1052 | 211, 213 |
| 1358 | | Zea mays | DNA | G1051, G1052 | 211, 213 |
| 1359 | | Oryza sativa | DNA | G1052 | 213 |
| 1360 | | Zea mays | DNA | G1052 | 213 |
| 1361 | | Zea mays | DNA | G1052 | 213 |
| 1362 | | Oryza sativa | PRT | G1051, G1052 | 211, 213 |
| 1363 | | Oryza sativa | PRT | G1051, G1052 | 211, 213 |
| 1364 | | Oryza sativa | PRT | G1051, G1052 | 211, 213 |
| 1365 | | Glycine max | DNA | G1062 | 215 |
| 1366 | | Glycine max | DNA | G1062 | 215 |
| 1367 | | Glycine max | DNA | G1062 | 215 |
| 1368 | | Glycine max | DNA | G1062 | 215 |
| 1369 | | Oryza sativa | DNA | G1062 | 215 |
| 1370 | | Oryza sativa | DNA | G1062 | 215 |
| 1371 | | Zea mays | DNA | G1062 | 215 |
| 1372 | | Zea mays | DNA | G1062 | 215 |
| 1373 | | Zea mays | DNA | G1062 | 215 |
| 1374 | | Zea mays | DNA | G1062 | 215 |
| 1375 | | Zea mays | DNA | G1062 | 215 |
| 1376 | | Medicago truncatula | DNA | G1062 | 215 |
| 1377 | | Lycopersicon esculentum | DNA | G1062 | 215 |
| 1378 | | Oryza sativa | PRT | G1062 | 215 |
| 1379 | | Glycine max | DNA | G1063, G2143 | 217, 413 |
| 1380 | | Glycine max | DNA | G1063, G2143 | 217, 413 |
| 1381 | | Glycine max | DNA | G1063, G2143 | 217, 413 |
| 1382 | | Glycine max | DNA | G1063, G2143 | 217, 413 |
| 1383 | | Glycine max | DNA | G1063, G2143 | 217, 413 |
| 1384 | | Lycopersicon esculentum | DNA | G1063, G2143 | 217, 413 |
| 1385 | | Glycine max | DNA | G1064 | 219 |
| 1386 | | Glycine max | DNA | G1064 | 219 |
| 1387 | | Glycine max | DNA | G1064 | 219 |
| 1388 | | Zea mays | DNA | G1064 | 219 |
| 1389 | | Zea mays | DNA | G1064 | 219 |
| 1390 | | Lycopersicon esculentum | DNA | G1064 | 219 |
| 1391 | | Oryza sativa | PRT | G1064 | 219 |
| 1392 | | Gossypium hirsutum | PRT | G1064 | 219 |
| 1393 | | Glycine max | DNA | G1069 | 221 |
| 1394 | | Glycine max | DNA | G1069 | 221 |
| 1395 | | Oryza sativa | PRT | G1069, G1073 | 221, 223 |
| 1396 | | Zea mays | DNA | G1069 | 221 |
| 1397 | | Lotus japonicus | DNA | G1069 | 221 |
| 1398 | | Lycopersicon esculentum | DNA | G1073 | 223 |
| 1399 | | Oryza sativa | PRT | G1073 | 223 |
| 1400 | | Oryza sativa | PRT | G1073 | 223 |
| 1401 | | Oryza sativa | PRT | G1073 | 223 |
| 1402 | | Oryza sativa | PRT | G1073 | 223 |
| 1403 | | Oryza sativa | PRT | G1073 | 223 |
| 1404 | | Oryza sativa | PRT | G1073 | 223 |
| 1405 | | Oryza sativa | PRT | G1073 | 223 |
| 1406 | | Oryza sativa | PRT | G1073 | 223 |
| 1407 | | Oryza sativa | PRT | G1073 | 223 |
| 1408 | | Oryza sativa | PRT | G1073 | 223 |
| 1409 | | Oryza sativa | PRT | G1073 | 223 |
| 1410 | | Oryza sativa | PRT | G1073 | 223 |
| 1411 | | Glycine max | PRT | G1073 | 223 |
| 1412 | | Glycine max | PRT | G1073 | 223 |
| 1413 | | Glycine max | PRT | G1073 | 223 |
| 1414 | | Glycine max | PRT | G1073 | 223 |
| 1415 | | Glycine max | PRT | G1073 | 223 |
| 1416 | | Glycine max | PRT | G1073 | 223 |
| 1417 | | Glycine max | PRT | G1073 | 223 |
| 1418 | | Zea mays | PRT | G1073 | 223 |
| 1419 | | Glycine max | DNA | G1075 | 225 |
| 1420 | | Glycine max | DNA | G1075 | 225 |
| 1421 | | Glycine max | DNA | G1075 | 225 |
| 1422 | | Glycine max | DNA | G1075 | 225 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1423 | | *Glycine max* | DNA | G1075 | 225 |
| 1424 | | *Oryza sativa* | DNA | G1075 | 225 |
| 1425 | | *Oryza sativa* | DNA | G1075 | 225 |
| 1426 | | *Oryza sativa* | DNA | G1075 | 225 |
| 1427 | | *Oryza sativa* | DNA | G1089 | 229 |
| 1428 | | *Zea mays* | DNA | G1089 | 229 |
| 1429 | | *Zea mays* | DNA | G1089 | 229 |
| 1430 | | *Zea mays* | DNA | G1089 | 229 |
| 1431 | | *Zea mays* | DNA | G1089 | 229 |
| 1432 | | *Zea mays* | DNA | G1089 | 229 |
| 1433 | | *Oryza sativa* | PRT | G1089 | 229 |
| 1434 | | *Glycine max* | DNA | G1134, G2555 | 231, 445 |
| 1435 | | *Glycine max* | DNA | G1134, G2555 | 231, 445 |
| 1436 | | *Oryza sativa* | DNA | G1134, G2555 | 231, 445 |
| 1437 | | *Glycine max* | DNA | G1140 | 233 |
| 1438 | | *Glycine max* | DNA | G1140 | 233 |
| 1439 | | *Glycine max* | DNA | G1140 | 233 |
| 1440 | | *Glycine max* | DNA | G1140 | 233 |
| 1441 | | *Glycine max* | DNA | G1140 | 233 |
| 1442 | | *Glycine max* | DNA | G1140 | 233 |
| 1443 | | *Oryza sativa* | DNA | G1140 | 233 |
| 1444 | | *Zea mays* | DNA | G1140 | 233 |
| 1445 | | *Zea mays* | DNA | G1140 | 233 |
| 1446 | | *Zea mays* | DNA | G1140 | 233 |
| 1447 | | *Zea mays* | DNA | G1140 | 233 |
| 1448 | | *Zea mays* | DNA | G1140 | 233 |
| 1449 | | *Zea mays* | DNA | G1140 | 233 |
| 1450 | | *Zea mays* | DNA | G1140 | 233 |
| 1451 | | *Zea mays* | DNA | G1140 | 233 |
| 1452 | | *Zea mays* | DNA | G1140 | 233 |
| 1453 | | *Oryza sativa* | PRT | G1140 | 233 |
| 1454 | | *Ipomoea batatas* | PRT | G1140 | 233 |
| 1455 | | *Zea mays* | DNA | G1146 | 237 |
| 1456 | | *Zea mays* | DNA | G1146 | 237 |
| 1457 | | *Oryza sativa* | PRT | G1146 | 237 |
| 1458 | | *Oryza sativa* | PRT | G1146 | 237 |
| 1459 | | *Oryza sativa* | PRT | G1146 | 237 |
| 1460 | | *Glycine max* | DNA | G1196 | 239 |
| 1461 | | *Glycine max* | DNA | G1196 | 239 |
| 1462 | | *Glycine max* | DNA | G1196 | 239 |
| 1463 | | *Oryza sativa* | DNA | G1196 | 239 |
| 1464 | | *Zea mays* | DNA | G1196 | 239 |
| 1465 | | *Zea mays* | DNA | G1196 | 239 |
| 1466 | | *Oryza sativa* | PRT | G1196 | 239 |
| 1467 | | *Oryza sativa* | PRT | G1196 | 239 |
| 1468 | | *Glycine max* | DNA | G1198 | 241 |
| 1469 | | *Glycine max* | DNA | G1198 | 241 |
| 1470 | | *Glycine max* | DNA | G1198 | 241 |
| 1471 | | *Glycine max* | DNA | G1198 | 241 |
| 1472 | | *Glycine max* | DNA | G1198 | 241 |
| 1473 | | *Glycine max* | DNA | G1198 | 241 |
| 1474 | | *Glycine max* | DNA | G1198 | 241 |
| 1475 | | *Glycine max* | DNA | G1198 | 241 |
| 1476 | | *Oryza sativa* | DNA | G1198 | 241 |
| 1477 | | *Oryza sativa* | DNA | G1198 | 241 |
| 1478 | | *Oryza sativa* | DNA | G1198 | 241 |
| 1479 | | *Oryza sativa* | DNA | G1198 | 241 |
| 1480 | | *Oryza sativa* | DNA | G1198 | 241 |
| 1481 | | *Zea mays* | DNA | G1198 | 241 |
| 1482 | | *Zea mays* | DNA | G1198 | 241 |
| 1483 | | *Zea mays* | DNA | G1198 | 241 |
| 1484 | | *Zea mays* | DNA | G1198 | 241 |
| 1485 | | *Zea mays* | DNA | G1198 | 241 |
| 1486 | | *Zea mays* | DNA | G1198 | 241 |
| 1487 | | *Zea mays* | DNA | G1198 | 241 |
| 1488 | | *Zea mays* | DNA | G1198 | 241 |
| 1489 | | *Zea mays* | DNA | G1198 | 241 |
| 1490 | | *Zea mays* | DNA | G1198 | 241 |
| 1491 | | *Nicotiana tabacum* | DNA | G1198 | 241 |
| 1492 | | *Oryza sativa* | PRT | G1198 | 241 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1493 | | *Oryza sativa* | PRT | G1198 | 241 |
| 1494 | | *Oryza sativa* | PRT | G1198 | 241 |
| 1495 | | *Oryza sativa* | PRT | G1198 | 241 |
| 1496 | | *Oryza sativa* | PRT | G1198 | 241 |
| 1497 | | *Oryza sativa* | PRT | G1198 | 241 |
| 1498 | | *Oryza sativa* | PRT | G1198 | 241 |
| 1499 | | *Zea mays* | DNA | G1225 | 243 |
| 1500 | | *Oryza sativa* | PRT | G1225 | 243 |
| 1501 | | *Oryza sativa* | PRT | G1226 | 245 |
| 1502 | | *Glycine max* | DNA | G1229 | 247 |
| 1503 | | *Oryza sativa* | PRT | G1229 | 247 |
| 1504 | | *Oryza sativa* | PRT | G1229 | 247 |
| 1505 | | *Glycine max* | DNA | G1255 | 249 |
| 1506 | | *Glycine max* | DNA | G1255 | 249 |
| 1507 | | *Glycine max* | DNA | G1255 | 249 |
| 1508 | | *Glycine max* | DNA | G1255 | 249 |
| 1509 | | *Glycine max* | DNA | G1255 | 249 |
| 1510 | | *Glycine max* | DNA | G1255 | 249 |
| 1511 | | *Glycine max* | DNA | G1255 | 249 |
| 1512 | | *Oryza sativa* | DNA | G1255 | 249 |
| 1513 | | *Oryza sativa* | DNA | G1255 | 249 |
| 1514 | | *Oryza sativa* | DNA | G1255 | 249 |
| 1515 | | *Oryza sativa* | DNA | G1255 | 249 |
| 1516 | | *Zea mays* | DNA | G1255 | 249 |
| 1517 | | *Zea mays* | DNA | G1255 | 249 |
| 1518 | | *Zea mays* | DNA | G1255 | 249 |
| 1519 | | *Zea mays* | DNA | G1255 | 249 |
| 1520 | | *Zea mays* | DNA | G1255 | 249 |
| 1521 | | *Zea mays* | DNA | G1255 | 249 |
| 1522 | | *Oryza sativa* | PRT | G1255 | 249 |
| 1523 | | *Glycine max* | DNA | G1266 | 251 |
| 1524 | | *Glycine max* | DNA | G1266 | 251 |
| 1525 | | *Glycine max* | DNA | G1266 | 251 |
| 1526 | | *Glycine max* | DNA | G1266 | 251 |
| 1527 | | *Oryza sativa* | DNA | G1266 | 251 |
| 1528 | | *Nicotiana tabacum* | PRT | G1266 | 251 |
| 1529 | | *Oryza sativa* | DNA | G1275 | 253 |
| 1530 | | *Zea mays* | DNA | G1275 | 253 |
| 1531 | | *Zea mays* | DNA | G1275 | 253 |
| 1532 | | *Zea mays* | DNA | G1275 | 253 |
| 1533 | | *Oryza sativa* | PRT | G1275 | 253 |
| 1534 | | *Oryza sativa* | PRT | G1275 | 253 |
| 1535 | | *Oryza sativa* | PRT | G1275 | 253 |
| 1536 | | *Glycine max* | DNA | G1322 | 257 |
| 1537 | | *Glycine max* | DNA | G1322 | 257 |
| 1538 | | *Glycine max* | DNA | G1322 | 257 |
| 1539 | | *Oryza sativa* | DNA | G1322 | 257 |
| 1540 | | *Oryza sativa* | PRT | G1322 | 257 |
| 1541 | | *Oryza sativa* | PRT | G1322 | 257 |
| 1542 | | *Zea mays* | DNA | G1323 | 259 |
| 1543 | | *Zea mays* | DNA | G1323 | 259 |
| 1544 | | *Glycine max* | DNA | G1330 | 261 |
| 1545 | | *Glycine max* | DNA | G1330 | 261 |
| 1546 | | *Glycine max* | DNA | G1330 | 261 |
| 1547 | | *Glycine max* | DNA | G1330 | 261 |
| 1548 | | *Glycine max* | DNA | G1330 | 261 |
| 1549 | | *Glycine max* | DNA | G1330 | 261 |
| 1550 | | *Glycine max* | DNA | G1330 | 261 |
| 1551 | | *Oryza sativa* | DNA | G1330 | 261 |
| 1552 | | *Oryza sativa* | DNA | G1330 | 261 |
| 1553 | | *Oryza sativa* | DNA | G1330 | 261 |
| 1554 | | *Oryza sativa* | DNA | G1330 | 261 |
| 1555 | | *Zea mays* | DNA | G1330 | 261 |
| 1556 | | *Zea mays* | DNA | G1330 | 261 |
| 1557 | | *Zea mays* | DNA | G1330 | 261 |
| 1558 | | *Zea mays* | DNA | G1330 | 261 |
| 1559 | | *Zea mays* | DNA | G1330 | 261 |
| 1560 | | *Zea mays* | DNA | G1330 | 261 |
| 1561 | | *Zea mays* | DNA | G1330 | 261 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1562 | | *Lycopersicon esculentum* | DNA | G1330 | 261 |
| 1563 | | *Oryza sativa* | PRT | G1330 | 261 |
| 1564 | | *Oryza sativa* | PRT | G1330 | 261 |
| 1565 | | *Oryza sativa* | PRT | G1330 | 261 |
| 1566 | | *Oryza sativa* | PRT | G1330 | 261 |
| 1567 | | *Glycine max* | DNA | G1331 | 263 |
| 1568 | | *Glycine max* | DNA | G1331 | 263 |
| 1569 | | *Oryza sativa* | DNA | G1331 | 263 |
| 1570 | | *Zea mays* | DNA | G1331 | 263 |
| 1571 | | *Zea mays* | DNA | G1331 | 263 |
| 1572 | | *Oryza sativa* | PRT | G1331 | 263 |
| 1573 | | *Glycine max* | DNA | G1363 | 267 |
| 1574 | | *Oryza sativa* | DNA | G1363 | 267 |
| 1575 | | *Oryza sativa* | DNA | G1363 | 267 |
| 1576 | | *Oryza sativa* | DNA | G1363 | 267 |
| 1577 | | *Oryza sativa* | DNA | G1363 | 267 |
| 1578 | | *Zea mays* | DNA | G1363 | 267 |
| 1579 | | *Zea mays* | DNA | G1363 | 267 |
| 1580 | | *Zea mays* | DNA | G1363 | 267 |
| 1581 | | *Zea mays* | DNA | G1363 | 267 |
| 1582 | | *Zea mays* | DNA | G1363 | 267 |
| 1583 | | *Oryza sativa* | PRT | G1363 | 267 |
| 1584 | | *Oryza sativa* | PRT | G1363 | 267 |
| 1585 | | *Oryza sativa* | PRT | G1363 | 267 |
| 1586 | | *Oryza sativa* | PRT | G1363 | 267 |
| 1587 | | *Glycine max* | DNA | G1411, G2509 | 269, 439 |
| 1588 | | *Glycine max* | DNA | G1411, G2509 | 269, 439 |
| 1589 | | *Glycine max* | DNA | G1411, G2509 | 269, 439 |
| 1590 | | *Glycine max* | DNA | G1411, G2509 | 269, 439 |
| 1591 | | *Zea mays* | DNA | G1411, G2509 | 269, 439 |
| 1592 | | *Glycine max* | DNA | G1417 | 271 |
| 1593 | | *Oryza sativa* | PRT | G1417 | 271 |
| 1594 | | *Oryza sativa* | PRT | G1417 | 271 |
| 1595 | | *Glycine max* | DNA | G1419 | 273 |
| 1596 | | *Glycine max* | DNA | G1449 | 275 |
| 1597 | | *Glycine max* | DNA | G1449 | 275 |
| 1598 | | *Oryza sativa* | DNA | G1449 | 275 |
| 1599 | | *Oryza sativa* | DNA | G1449 | 275 |
| 1600 | | *Zea mays* | DNA | G1449 | 275 |
| 1601 | | *Zea mays* | DNA | G1449 | 275 |
| 1602 | | *Zea mays* | DNA | G1449 | 275 |
| 1603 | | *Zea mays* | DNA | G1449 | 275 |
| 1604 | | *Glycine max* | DNA | G1451 | 277 |
| 1605 | | *Glycine max* | DNA | G1451 | 277 |
| 1606 | | *Oryza sativa* | DNA | G1451 | 277 |
| 1607 | | *Oryza sativa* | DNA | G1451 | 277 |
| 1608 | | *Oryza sativa* | DNA | G1451 | 277 |
| 1609 | | *Zea mays* | DNA | G1451 | 277 |
| 1610 | | *Zea mays* | DNA | G1451 | 277 |
| 1611 | | *Zea mays* | DNA | G1451 | 277 |
| 1612 | | *Zea mays* | DNA | G1451 | 277 |
| 1613 | | *Medicago truncatula* | DNA | G1451 | 277 |
| 1614 | | *Solanum tuberosum* | DNA | G1451 | 277 |
| 1615 | | *Zea mays* | DNA | G1451 | 277 |
| 1616 | | *Sorghum propinquum* | DNA | G1451 | 277 |
| 1617 | | *Glycine max* | DNA | G1451 | 277 |
| 1618 | | *Sorghum bicolor* | DNA | G1451 | 277 |
| 1619 | | *Hordeum vulgare* | DNA | G1451 | 277 |
| 1620 | | *Lycopersicon esculentum* | DNA | G1451 | 277 |
| 1621 | | *Oryza sativa* | PRT | G1451 | 277 |
| 1622 | | *Oryza sativa* | PRT | G1451 | 277 |
| 1623 | | *Oryza sativa* | PRT | G1451 | 277 |
| 1624 | | *Oryza sativa* | PRT | G1451 | 277 |
| 1625 | | *Glycine max* | DNA | G1452 | 279 |
| 1626 | | *Glycine max* | DNA | G1478 | 285 |
| 1627 | | *Glycine max* | DNA | G1478 | 285 |
| 1628 | | *Glycine max* | DNA | G1478 | 285 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1629 | | Zea mays | DNA | G1478 | 285 |
| 1630 | | Glycine max | DNA | G1482 | 287 |
| 1631 | | Glycine max | DNA | G1482 | 287 |
| 1632 | | Glycine max | DNA | G1482 | 287 |
| 1633 | | Glycine max | DNA | G1482 | 287 |
| 1634 | | Glycine max | DNA | G1482 | 287 |
| 1635 | | Oryza sativa | DNA | G1482 | 287 |
| 1636 | | Oryza sativa | DNA | G1482 | 287 |
| 1637 | | Oryza sativa | DNA | G1482 | 287 |
| 1638 | | Oryza sativa | DNA | G1482 | 287 |
| 1639 | | Zea mays | DNA | G1482 | 287 |
| 1640 | | Zea mays | DNA | G1482 | 287 |
| 1641 | | Zea mays | DNA | G1482 | 287 |
| 1642 | | Zea mays | DNA | G1482 | 287 |
| 1643 | | Zea mays | DNA | G1482 | 287 |
| 1644 | | Zea mays | DNA | G1482 | 287 |
| 1645 | | Oryza sativa | PRT | G1482 | 287 |
| 1646 | | Oryza sativa | PRT | G1482 | 287 |
| 1647 | | Glycine max | DNA | G1488 | 289 |
| 1648 | | Glycine max | DNA | G1488 | 289 |
| 1649 | | Glycine max | DNA | G1488 | 289 |
| 1650 | | Oryza sativa | DNA | G1488 | 289 |
| 1651 | | Oryza sativa | DNA | G1488 | 289 |
| 1652 | | Zea mays | DNA | G1488 | 289 |
| 1653 | | Zea mays | DNA | G1488 | 289 |
| 1654 | | Zea mays | DNA | G1488 | 289 |
| 1655 | | Oryza sativa | PRT | G1488 | 289 |
| 1656 | | Oryza sativa | PRT | G1488 | 289 |
| 1657 | | Oryza sativa | PRT | G1488 | 289 |
| 1658 | | Oryza sativa | PRT | G1499 | 295 |
| 1659 | | Brassica rapa subsp. pekinensis | DNA | G1499 | 295 |
| 1660 | | Glycine max | DNA | G1519 | 297 |
| 1661 | | Oryza sativa | DNA | G1519 | 297 |
| 1662 | | Zea mays | DNA | G1519 | 297 |
| 1663 | | Zea mays | DNA | G1519 | 297 |
| 1664 | | Lycopersicon esculentum | DNA | G1519 | 297 |
| 1665 | | Glycine max | DNA | G1526 | 2199 |
| 1666 | | Oryza sativa | DNA | G1526 | 299 |
| 1667 | | Oryza sativa | DNA | G1526 | 299 |
| 1668 | | Zea mays | DNA | G1526 | 299 |
| 1669 | | Glycine max | DNA | G1540 | 301 |
| 1670 | | Oryza sativa | PRT | G1540 | 301 |
| 1671 | | Glycine max | DNA | G1543 | 303 |
| 1672 | | Oryza sativa | DNA | G1543 | 303 |
| 1673 | | Zea mays | DNA | G1543 | 303 |
| 1674 | | Oryza sativa | PRT | G1543 | 303 |
| 1675 | | Zea mays | DNA | G1637 | 307 |
| 1676 | | Zea mays | DNA | G1637 | 307 |
| 1677 | | Zea mays | DNA | G1637 | 307 |
| 1678 | | Glycine max | DNA | G1640 | 309 |
| 1679 | | Glycine max | DNA | G1640 | 309 |
| 1680 | | Glycine max | DNA | G1640 | 309 |
| 1681 | | Oryza sativa | PRT | G1640 | 309 |
| 1682 | | Zea mays | DNA | G1645 | 311 |
| 1683 | | Zea mays | DNA | G1645 | 311 |
| 1684 | | Zea mays | DNA | G1645 | 311 |
| 1685 | | Lycopersicon esculentum | DNA | G1645 | 311 |
| 1686 | | Medicago truncatula | DNA | G1645 | 311 |
| 1687 | | Oryza sativa | PRT | G1645 | 311 |
| 1688 | | Oryza sativa | DNA | G1646 | 313 |
| 1689 | | Oryza sativa | DNA | G1646 | 313 |
| 1690 | | Glycine max | DNA | G1652 | 315 |
| 1691 | | Glycine max | DNA | G1652 | 315 |
| 1692 | | Glycine max | DNA | G1652 | 315 |
| 1693 | | Glycine max | DNA | G1652 | 315 |
| 1694 | | Glycine max | DNA | G1652 | 315 |
| 1695 | | Glycine max | DNA | G1652 | 315 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1696 | | *Glycine max* | DNA | G1652 | 315 |
| 1697 | | *Glycine max* | DNA | G1652 | 315 |
| 1698 | | *Oryza sativa* | DNA | G1652 | 315 |
| 1699 | | *Zea mays* | DNA | G1652 | 315 |
| 1700 | | *Zea mays* | DNA | G1652 | 315 |
| 1701 | | *Oryza sativa* | PRT | G1652 | 315 |
| 1702 | | *Oryza sativa* | PRT | G1652 | 315 |
| 1703 | | *Oryza sativa* | PRT | G1652 | 315 |
| 1704 | | *Oryza sativa* | PRT | G1652 | 315 |
| 1705 | | *Oryza sativa* | PRT | G1652 | 315 |
| 1706 | | *Glycine max* | DNA | G1672 | 317 |
| 1707 | | *Oryza sativa* | DNA | G1672 | 317 |
| 1708 | | *Zea mays* | DNA | G1672 | 317 |
| 1709 | | *Zea mays* | DNA | G1672 | 317 |
| 1710 | | *Oryza sativa* | PRT | G1672 | 317 |
| 1711 | | *Oryza sativa* | PRT | G1672 | 317 |
| 1712 | | *Oryza sativa* | PRT | G1672 | 317 |
| 1713 | | *Oryza sativa* | PRT | G1672 | 317 |
| 1714 | | *Glycine max* | DNA | G1750 | 323 |
| 1715 | | *Glycine max* | DNA | G1750 | 323 |
| 1716 | | *Glycine max* | DNA | G1750 | 323 |
| 1717 | | *Glycine max* | DNA | G1750 | 323 |
| 1718 | | *Oryza sativa* | DNA | G1750 | 323 |
| 1719 | | *Zea mays* | DNA | G1750 | 323 |
| 1720 | | *Zea mays* | DNA | G1750 | 323 |
| 1721 | | *Glycine max* | DNA | G1756 | 325 |
| 1722 | | *Medicago truncatula* | DNA | G1765 | 327 |
| 1723 | | *Glycine max* | DNA | G1777 | 329 |
| 1724 | | *Oryza sativa* | DNA | G1777 | 329 |
| 1725 | | *Zea mays* | DNA | G1777 | 329 |
| 1726 | | *Zea mays* | DNA | G1777 | 329 |
| 1727 | | *Oryza sativa* | PRT | G1777 | 329 |
| 1728 | | *Glycine max* | DNA | G1792 | 331 |
| 1729 | | *Glycine max* | DNA | G1792 | 331 |
| 1730 | | *Glycine max* | DNA | G1792 | 331 |
| 1731 | | *Glycine max* | DNA | G1792 | 331 |
| 1732 | | *Glycine max* | DNA | G1792 | 331 |
| 1733 | | *Zea mays* | DNA | G1792 | 331 |
| 1734 | | *Lycopersicon esculentum* | DNA | G1792 | 331 |
| 1735 | G3380 | *Oryza sativa* | PRT | G1792 | 331 |
| 1736 | G3381 | *Oryza sativa indica* | PRT | G1792 | 331 |
| 1737 | G3383 | *Oryza sativa japonica* | PRT | G1792 | 331 |
| 1738 | | *Glycine max* | DNA | G1793 | 333 |
| 1739 | | *Oryza sativa* | DNA | G1793 | 333 |
| 1740 | | *Zea mays* | DNA | G1793 | 333 |
| 1741 | | *Zea mays* | DNA | G1793 | 333 |
| 1742 | | *Zea mays* | DNA | G1793 | 333 |
| 1743 | | *Oryza sativa* | PRT | G1793 | 333 |
| 1744 | | *Glycine max* | DNA | G1794 | 335 |
| 1745 | | *Glycine max* | DNA | G1794 | 335 |
| 1746 | | *Glycine max* | DNA | G1794 | 335 |
| 1747 | | *Glycine max* | DNA | G1794 | 335 |
| 1748 | | *Glycine max* | DNA | G1794 | 335 |
| 1749 | | *Glycine max* | DNA | G1794 | 335 |
| 1750 | | *Glycine max* | DNA | G1794 | 335 |
| 1751 | | *Zea mays* | DNA | G1794 | 335 |
| 1752 | | *Zea mays* | DNA | G1794 | 335 |
| 1753 | | *Zea mays* | DNA | G1794 | 335 |
| 1754 | | *Oryza sativa* | PRT | G1794 | 335 |
| 1755 | | *Oryza sativa* | PRT | G1794 | 335 |
| 1756 | | *Oryza sativa* | PRT | G1794 | 335 |
| 1757 | | *Glycine max* | DNA | G1804 | 337 |
| 1758 | | *Glycine max* | DNA | G1804 | 337 |
| 1759 | | *Glycine max* | DNA | G1804 | 337 |
| 1760 | | *Oryza sativa* | DNA | G1804 | 337 |
| 1761 | | *Oryza sativa* | PRT | G1804 | 337 |
| 1762 | | *Helianthus annuus* | PRT | G1804 | 337 |
| 1763 | | *Glycine max* | DNA | G1838 | 345 |
| 1764 | | *Glycine max* | DNA | G1838 | 345 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1765 | | *Oryza sativa* | PRT | G1838 | 345 |
| 1766 | | *Glycine max* | DNA | G1841 | 347 |
| 1767 | | *Glycine max* | DNA | G1841 | 347 |
| 1768 | | *Oryza sativa* | DNA | G1841 | 347 |
| 1769 | | *Oryza sativa* | PRT | G1841 | 347 |
| 1770 | | *Solanum tuberosum* | DNA | G1852 | 353 |
| 1771 | | *Gossypium arboreum* | DNA | G1852 | 353 |
| 1772 | | *Medicago truncatula* | DNA | G1852 | 353 |
| 1773 | | *Glycine max* | DNA | G1852 | 353 |
| 1774 | | *Lycopersicon esculentum* | DNA | G1852 | 353 |
| 1775 | | *Pinus taeda* | DNA | G1852 | 353 |
| 1776 | | *Lotus japonicus* | DNA | G1852 | 353 |
| 1777 | | *Gossypium hirsutum* | DNA | G1852 | 353 |
| 1778 | | *Solanum tuberosum* | DNA | G1863 | 355 |
| 1779 | | *Medicago truncatula* | DNA | G1863 | 355 |
| 1780 | | *Lycopersicon esculentum* | DNA | G1863 | 355 |
| 1781 | | *Oryza sativa* | PRT | G1863 | 355 |
| 1782 | | *Glycine max* | DNA | G1880 | 357 |
| 1783 | | *Glycine max* | DNA | G1880 | 357 |
| 1784 | | *Medicago truncatula* | DNA | G1880 | 357 |
| 1785 | | *Oryza sativa* | PRT | G1880 | 357 |
| 1786 | | *Glycine max* | DNA | G1902 | 361 |
| 1787 | | *Glycine max* | DNA | G1902 | 361 |
| 1788 | | *Glycine max* | DNA | G1902 | 361 |
| 1789 | | *Zea mays* | DNA | G1902 | 361 |
| 1790 | | *Oryza sativa* | PRT | G1902 | 361 |
| 1791 | | *Glycine max* | DNA | G1927 | 367 |
| 1792 | | *Oryza sativa* | DNA | G1927 | 367 |
| 1793 | | *Zea mays* | DNA | G1927 | 367 |
| 1794 | | *Lycopersicon esculentum* | DNA | G1927 | 367 |
| 1795 | | *Oryza sativa* | DNA | G1930 | 369 |
| 1796 | | *Glycine max* | DNA | G1944 | 373 |
| 1797 | | *Glycine max* | DNA | G1944 | 373 |
| 1798 | | *Zea mays* | DNA | G1944 | 373 |
| 1799 | | *Glycine max* | DNA | G1944 | 373 |
| 1800 | | *Glycine max* | DNA | G1944 | 373 |
| 1801 | | *Glycine max* | DNA | G1946 | 375 |
| 1802 | | *Glycine max* | DNA | G1946 | 375 |
| 1803 | | *Zea mays* | DNA | G1946 | 375 |
| 1804 | | *Zea mays* | DNA | G1946 | 375 |
| 1805 | | *Oryza sativa* | PRT | G1946 | 375 |
| 1806 | | *Glycine max* | DNA | G1948 | 379 |
| 1807 | | *Glycine max* | DNA | G1948 | 379 |
| 1808 | | *Oryza sativa* | DNA | G1948 | 379 |
| 1809 | | *Oryza sativa* | DNA | G1948 | 379 |
| 1810 | | *Zea mays* | DNA | G1948 | 379 |
| 1811 | | *Zea mays* | DNA | G1948 | 379 |
| 1812 | | *Zea mays* | DNA | G1948 | 379 |
| 1813 | | *Oryza sativa* | PRT | G1948 | 379 |
| 1814 | | *Glycine max* | DNA | G1950 | 381 |
| 1815 | | *Glycine max* | DNA | G1950 | 381 |
| 1816 | | *Glycine max* | DNA | G1950 | 381 |
| 1817 | | *Glycine max* | DNA | G1950 | 381 |
| 1818 | | *Glycine max* | DNA | G1950 | 381 |
| 1819 | | *Glycine max* | DNA | G1950 | 381 |
| 1820 | | *Oryza sativa* | DNA | G1950 | 381 |
| 1821 | | *Oryza sativa* | DNA | G1950 | 381 |
| 1822 | | *Oryza sativa* | DNA | G1950 | 381 |
| 1823 | | *Oryza sativa* | DNA | G1950 | 381 |
| 1824 | | *Oryza sativa* | DNA | G1950 | 381 |
| 1825 | | *Oryza sativa* | DNA | G1950 | 381 |
| 1826 | | *Oryza sativa* | DNA | G1950 | 381 |
| 1827 | | *Oryza sativa* | DNA | G1950 | 381 |
| 1828 | | *Oryza sativa* | DNA | G1950 | 381 |
| 1829 | | *Zea mays* | DNA | G1950 | 381 |
| 1830 | | *Zea mays* | DNA | G1950 | 381 |
| 1831 | | *Zea mays* | DNA | G1950 | 381 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1832 | | *Zea mays* | DNA | G1950 | 381 |
| 1833 | | *Zea mays* | DNA | G1950 | 381 |
| 1834 | | *Zea mays* | DNA | G1950 | 381 |
| 1835 | | *Zea mays* | DNA | G1950 | 381 |
| 1836 | | *Zea mays* | DNA | G1950 | 381 |
| 1837 | | *Zea mays* | DNA | G1950 | 381 |
| 1838 | | *Oryza sativa* | PRT | G1950 | 381 |
| 1839 | | *Oryza sativa* | PRT | G1950 | 381 |
| 1840 | | *Oryza sativa* | PRT | G1950 | 381 |
| 1841 | | *Oryza sativa* | PRT | G1950 | 381 |
| 1842 | | *Oryza sativa* | PRT | G1950 | 381 |
| 1843 | | *Oryza sativa* | PRT | G1950 | 381 |
| 1844 | | *Oryza sativa* | PRT | G1950 | 381 |
| 1845 | | *Oryza sativa* | PRT | G1950 | 381 |
| 1846 | | *Oryza sativa* | PRT | G1950 | 381 |
| 1847 | | *Glycine max* | DNA | G1958 | 383 |
| 1848 | | *Glycine max* | DNA | G1958 | 383 |
| 1849 | | *Glycine max* | DNA | G1958 | 383 |
| 1850 | | *Glycine max* | DNA | G1958 | 383 |
| 1851 | | *Glycine max* | DNA | G1958 | 383 |
| 1852 | | *Oryza sativa* | DNA | G1958 | 383 |
| 1853 | | *Oryza sativa* | DNA | G1958 | 383 |
| 1854 | | *Zea mays* | DNA | G1958 | 383 |
| 1855 | | *Zea mays* | DNA | G1958 | 383 |
| 1856 | | *Zea mays* | DNA | G1958 | 383 |
| 1857 | | *Nicotiana tabacum* | PRT | G1958 | 383 |
| 1858 | | *Glycine max* | DNA | G2007 | 385 |
| 1859 | | *Glycine max* | DNA | G2007 | 385 |
| 1860 | | *Zea mays* | DNA | G2007 | 385 |
| 1861 | | *Zea mays* | DNA | G2007 | 385 |
| 1862 | | *Zea mays* | DNA | G2007 | 385 |
| 1863 | | *Oryza sativa* | PRT | G2007 | 385 |
| 1864 | | *Glycine max* | DNA | G2010, G2347 | 387, 431 |
| 1865 | | *Oryza sativa* | DNA | G2010, G2347 | 387, 431 |
| 1866 | | *Zea mays* | DNA | G2010 | 387 |
| 1867 | | *Zea mays* | DNA | G2010, G2347 | 387, 431 |
| 1868 | | *Glycine max* | DNA | G2059 | 391 |
| 1869 | | *Glycine max* | DNA | G2085 | 393 |
| 1870 | | *Glycine max* | DNA | G2085 | 393 |
| 1871 | | *Glycine max* | DNA | G2085 | 393 |
| 1872 | | *Glycine max* | DNA | G2085 | 393 |
| 1873 | | *Zea mays* | DNA | G2085 | 393 |
| 1874 | | *Oryza sativa* | PRT | G2085 | 393 |
| 1875 | | *Oryza sativa* | PRT | G2105 | 395 |
| 1876 | | *Glycine max* | DNA | G2110 | 397 |
| 1877 | | *Oryza sativa* | DNA | G2114 | 399 |
| 1878 | | *Oryza sativa* | DNA | G2114 | 399 |
| 1879 | | *Zea mays* | DNA | G2114 | 399 |
| 1880 | | *Zea mays* | DNA | G2114 | 399 |
| 1881 | | *Oryza sativa* | DNA | G2117 | 401 |
| 1882 | | *Medicago truncatula* | DNA | G2130 | 405 |
| 1883 | | *Oryza sativa* | PRT | G2130 | 405 |
| 1884 | | *Oryza sativa* | PRT | G2130 | 405 |
| 1885 | | *Glycine max* | DNA | G2140 | 411 |
| 1886 | | *Glycine max* | DNA | G2140 | 411 |
| 1887 | | *Glycine max* | DNA | G2140 | 411 |
| 1888 | | *Glycine max* | DNA | G2140 | 411 |
| 1889 | | *Glycine max* | DNA | G2140 | 411 |
| 1890 | | *Glycine max* | DNA | G2140 | 411 |
| 1891 | | *Oryza sativa* | DNA | G2140 | 411 |
| 1892 | | *Oryza sativa* | DNA | G2140 | 411 |
| 1893 | | *Oryza sativa* | DNA | G2140 | 411 |
| 1894 | | *Oryza sativa* | DNA | G2140 | 411 |
| 1895 | | *Zea mays* | DNA | G2140 | 411 |
| 1896 | | *Lycopersicon esculentum* | DNA | G2140 | 411 |
| 1897 | | *Oryza sativa* | PRT | G2140 | 411 |
| 1898 | | *Oryza sativa* | PRT | G2140 | 411 |
| 1899 | | *Oryza sativa* | PRT | G2140 | 411 |
| 1900 | | *Oryza sativa* | PRT | G2140 | 411 |

TABLE 7-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1901 | | Oryza sativa | PRT | G2140 | 411 |
| 1902 | | Glycine max | DNA | G2143 | 413 |
| 1903 | | Glycine max | DNA | G2143 | 413 |
| 1904 | | Glycine max | DNA | G2144 | 415 |
| 1905 | | Glycine max | DNA | G2144 | 415 |
| 1906 | | Zea mays | DNA | G2144 | 415 |
| 1907 | | Zea mays | DNA | G2144 | 415 |
| 1908 | | Medicago truncatula | DNA | G2155 | 419 |
| 1909 | | Medicago truncatula | DNA | G2155 | 419 |
| 1910 | | Glycine max | DNA | G2155 | 419 |
| 1911 | | Oryza sativa | PRT | G2192 | 421 |
| 1912 | | Oryza sativa | PRT | G2295 | 423 |
| 1913 | | Glycine max | DNA | G2340 | 425 |
| 1914 | | Glycine max | DNA | G2343 | 427 |
| 1915 | | Glycine max | DNA | G2343 | 427 |
| 1916 | | Glycine max | DNA | G2343 | 427 |
| 1917 | | Lycopersicon esculentum | PRT | G2343 | 427 |
| 1918 | | Oryza sativa | PRT | G2379 | 433 |
| 1919 | | Oryza sativa | PRT | G2379 | 433 |
| 1920 | | Oryza sativa | PRT | G2379 | 433 |
| 1921 | | Glycine max | DNA | G2505 | 437 |
| 1922 | | Zea mays | DNA | G2505 | 437 |
| 1923 | | Glycine max | DNA | G2520 | 443 |
| 1924 | | Glycine max | DNA | G2520 | 443 |
| 1925 | | Oryza sativa | DNA | G2520 | 443 |
| 1926 | | Zea mays | DNA | G2520 | 443 |
| 1927 | | Zea mays | DNA | G2520 | 443 |
| 1928 | | Zea mays | DNA | G2520 | 443 |
| 1929 | | Oryza sativa | PRT | G2520 | 443 |
| 1930 | | Oryza sativa | PRT | G2520 | 443 |
| 1931 | | Glycine max | DNA | G2557 | 447 |
| 1932 | | Glycine max | DNA | G2557 | 447 |
| 1933 | | Glycine max | DNA | G2557 | 447 |
| 1934 | | Zea mays | DNA | G2557 | 447 |
| 1935 | | Zea mays | DNA | G2557 | 447 |
| 1936 | | Glycine max | DNA | G2557 | 447 |
| 1937 | | Oryza sativa | PRT | G2557 | 447 |
| 1938 | | Oryza sativa | PRT | G2557 | 447 |
| 1939 | | Oryza sativa | PRT | G2557 | 447 |
| 1940 | | Glycine max | DNA | G2719 | 453 |
| 1941 | | Zea mays | DNA | G2719 | 453 |
| 1942 | | Oryza sativa | PRT | G2719 | 453 |
| 1943 | | Oryza sativa | PRT | G2719 | 453 |
| 1944 | | Glycine max | DNA | G2789 | 455 |
| 1945 | | Medicago truncatula | DNA | G2789 | 455 |
| 1946 | | Glycine max | DNA | G2830 | 457 |

Table 8 lists a summary of homologous sequences identified using BLAST (tblastx program). The first column shows the polynucleotide sequence identifier (SEQ ID NO), the second column shows the corresponding cDNA identifier (Gene ID), the third column shows the orthologous or homologous polynucleotide GenBank Accession Number (Test Sequence ID), the fourth column shows the calculated probability value that the sequence identity is due to chance (Smallest Sum Probability), the fifth column shows the plant species from which the test sequence was isolated (Test Sequence Species), and the sixth column shows the orthologous or homologous test sequence GenBank annotation (Test Sequence GenBank Annotation).

TABLE 8

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 1 | G8 | AF134116 | 2.00E−92 | Hyacinthus orientalis | APETALA2 protein homolog HAP2 (HAP2) |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 1 | G8 | AF132002 | 6.00E−86 | Petunia x hybrida | PHAP2B protein (Ap2B) mRNA, complete cds. |
| 1 | G8 | AF332215 | 8.00E−84 | Malus x domestica | transcription factor AHAP2 (AHAP2) mRNA, |
| 1 | G8 | CA783794 | 3.00E−83 | Glycine max | sat57d09.y1 Gm-c1056 Glycine max cDNA clone SOY |
| 1 | G8 | AY069953 | 7.00E−82 | Hordeum vulgare | APETALA2-like protein (AP2L1) mRNA, complet |
| 1 | G8 | AF253971 | 5.00E−81 | Picea abies | APETALA2-related transcription factor 2 (AP2L2) |
| 1 | G8 | AF048900 | 2.00E−80 | Zea mays | indeterminate spikelet 1 (ids1) mRNA, complete cds |
| 1 | G8 | AF325506 | 4.00E−80 | Pisum sativum | APETAL2-like protein mRNA, complete cds. |
| 1 | G8 | BG321674 | 6.00E−79 | Descurainia sophia | Ds01_06a02_A Ds01_AAFC_ECORC_cold_stress |
| 1 | G8 | BQ120583 | 3.00E−78 | Solanum tuberosum | EST606159 mixed potato tissues Solanum tu |
| 1 | G8 | gi24059986 | 1.30E−91 | Oryza sativa (japonica cultivar-group) | putative indetermi |
| 1 | G8 | gi5360996 | 8.70E−88 | Hyacinthus orientalis | APETALA2 protein homolog HAP2. |
| 1 | G8 | gi5081555 | 4.50E−86 | Petunia x hybrida | PHAP2A protein. |
| 1 | G8 | gi2944040 | 5.80E−84 | Zea mays | indeterminate spikelet 1. |
| 1 | G8 | gi21717332 | 9.30E−82 | Malus x domestica | transcription factor AHAP2. |
| 1 | G8 | gi11181612 | 7.50E−78 | Picea abies | APETALA2-related transcription factor 2. |
| 1 | G8 | gi13173164 | 1.60E−77 | Pisum sativum | APETAL2-like protein. |
| 1 | G8 | gi18476518 | 2.60E−70 | Hordeum vulgare | APETALA2-like protein. |
| 1 | G8 | gi21069051 | 1.40E−34 | Brassica napus | AP2/EREBP transcription factor BABY BOOM1. |
| 1 | G8 | gi21304225 | 8.60E−33 | Oryza sativa | aintegumenta-like protein. |
| 3 | G19 | BG321358 | 1.00E−101 | Descurainia sophia | Ds01_07d03_R Ds01_AAFC_ECORC_cold_stress |
| 3 | G19 | BH444831 | 1.00E−77 | Brassica oleracea | BOHPW42TR BOHP Brassica oleracea genomic |
| 3 | G19 | BM412184 | 2.00E−43 | Lycopersicon esculentum | EST586511 tomato breaker fruit Lyco |
| 3 | G19 | BU837697 | 3.00E−43 | Populus tremula x Populus tremuloides | T104G02 Populus apica |
| 3 | G19 | CA784650 | 6.00E−43 | Glycine max | sat87a10.y1 Gm-c1062 Glycine max cDNA clone SOY |
| 3 | G19 | BU819833 | 3.00E−41 | Populus tremula | UA48BPB07 Populus tremula cambium cDNA libr |
| 3 | G19 | BU870388 | 4.00E−41 | Populus balsamifera subsp. trichocarpa | Q011H05 Populus flow |
| 3 | G19 | CA797119 | 1.00E−38 | Theobroma cacao | Cac_BL_4204 Cac_BL (Bean and Leaf from Amel |
| 3 | G19 | BI436183 | 2.00E−38 | Solanum tuberosum | EST538944 cSTE Solanum tuberosum cDNA clo |
| 3 | G19 | BQ989448 | 2.00E−36 | Lactuca sativa | QGF17L05.yg.ab1 QG_EFGHJ lettuce serriola La |
| 3 | G19 | gi10798644 | 5.70E−36 | Nicotiana tabacum | AP2 domain-containing transcription fac |
| 3 | G19 | gi6176534 | 2.40E−35 | Oryza sativa | EREBP-like protein. |
| 3 | G19 | gi1688233 | 7.50E−34 | Solanum tuberosum | DNA binding protein homolog. |
| 3 | G19 | gi22074046 | 1.50E−33 | Lycopersicon esculentum | transcription factor JERF1. |
| 3 | G19 | gi18496063 | 4.90E−33 | Fagus sylvatica | ethylene responsive element binding prote |
| 3 | G19 | gi20805105 | 2.10E−32 | Oryza sativa (japonica cultivar-group) | contains ESTs AU06 |
| 3 | G19 | gi24940524 | 2.30E−31 | Triticum aestivum | ethylene response element binding prote |
| 3 | G19 | gi18266198 | 2.30E−31 | Narcissus pseudonarcissus | AP-2 domain containing protein. |
| 3 | G19 | gi3264767 | 1.30E−30 | Prunus armeniaca | AP2 domain containing protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 3 | G19 | gi24817250 | 4.00E−28 | Cicer arietinum | transcription factor EREBP-like protein. |
| 5 | G22 | AB016264 | 9.00E−48 | Nicotiana sylvestris | nserf2 gene for ethylene-responsive el |
| 5 | G22 | TOBBY4A | 1.00E−47 | Nicotiana tabacum | mRNA for ERF1, complete cds. |
| 5 | G22 | AP004533 | 4.00E−47 | Lotus japonicus | genomic DNA, chromosome 3, clone: LjT14G02, |
| 5 | G22 | LEU89255 | 6.00E−47 | Lycopersicon esculentum | DNA-binding protein Pti4 mRNA, comp |
| 5 | G22 | BQ517082 | 6.00E−46 | Solanum tuberosum | EST624497 Generation of a set of potato c |
| 5 | G22 | BE449392 | 1.00E−45 | Lycopersicon hirsutum | EST356151 L. hirsutum trichome, Corne |
| 5 | G22 | AF245119 | 5.00E−45 | Mesembryanthemum crystallinum | AP2-related transcription fac |
| 5 | G22 | BQ165291 | 7.00E−45 | Medicago truncatula | EST611160 KVKC Medicago truncatula cDNA |
| 5 | G22 | AW618245 | 8.00E−38 | Lycopersicon pennellii | EST314295 L. pennellii trichome, Cor |
| 5 | G22 | BG444654 | 2.00E−36 | Gossypium arboreum | GA_Ea0025B11f Gossypium arboreum 7-10 d |
| 5 | G22 | gi1208495 | 6.10E−48 | Nicotiana tabacum | ERF1. |
| 5 | G22 | gi3342211 | 3.30E−47 | Lycopersicon esculentum | Pti4. |
| 5 | G22 | gi8809571 | 8.90E−47 | Nicotiana sylvestris | ethylene-responsive element binding |
| 5 | G22 | gi17385636 | 2.70E−36 | Matricaria chamomilla | ethylene-responsive element binding |
| 5 | G22 | gi8980313 | 2.50E−33 | Catharanthus roseus | AP2-domain DNA-binding protein. |
| 5 | G22 | gi7528276 | 8.60E−33 | Mesembryanthemum crystallinum | AP2-related transcription f |
| 5 | G22 | gi21304712 | 3.10E−28 | Glycine max | ethylene-responsive element binding protein 1 |
| 5 | G22 | gi14140141 | 1.50E−26 | Oryza sativa | putative AP2-related transcription factor. |
| 5 | G22 | gi15623863 | 1.30E−22 | Oryza sativa (japonica cultivar-group) | contains EST~hypot |
| 5 | G22 | gi4099914 | 3.10E−21 | Stylosanthes hamata | ethylene-responsive element binding p |
| 7 | G24 | BZ026790 | 7.00E−71 | Brassica oleracea | oeh27a09.b1 B. oleracea002 Brassica olerac |
| 7 | G24 | BM985484 | 4.00E−52 | Thellungiella halophila | 10_C12_T Ath Thellungiella halophil |
| 7 | G24 | BQ405872 | 3.00E−45 | Gossypium arboreum | GA_Ed0088A03f Gossypium arboreum 7-10 d |
| 7 | G24 | BG543187 | 3.00E−44 | Brassica rapa subsp. pekinensis | E0677 Chinese cabbage etiol |
| 7 | G24 | AW981184 | 7.00E−42 | Medicago truncatula | EST392378 DSIL Medicago truncatula cDNA |
| 7 | G24 | BQ704289 | 9.00E−41 | Brassica napus | Bn01_04f19_A |
| 7 | G24 | BG321374 | 9.00E−40 | Descurainia sophia | Ds01_06d08_R Ds01_AAFC_ECORC_cold_stress |
| 7 | G24 | OSIG00036 | 4.00E−37 | Oryza sativa | chromosome 4 clone H0721B11, *** SEQUENCING I |
| 7 | G24 | AAAA01024762 | 4.00E−37 | Oryza sativa (indica cultivar-group) | ( ) scaffold024762 |
| 7 | G24 | BQ586795 | 6.00E−37 | Beta vulgaris | E012390-024-012-J13-SP6 MPIZ-ADIS-024-leaf Be |
| 7 | G24 | gi5091503 | 9.60E−34 | Oryza sativa | EST AU055776(S20048) corresponds to a region |
| 7 | G24 | gi20161239 | 6.40E−21 | Oryza sativa (japonica cultivar-group) | hypothetical prote |
| 7 | G24 | gi8980313 | 2.20E−20 | Catharanthus roseus | AP2-domain DNA-binding protein. |
| 7 | G24 | gi4099921 | 2.80E−20 | Stylosanthes hamata | EREBP-3 homolog. |
| 7 | G24 | gi10798644 | 5.70E−20 | Nicotiana tabacum | AP2 domain-containing transcription fac |
| 7 | G24 | gi8571476 | 1.70E−18 | Atriplex hortensis | apetala2 domain-containing protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 7 | G24 | gi8809573 | 2.10E−18 | Nicotiana sylvestris | ethylene-responsive element binding |
| 7 | G24 | gi21908034 | 2.20E−18 | Zea mays | DRE binding factor 2. |
| 7 | G24 | gi17352283 | 9.60E−18 | Brassica napus | CBF-like protein. |
| 7 | G24 | gi3342211 | 4.70E−17 | Lycopersicon esculentum | Pti4. |
| 9 | G28 | AF245119 | 2.00E−72 | Mesembryanthemum crystallinum | AP2-related transcription fac |
| 9 | G28 | BQ165291 | 1.00E−68 | Medicago truncatula | EST611160 KVKC Medicago truncatula cDNA |
| 9 | G28 | AB016264 | 1.00E−57 | Nicotiana sylvestris | nserf2 gene for ethylene-responsive el |
| 9 | G28 | TOBBY4D | 2.00E−57 | Nicotiana tabacum | Tobacco mRNA for EREBP-2, complete cds. |
| 9 | G28 | BQ047502 | 2.00E−57 | Solanum tuberosum | EST596620 P. infestans-challenged potato |
| 9 | G28 | LEU89255 | 2.00E−56 | Lycopersicon esculentum | DNA-binding protein Pti4 mRNA, comp |
| 9 | G28 | BH454277 | 2.00E−54 | Brassica oleracea | BOGSI45TR BOGS Brassica oleracea genomic |
| 9 | G28 | BE449392 | 1.00E−53 | Lycopersicon hirsutum | EST356151 L. hirsutum trichome, Corne |
| 9 | G28 | AB035270 | 2.00E−50 | Matricaria chamomilla | McEREBP1 mRNA for ethylene-responsive |
| 9 | G28 | AW233956 | 5.00E−50 | Glycine max | sf32e02.y1 Gm-c1028 Glycine max cDNA clone GENO |
| 9 | G28 | gi7528276 | 6.10E−71 | Mesembryanthemum crystallinum | AP2-related transcription f |
| 9 | G28 | gi8809571 | 3.30E−56 | Nicotiana sylvestris | ethylene-responsive element binding |
| 9 | G28 | gi3342211 | 4.20E−56 | Lycopersicon esculentum | Pti4. |
| 9 | G28 | gi1208498 | 8.70E−56 | Nicotiana tabacum | EREBP-2. |
| 9 | G28 | gi14140141 | 4.20E−49 | Oryza sativa | putative AP2-related transcription factor. |
| 9 | G28 | gi17385636 | 3.00E−46 | Matricaria chamomilla | ethylene-responsive element binding |
| 9 | G28 | gi21304712 | 2.90E−31 | Glycine max | ethylene-responsive element binding protein 1 |
| 9 | G28 | gi15623863 | 5.60E−29 | Oryza sativa (japonica cultivar-group) | contains EST~hypot |
| 9 | G28 | gi8980313 | 1.20E−26 | Catharanthus roseus | AP2-domain DNA-binding protein. |
| 9 | G28 | gi4099921 | 3.10E−21 | Stylosanthes hamata | EREBP-3 homolog. |
| 11 | G47 | BG543936 | 1.00E−60 | Brassica rapa subsp. pekinensis | E1686 Chinese cabbage etiol |
| 11 | G47 | BH420519 | 3.00E−43 | Brassica oleracea | BOGUH88TF BOGU Brassica oleracea genomic |
| 11 | G47 | AU292603 | 3.00E−30 | Zinnia elegans | AU292603 zinnia cultured mesophyll cell equa |
| 11 | G47 | BE320193 | 1.00E−24 | Medicago truncatula | NF024B04RT1F1029 Developing root Medica |
| 11 | G47 | AAAA01000718 | 1.00E−22 | Oryza sativa (indica cultivar-group) | ( ) scaffold000718 |
| 11 | G47 | AP003379 | 2.00E−22 | Oryza sativa | chromosome 1 clone P0408G07, *** SEQUENCING IN |
| 11 | G47 | AC124836 | 8.00E−21 | Oryza sativa (japonica cultivar-group) | ( ) chromosome 5 clo |
| 11 | G47 | BZ403609 | 2.00E−20 | Zea mays | OGABN17TM ZM_0.7_1.5_KB Zea mays genomic clone ZMM |
| 11 | G47 | BM112772 | 6.00E−17 | Solanum tuberosum | EST560308 potato roots Solanum tuberosum |
| 11 | G47 | BQ698717 | 1.00E−16 | Pinus taeda | NXPV_148_C06_F NXPV (Nsf Xylem Planings wood Ve |
| 11 | G47 | gi20161239 | 6.90E−24 | Oryza sativa (japonica cultivar-group) | hypothetical prote |
| 11 | G47 | gi14140155 | 6.80E−17 | Oryza sativa | putative AP2 domain transcription factor. |
| 11 | G47 | gi21908034 | 7.00E−15 | Zea mays | DRE binding factor 2. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 11 | G47 | gi20303011 | 1.90E−14 | Brassica napus | CBF-like protein CBF5. |
| 11 | G47 | gi8571476 | 3.00E−14 | Atriplex hortensis | apetala2 domain-containing protein. |
| 11 | G47 | gi8980313 | 2.10E−13 | Catharanthus roseus | AP2-domain DNA-binding protein. |
| 11 | G47 | gi19071243 | 4.40E−13 | Hordeum vulgare | CRT/DRE binding factor 1. |
| 11 | G47 | gi18650662 | 5.60E−13 | Lycopersicon esculentum | ethylene response factor 1. |
| 11 | G47 | gi17385636 | 1.20E−12 | Matricaria chamomilla | ethylene-responsive element binding |
| 11 | G47 | gi1208498 | 1.50E−12 | Nicotiana tabacum | EREBP-2. |
| 13 | G156 | AF335242 | 4.00E−45 | Petunia x hybrida | MADS-box transcription factor FBP24 (FBP2 |
| 13 | G156 | AMA307056 | 2.00E−41 | Antirrhinum majus | mRNA for putative MADS-domain transcript |
| 13 | G156 | BF276751 | 1.00E−35 | Gossypium arboreum | GA_Eb0030I08f Gossypium arboreum 7-10 d |
| 13 | G156 | AB071380 | 2.00E−35 | Lilium regale | LRGLOB mRNA for MADS-box transcription factor |
| 13 | G156 | ZMA271208 | 2.00E−34 | Zea mays | mRNA for putative MADS-domain transcription facto |
| 13 | G156 | AI899235 | 1.00E−33 | Lycopersicon esculentum | EST268678 tomato ovary, TAMU Lycope |
| 13 | G156 | GGN132219 | 8.00E−33 | Gnetum gnemon | mRNA for putative MADS domain transcription |
| 13 | G156 | BQ753907 | 2.00E−32 | Hordeum vulgare subsp. vulgare | EBca01_SQ002_D17_R carpel, p |
| 13 | G156 | AF134114 | 1.00E−31 | Hyacinthus orientalis | PISTILLATA protein homolog HPI1 (HPI1 |
| 13 | G156 | AB094985 | 1.00E−30 | Orchis italica | OrcPI mRNA for PI/GLO-like protein, complete |
| 13 | G156 | gi13384062 | 8.50E−42 | Petunia x hybrida | MADS-box transcription factor FBP24. |
| 13 | G156 | gi19578307 | 2.00E−40 | Antirrhinum majus | putative MADS-domain transcription fact |
| 13 | G156 | gi20513262 | 1.30E−36 | Lilium regale | MADS-box transcription factor. |
| 13 | G156 | gi18076209 | 2.70E−36 | Zea mays | putative MADS-domain transcription factor. |
| 13 | G156 | gi5019464 | 1.40E−34 | Gnetum gnemon | putative MADS domain transcription factor G |
| 13 | G156 | gi3114586 | 7.10E−34 | Eucalyptus grandis | MADS box protein. |
| 13 | G156 | gi4885036 | 9.00E−34 | Hyacinthus orientalis | PISTILLATA protein homolog HPI2. |
| 13 | G156 | gi24421111 | 1.60E−31 | Orchis italica | PI/GLO-like protein. |
| 13 | G156 | gi2961437 | 2.30E−31 | Oryza sativa | MADS box protein. |
| 13 | G156 | gi16549070 | 3.40E−31 | Magnolia praecocissima | putative MADS-domain transcription |
| 15 | G157 | AY036888 | 1.00E−63 | Brassica napus | MADS-box protein (FLC1) mRNA, complete cds. |
| 15 | G157 | BG596731 | 1.00E−37 | Solanum tuberosum | EST495409 cSTS Solanum tuberosum cDNA clo |
| 15 | G157 | BG544805 | 1.00E−37 | Brassica rapa subsp. pekinensis | E2809 Chinese cabbage etiol |
| 15 | G157 | AW219962 | 4.00E−37 | Lycopersicon esculentum | EST302445 tomato root during/after |
| 15 | G157 | BM436799 | 5.00E−36 | Vitis vinifera | VVA010B05_53181 An expressed sequence tag da |
| 15 | G157 | BU875165 | 1.00E−31 | Populus balsamifera subsp. trichocarpa | V003A12 Populus flow |
| 15 | G157 | BQ868455 | 2.00E−31 | Lactuca sativa | QGD14A13.yg.ab1 QG_ABCDI lettuce salinas Lac |
| 15 | G157 | BI957545 | 1.00E−30 | Hordeum vulgare | HVSMEn0010B09f Hordeum vulgare rachis EST 1 |
| 15 | G157 | BJ213269 | 3.00E−30 | Triticum aestivum | BJ213269 Y. Ogihara unpublished cDNA libr |
| 15 | G157 | BU887610 | 3.00E−30 | Populus tremula x Populus tremuloides | R064B01 Populus root |
| 15 | G157 | gi17933450 | 4.90E−62 | Brassica napus | MADS-box protein. |
| 15 | G157 | gi9367313 | 2.60E−31 | Hordeum vulgare | MADS-box protein 8. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 15 | G157 | gi16874557 | 5.50E−31 | *Antirrhinum majus* | MADS-box transcription factor DEFH28. |
| 15 | G157 | gi1483232 | 7.00E−31 | *Betula pendula* | MADS5 protein. |
| 15 | G157 | gi4204234 | 1.40E−30 | *Lolium temulentum* | MADS-box protein 2. |
| 15 | G157 | gi7592642 | 1.40E−30 | *Oryza sativa* | AP1-like MADS box protein. |
| 15 | G157 | gi12002141 | 1.80E−30 | *Zea mays* | MADS box protein 3. |
| 15 | G157 | gi21070923 | 1.80E−30 | *Oryza sativa (japonica cultivar-group)* | AP1-like MADS-box |
| 15 | G157 | gi13384068 | 8.00E−30 | *Petunia x hybrida* | MADS-box transcription factor FBP29. |
| 15 | G157 | gi6469345 | 1.30E−29 | *Brassica rapa* subsp. *pekinensis* | DNA-binding protein. |
| 17 | G162 | BZ073323 | 6.00E−44 | *Brassica oleracea* | 1kf66e08.b1 *B. oleracea*002 *Brassica olerac* |
| 17 | G162 | BQ403135 | 3.00E−33 | *Gossypium arboreum* | GA_Ed0054C07f *Gossypium arboreum* 7-10 d |
| 17 | G162 | AC122160 | 2.00E−27 | *Medicago truncatula* | clone mth2-23d6, WORKING DRAFT SEQUENCE |
| 17 | G162 | CRU91416 | 2.00E−18 | *Ceratopteris richardii* | CMADS2 mRNA, complete cds. |
| 17 | G162 | AP005789 | 3.00E−18 | *Oryza sativa (japonica cultivar-group)* | ( ) chromosome 9 clo |
| 17 | G162 | AAAA01007138 | 3.00E−18 | *Oryza sativa (indica cultivar-group)* | ( ) scaffold007138 |
| 17 | G162 | AP003627 | 8.00E−18 | *Oryza sativa* | genomic DNA, chromosome 1, PAC clone: P0459B04, |
| 17 | G162 | BZ415846 | 1.00E−16 | *Zea mays* | if60b04.g1 WGS-ZmaysF (DH5a methyl filtered) *Zea m* |
| 17 | G162 | CA733624 | 3.00E−16 | *Triticum aestivum* | wlp1c.pk005.p15 wlp1c *Triticum aestivum* c |
| 17 | G162 | AF035379 | 4.00E−16 | *Lolium temulentum* | MADS-box protein 2 (MADS2) mRNA, alternat |
| 17 | G162 | gi3253149 | 1.30E−20 | *Ceratopteris richardii* | CMADS2. |
| 17 | G162 | gi15290141 | 2.80E−20 | *Oryza sativa* | hypothetical protein. |
| 17 | G162 | gi6580943 | 2.40E−19 | *Picea abies* | MADS-box transcription factor. |
| 17 | G162 | gi5019431 | 4.90E−19 | *Gnetum gnemon* | putative MADS domain transcription factor G |
| 17 | G162 | gi1206005 | 4.90E−19 | *Pinus radiata* | putative MADS-box family transcription fact |
| 17 | G162 | gi1702951 | 4.90E−19 | *Pinus resinosa* | MADS-box family transcription factor. |
| 17 | G162 | gi887392 | 8.00E−19 | *Brassica oleracea* | BOAP1. |
| 17 | G162 | gi21396799 | 1.60E−18 | *Lycopodium annotinum* | MADS-box gene 4 protein. |
| 17 | G162 | gi20219014 | 3.40E−18 | *Lycopersicon esculentum* | MADS-box transcription factor MAD |
| 17 | G162 | gi7672991 | 3.60E−18 | *Canavalia lineata* | MADS-box transcription factor. |
| 19 | G175 | AB063576 | 1.00E−108 | *Nicotiana tabacum* | NtWRKY-9 mRNA for WRKY DNA-binding protei |
| 19 | G175 | LES303343 | 1.00E−103 | *Lycopersicon esculentum* | mRNA for hypothetical protein (ORF |
| 19 | G175 | BZ005522 | 2.00E−74 | *Brassica oleracea* | oej73d10.b1 *B. oleracea*002 *Brassica olerac* |
| 19 | G175 | IPBSPF1P | 3.00E−71 | *Ipomoea batatas* | Sweet potato mRNA for SPF1 protein, complet |
| 19 | G175 | AX192162 | 3.00E−68 | *Glycine max* | Sequence 9 from Patent WO0149840. |
| 19 | G175 | AX192164 | 1.00E−66 | *Triticum aestivum* | Sequence 11 from Patent WO0149840. |
| 19 | G175 | AF439274 | 5.00E−65 | *Retama raetam* | WRKY-like drought-induced protein (WRK) mRNA, |
| 19 | G175 | OSJN00012 | 5.00E−64 | *Oryza sativa* | chromosome 4 clone OSJNBa0089K21, *** SEQUENC |
| 19 | G175 | CUSSLDB | 6.00E−63 | *Cucumis sativus* | SPF1-like DNA-binding protein mRNA, complet |
| 19 | G175 | PCU48831 | 7.00E−63 | *Petroselinum crispum* | DNA-binding protein WRKY1 mRNA, comple |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 19 | G175 | gi13620227 | 8.20E−108 | *Lycopersicon esculentum* | hypothetical protein. |
| 19 | G175 | gi14530687 | 2.00E−89 | *Nicotiana tabacum* | WRKY DNA-binding protein. |
| 19 | G175 | gi1076685 | 2.10E−74 | *Ipomoea batatas* | SPF1 protein-sweet potato. |
| 19 | G175 | gi18158619 | 1.10E−69 | *Retama raetam* | WRKY-like drought-induced protein. |
| 19 | G175 | gi7484759 | 5.90E−68 | *Cucumis sativus* | SP8 binding protein homolog-cucumber. |
| 19 | G175 | gi5917653 | 7.80E−64 | *Petroselinum crispum* | zinc-finger type transcription facto |
| 19 | G175 | gi14587365 | 2.40E−63 | *Oryza sativa* | putative DNA-binding protein ABF1. |
| 19 | G175 | gi4894965 | 9.90E−61 | *Avena sativa* | DNA-binding protein WRKY1. |
| 19 | G175 | gi1159877 | 2.40E−60 | *Avena fatua* | DNA-binding protein. |
| 19 | G175 | gi16588566 | 7.30E−52 | *Solanum dulcamara* | thermal hysteresis protein STHP-64. |
| 21 | G180 | BU896559 | 7.00E−66 | *Populus tremula* x *Populus tremuloides* | X042D08 *Populus* wood |
| 21 | G180 | CA800201 | 2.00E−58 | *Glycine max* | sat79d02.y1 Gm-c1062 *Glycine max* cDNA clone SOY |
| 21 | G180 | BQ507128 | 8.00E−55 | *Solanum tuberosum* | EST614543 Generation of a set of potato c |
| 21 | G180 | BJ322852 | 1.00E−39 | *Triticum aestivum* | BJ322852 Y. Ogihara unpublished cDNA libr |
| 21 | G180 | BQ293390 | 8.00E−39 | *Zea mays* | 1091013C10.x2 1091-Immature ear with common ESTs |
| 21 | G180 | BM370440 | 9.00E−30 | *Hordeum vulgare* | EBro08_SQ004_D21_R IGF Barley EBro08 librar |
| 21 | G180 | AF140554 | 3.00E−28 | *Avena sativa* | DNA-binding protein WRKY1 (wrky1) mRNA, comple |
| 21 | G180 | BI210061 | 1.00E−27 | *Lycopersicon esculentum* | EST528101 cTOS *Lycopersicon* esculen |
| 21 | G180 | AFABF1 | 4.00E−27 | *Avena fatua* | *A. fatua* mRNA for DNA-binding protein (clone ABF |
| 21 | G180 | BQ864325 | 2.00E−26 | *Lactuca sativa* | QGC26J22.yg.ab1 QG_ABCDI lettuce salinas Lac |
| 21 | G180 | gi14140117 | 9.60E−50 | *Oryza sativa* | WRKY-like DNA-binding protein. |
| 21 | G180 | gi24745606 | 1.10E−31 | *Solanum tuberosum* | WRKY-type DNA binding protein. |
| 21 | G180 | gi4894965 | 1.90E−29 | *Avena sativa* | DNA-binding protein WRKY1. |
| 21 | G180 | gi1159877 | 3.50E−29 | *Avena fatua* | DNA-binding protein. |
| 21 | G180 | gi20161004 | 5.60E−29 | *Oryza sativa (japonica cultivar-group)* | hypothetical prote |
| 21 | G180 | gi1431872 | 7.30E−29 | *Petroselinum crispum* | WRKY1. |
| 21 | G180 | gi5360683 | 6.90E−28 | *Nicotiana tabacum* | NtWRKY1. |
| 21 | G180 | gi13620227 | 3.50E−27 | *Lycopersicon esculentum* | hypothetical protein. |
| 21 | G180 | gi3420906 | 5.30E−27 | *Pimpinella brachycarpa* | zinc finger protein; WRKY1. |
| 21 | G180 | gi1076685 | 1.20E−26 | *Ipomoea batatas* | SPF1 protein-sweet potato. |
| 23 | G183 | CRU303349 | 3.00E−54 | *Capsella rubella* | ORF1, ORF2, ORF3, ORF4, ORF5 and ORF6 (pa |
| 23 | G183 | AB063576 | 5.00E−33 | *Nicotiana tabacum* | NtWRKY-9 mRNA for WRKY DNA-binding protei |
| 23 | G183 | LES303343 | 3.00E−32 | *Lycopersicon esculentum* | mRNA for hypothetical protein (ORF |
| 23 | G183 | IPBSPF1P | 2.00E−29 | *Ipomoea batatas* | Sweet potato mRNA for SPF1 protein, complet |
| 23 | G183 | BM408205 | 2.00E−29 | *Solanum tuberosum* | EST582532 potato roots *Solanum tuberosum* |
| 23 | G183 | BI128063 | 5.00E−29 | *Populus tremula* x *Populus tremuloides* | G070P32Y *Populus* camb |
| 23 | G183 | BU043758 | 1.00E−28 | *Prunus persica* | PP_LEa0017B09f Peach developing fruit mesoca |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 23 | G183 | AX192162 | 4.00E−28 | *Glycine max* | Sequence 9 from Patent WO0149840. |
| 23 | G183 | BG442954 | 5.00E−28 | *Gossypium arboreum* | GA_Ea0018P14f *Gossypium arboreum* 7-10 d |
| 23 | G183 | AF080595 | 2.00E−27 | *Pimpinella brachycarpa* | zinc finger protein (ZFP1) mRNA, com |
| 23 | G183 | gi13620168 | 1.30E−86 | *Capsella rubella* | hypothetical protein. |
| 23 | G183 | gi13620227 | 2.60E−52 | *Lycopersicon esculentum* | hypothetical protein. |
| 23 | G183 | gi6174838 | 1.10E−37 | *Nicotiana tabacum* | transcription factor NtWRKY4. |
| 23 | G183 | gi1076685 | 1.70E−35 | *Ipomoea batatas* | SPF1 protein-sweet potato. |
| 23 | G183 | gi7484759 | 9.20E−29 | *Cucumis sativus* | SP8 binding protein homolog-cucumber. |
| 23 | G183 | gi1159877 | 9.50E−29 | *Avena fatua* | DNA-binding protein. |
| 23 | G183 | gi14587365 | 8.00E−28 | *Oryza sativa* | putative DNA-binding protein ABF1. |
| 23 | G183 | gi3420906 | 1.10E−27 | *Pimpinella brachycarpa* | zinc finger protein; WRKY1. |
| 23 | G183 | gi5917653 | 1.00E−26 | *Petroselinum crispum* | zinc-finger type transcription facto |
| 23 | G183 | gi4894965 | 2.30E−26 | *Avena sativa* | DNA-binding protein WRKY1. |
| 25 | G188 | AW596933 | 6.00E−43 | *Glycine max* | sj84f07.y1 Gm-c1034 *Glycine max* cDNA clone GENO |
| 25 | G188 | BI923414 | 2.00E−40 | *Lycopersicon esculentum* | EST543319 tomato callus *Lycopersico* |
| 25 | G188 | AV423663 | 3.00E−40 | *Lotus japonicus* | AV423663 *Lotus japonicus* young plants (two- |
| 25 | G188 | BM112869 | 6.00E−39 | *Solanum tuberosum* | EST560405 potato roots *Solanum tuberosum* |
| 25 | G188 | AP003951 | 6.00E−39 | *Oryza sativa* | chromosome 6 clone OJ1288_C01, *** SEQUENCING |
| 25 | G188 | AP004683 | 9.00E−39 | *Oryza sativa (japonica cultivar-group)* | ( ) chromosome 2 clo |
| 25 | G188 | AAAA01011017 | 9.00E−39 | *Oryza sativa (indica cultivar-group)* | ( ) scaffold011017 |
| 25 | G188 | BU837263 | 6.00E−38 | *Populus tremula* x *Populus tremuloides* | T096G05 *Populus* apica |
| 25 | G188 | AW447931 | 4.00E−34 | *Triticum aestivum* | BRY_1082 BRY *Triticum aestivum* cDNA clone |
| 25 | G188 | BQ763996 | 2.00E−32 | *Hordeum vulgare* subsp. *vulgare* | EBro03_SQ006_A04_R root, 3 w |
| 25 | G188 | gi12039364 | 4.00E−37 | *Oryza sativa* | putative DNA-binding protein. |
| 25 | G188 | gi4322940 | 4.70E−21 | *Nicotiana tabacum* | DNA-binding protein 2. |
| 25 | G188 | gi4894963 | 5.00E−20 | *Avena sativa* | DNA-binding protein WRKY3. |
| 25 | G188 | gi1432056 | 7.80E−20 | *Petroselinum crispum* | WRKY3. |
| 25 | G188 | gi11993901 | 3.10E−18 | *Dactylis glomerata* | somatic embryogenesis related protein. |
| 25 | G188 | gi22830985 | 1.10E−17 | *Oryza sativa (japonica cultivar-group)* | WRKY transcription |
| 25 | G188 | gi7484759 | 1.40E−16 | *Cucumis sativus* | SP8 binding protein homolog-cucumber. |
| 25 | G188 | gi1159879 | 2.70E−15 | *Avena fatua* | DNA-binding protein. |
| 25 | G188 | gi23305051 | 8.00E−15 | *Oryza sativa (indica cultivar-group)* | WRKY transcription f |
| 25 | G188 | gi9187622 | 2.70E−14 | *Solanum tuberosum* | WRKY DNA binding protein. |
| 27 | G189 | AB041520 | 2.00E−67 | *Nicotiana tabacum* | mRNA for WRKY transcription factor Nt-Sub |
| 27 | G189 | PCU56834 | 2.00E−64 | *Petroselinum crispum* | DNA binding protein WRKY3 mRNA, comple |
| 27 | G189 | AF140553 | 6.00E−55 | *Avena sativa* | DNA-binding protein WRKY3 (wrky3) mRNA, comple |
| 27 | G189 | BI469529 | 1.00E−54 | *Glycine max* | sah61a11.y1 Gm-c1049 *Glycine max* cDNA clone GEN |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 27 | G189 | AY108689 | 5.00E−54 | Zea mays | PCO134907 mRNA sequence. |
| 27 | G189 | AAAA01014145 | 7.00E−54 | Oryza sativa (indica cultivar-group) | ( ) scaffold014145 |
| 27 | G189 | BI209749 | 2.00E−53 | Lycopersicon esculentum | EST527789 cTOS Lycopersicon esculen |
| 27 | G189 | BU046845 | 4.00E−53 | Prunus persica | PP_LEa0027O15f Peach developing fruit mesoca |
| 27 | G189 | AP004648 | 4.00E−51 | Oryza sativa (japonica cultivar-group) | ( ) chromosome 8 clo |
| 27 | G189 | OSJN00198 | 6.00E−48 | Oryza sativa | chromosome 4 clone OSJNBb0015N08, *** SEQUENC |
| 27 | G189 | gi4894963 | 1.00E−54 | Avena sativa | DNA-binding protein WRKY3. |
| 27 | G189 | gi10798760 | 1.70E−50 | Nicotiana tabacum | WRKY transcription factor Nt-SubD48. |
| 27 | G189 | gi1432056 | 1.60E−49 | Petroselinum crispum | WRKY3. |
| 27 | G189 | gi11993901 | 5.80E−43 | Dactylis glomerata | somatic embryogenesis related protein. |
| 27 | G189 | gi15289829 | 5.60E−25 | Oryza sativa | contains ESTs D24303(R1701), C26098(C11628) ~u |
| 27 | G189 | gi1076685 | 1.60E−21 | Ipomoea batatas | SPF1 protein-sweet potato. |
| 27 | G189 | gi1159877 | 6.50E−21 | Avena fatua | DNA-binding protein. |
| 27 | G189 | gi18158619 | 5.10E−20 | Retama raetam | WRKY-like drought-induced protein. |
| 27 | G189 | gi3420906 | 9.80E−20 | Pimpinella brachycarpa | zinc finger protein; WRKY1. |
| 27 | G189 | gi23305051 | 4.50E−19 | Oryza sativa (indica cultivar-group) | WRKY transcription f |
| 29 | G192 | BH471182 | 3.00E−62 | Brassica oleracea | BOHES67TF BOHE Brassica oleracea genomic |
| 29 | G192 | BI923235 | 2.00E−49 | Lycopersicon esculentum | EST543139 tomato callus Lycopersico |
| 29 | G192 | AW596933 | 3.00E−47 | Glycine max | sj84f07.y1 Gm-c1034 Glycine max cDNA clone GENO |
| 29 | G192 | AV423663 | 2.00E−46 | Lotus japonicus | AV423663 Lotus japonicus young plants (two- |
| 29 | G192 | BM112869 | 1.00E−41 | Solanum tuberosum | EST560405 potato roots Solanum tuberosum |
| 29 | G192 | BU837263 | 8.00E−39 | Populus tremula x Populus tremuloides | T096G05 Populus apica |
| 29 | G192 | AAAA01003718 | 6.00E−34 | Oryza sativa (indica cultivar-group) | ( ) scaffold003718 |
| 29 | G192 | AC018727 | 6.00E−34 | Oryza sativa | chromosome 10 clone OSJNBa0056G17, *** SEQUENC |
| 29 | G192 | AP004683 | 1.00E−33 | Oryza sativa (japonica cultivar-group) | ( ) chromosome 2 clo |
| 29 | G192 | AW447931 | 1.00E−32 | Triticum aestivum | BRY_1082 BRY Triticum aestivum cDNA clone |
| 29 | G192 | gi12039364 | 1.90E−35 | Oryza sativa | putative DNA-binding protein. |
| 29 | G192 | gi1432056 | 2.00E−24 | Petroselinum crispum | WRKY3. |
| 29 | G192 | gi4894963 | 8.80E−24 | Avena sativa | DNA-binding protein WRKY3. |
| 29 | G192 | gi4760596 | 1.80E−23 | Nicotiana tabacum | DNA-binding protein NtWRKY3. |
| 29 | G192 | gi11993901 | 4.30E−20 | Dactylis glomerata | somatic embryogenesis related protein. |
| 29 | G192 | gi21644680 | 1.60E−17 | Oryza sativa (japonica cultivar-group) | hypothetical prote |
| 29 | G192 | gi23305051 | 5.00E−17 | Oryza sativa (indica cultivar-group) | WRKY transcription f |
| 29 | G192 | gi1076685 | 1.90E−15 | Ipomoea batatas | SPF1 protein-sweet potato. |
| 29 | G192 | gi7484759 | 2.30E−15 | Cucumis sativus | SP8 binding protein homolog-cucumber. |
| 29 | G192 | gi3420906 | 5.10E−15 | Pimpinella brachycarpa | zinc finger protein; WRKY1. |
| 31 | G196 | BH944961 | 9.00E−69 | Brassica oleracea | obu81g06.g1 B. oleracea002 Brassica olerac |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 31 | G196 | AAAA01003718 | 1.00E−46 | Oryza sativa (indica cultivar-group) | ( ) scaffold003718 |
| 31 | G196 | AC018727 | 1.00E−46 | Oryza sativa | chromosome 10 clone OSJNBa0056G17, *** SEQUENC |
| 31 | G196 | BI923235 | 6.00E−40 | Lycopersicon esculentum | EST543139 tomato callus Lycopersico |
| 31 | G196 | BM113882 | 4.00E−38 | Solanum tuberosum | EST561418 potato roots Solanum tuberosum |
| 31 | G196 | AW596933 | 1.00E−35 | Glycine max | sj84f07.y1 Gm-c1034 Glycine max cDNA clone GENO |
| 31 | G196 | AV423663 | 2.00E−34 | Lotus japonicus | AV423663 Lotus japonicus young plants (two- |
| 31 | G196 | BG647709 | 3.00E−34 | Medicago truncatula | EST509328 HOGA Medicago truncatula cDNA |
| 31 | G196 | BQ855766 | 3.00E−33 | Lactuca sativa | QGB27K18.yg.ab1 QG_ABCDI lettuce salinas Lac |
| 31 | G196 | BU837263 | 5.00E−32 | Populus tremula x Populus tremuloides | T096G05 Populus apica |
| 31 | G196 | gi12039364 | 3.30E−51 | Oryza sativa | putative DNA-binding protein. |
| 31 | G196 | gi4894963 | 2.40E−27 | Avena sativa | DNA-binding protein WRKY3. |
| 31 | G196 | gi10798760 | 7.00E−26 | Nicotiana tabacum | WRKY transcription factor Nt-SubD48. |
| 31 | G196 | gi1432056 | 6.20E−25 | Petroselinum crispum | WRKY3. |
| 31 | G196 | gi11993901 | 3.00E−20 | Dactylis glomerata | somatic embryogenesis related protein. |
| 31 | G196 | gi20160973 | 3.50E−20 | Oryza sativa (japonica cultivar-group) | hypothetical prote |
| 31 | G196 | gi23305051 | 1.10E−14 | Oryza sativa (indica cultivar-group) | WRKY transcription f |
| 31 | G196 | gi9187622 | 1.40E−14 | Solanum tuberosum | WRKY DNA binding protein. |
| 31 | G196 | gi1076685 | 2.50E−14 | Ipomoea batatas | SPF1 protein-sweet potato. |
| 31 | G196 | gi13620227 | 5.50E−14 | Lycopersicon esculentum | hypothetical protein. |
| 33 | G211 | BG441912 | 6.00E−70 | Gossypium arboreum | GA_Ea0015B19f Gossypium arboreum 7-10 d |
| 33 | G211 | AF336278 | 1.00E−69 | Gossypium hirsutum | BNLGHi233 (bnlghi6233) mRNA, complete cd |
| 33 | G211 | BU837990 | 3.00E−66 | Populus tremula x Populus tremuloides | T108C04 Populus apica |
| 33 | G211 | D88620 | 2.00E−57 | Oryza sativa | mRNA for OSMYB4, complete cds. |
| 33 | G211 | AW186273 | 6.00E−54 | Glycine max | se65f12.y1 Gm-c1019 Glycine max cDNA clone GENO |
| 33 | G211 | PMU39448 | 1.00E−52 | Picea mariana | MYB-like transcriptional factor MBF1 mRNA, co |
| 33 | G211 | AAAA01005841 | 1.00E−52 | Oryza sativa (indica cultivar-group) | ( ) scaffold005841 |
| 33 | G211 | BI674748 | 7.00E−52 | Zea mays | 949066G11.y2 949- Juvenile leaf and shoot cDNA fr |
| 33 | G211 | AW775893 | 2.00E−51 | Medicago truncatula | EST334958 DSIL Medicago truncatula cDNA |
| 33 | G211 | HVMYB2 | 2.00E−51 | Hordeum vulgare | H. vulgare myb2 mRNA. |
| 33 | G211 | gi13346178 | 1.50E−67 | Gossypium hirsutum | BNLGHi233. |
| 33 | G211 | gi22535556 | 1.10E−53 | Oryza sativa (japonica cultivar-group) | myb-related protei |
| 33 | G211 | gi2605623 | 1.10E−53 | Oryza sativa | OSMYB4. |
| 33 | G211 | gi1101770 | 5.70E−52 | Picea mariana | MYB-like transcriptional factor MBF1. |
| 33 | G211 | gi82310 | 2.00E−51 | Antirrhinum majus | myb protein 330-garden snapdragon. |
| 33 | G211 | gi127582 | 4.00E−51 | Zea mays | MYB-RELATED PROTEIN ZM38. |
| 33 | G211 | gi19055 | 1.10E−50 | Hordeum vulgare | MybHv5. |
| 33 | G211 | gi22795039 | 1.10E−50 | Populus x canescens | putative MYB transcription factor. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 33 | G211 | gi1167484 | 3.60E−50 | Lycopersicon esculentum | transcription factor. |
| 33 | G211 | gi20563 | 3.70E−50 | Petunia x hybrida | protein 1. |
| 35 | G214 | PVU420902 | 1.00E−111 | Phaseolus vulgaris | mRNA for LHY protein. |
| 35 | G214 | BU868664 | 6.00E−60 | Populus balsamifera subsp. trichocarpa | M118F07 Populus flow |
| 35 | G214 | BE331563 | 2.00E−50 | Glycine max | sp15d08.y1 Gm-c1042 Glycine max cDNA clone GENO |
| 35 | G214 | BH935194 | 1.00E−49 | Brassica oleracea | ode18e05.g1 B. oleracea002 Brassica olerac |
| 35 | G214 | AAAA01009649 | 4.00E−49 | Oryza sativa (indica cultivar-group) | ( ) scaffold009649 |
| 35 | G214 | AP004460 | 5.00E−48 | Oryza sativa (japonica cultivar-group) | ( ) chromosome 8 clo |
| 35 | G214 | AW979367 | 2.00E−46 | Lycopersicon esculentum | EST310415 tomato root deficiency, C |
| 35 | G214 | BM322287 | 5.00E−46 | Sorghum bicolor | PIC1_2_F02.b1_A002 Pathogen-infected compat |
| 35 | G214 | AY103618 | 4.00E−45 | Zea mays | PCO118792 mRNA sequence. |
| 35 | G214 | BG524104 | 3.00E−44 | Stevia rebaudiana | 38-82 Stevia field grown leaf cDNA Stevia |
| 35 | G214 | gi21213868 | 7.60E−57 | Phaseolus vulgaris | LHY protein. |
| 35 | G214 | gi15528628 | 2.40E−23 | Oryza sativa | hypothetical protein~similar to Oryza sativa |
| 35 | G214 | gi12406993 | 1.20E−06 | Hordeum vulgare | MCB1 protein. |
| 35 | G214 | gi20067661 | 1.40E−06 | Zea mays | one repeat myb transcriptional factor. |
| 35 | G214 | gi18874263 | 3.70E−06 | Antirrhinum majus | MYB-like transcription factor DIVARICAT |
| 35 | G214 | gi24850305 | 1.00−05 | Oryza sativa (japonica cultivar-group) | transcription fact |
| 35 | G214 | gi12005328 | 3.00E−05 | Hevea brasiliensis | unknown. |
| 35 | G214 | gi6688529 | 6.80E−05 | Lycopersicon esculentum | I-box binding factor. |
| 35 | G214 | gi19911579 | 7.10E−05 | Glycine max | syringolide-induced protein 1-3-1B. |
| 35 | G214 | gi7677132 | 0.0025 | Secale cereale | c-myb-like transcription factor. |
| 37 | G226 | BU872107 | 2.00E−21 | Populus balsamifera subsp. trichocarpa | Q039C07 Populus flow |
| 37 | G226 | BU831849 | 2.00E−21 | Populus tremula x Populus tremuloides | T026E01 Populus apica |
| 37 | G226 | BM437313 | 9.00E−21 | Vitis vinifera | VVA017F06_54121 An expressed sequence tag da |
| 37 | G226 | BI699876 | 1.00E−19 | Glycine max | sag49b09.y1 Gm-c1081 Glycine max cDNA clone GEN |
| 37 | G226 | AL750151 | 4.00E−16 | Pinus pinaster | AL750151 AS Pinus pinaster cDNA clone AS06C1 |
| 37 | G226 | CA744013 | 2.00E−12 | Triticum aestivum | wri1s.pk006.m22 wri1s Triticum aestivum c |
| 37 | G226 | BH961028 | 3.00E−12 | Brassica oleracea | odj30d06.g1 B. oleracea002 Brassica olerac |
| 37 | G226 | BJ472717 | 8.00E−12 | Hordeum vulgare subsp. vulgare | BJ472717 K. Sato unpublished |
| 37 | G226 | BF617445 | 8.00E−12 | Hordeum vulgare | HVSMEc0017G08f Hordeum vulgare seedling sho |
| 37 | G226 | CA762299 | 2.00E−11 | Oryza sativa (indica cultivar-group) | BR060003B10F03.ab1 IRR |
| 37 | G226 | gi9954118 | 2.20E−11 | Solanum tuberosum | tuber-specific and sucrose-responsive e |
| 37 | G226 | gi14269333 | 2.50E−10 | Gossypium raimondii | myb-like transcription factor Myb 3. |
| 37 | G226 | gi14269335 | 2.50E−10 | Gossypium herbaceum | myb-like transcription factor Myb 3. |
| 37 | G226 | gi14269337 | 2.50E−10 | Gossypium hirsutum | myb-like transcription factor Myb 3. |
| 37 | G226 | gi23476297 | 2.50E−10 | Gossypioides kirkii | myb-like transcription factor 3. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 37 | G226 | gi15082210 | 8.50E−10 | *Fragaria* x *ananassa* | transcription factor MYB1. |
| 37 | G226 | gi19072770 | 8.50E−10 | *Oryza sativa* | typical P-type R2R3 Myb protein. |
| 37 | G226 | gi15042108 | 1.40E−09 | *Zea mays* subsp. *parviglumis* | CI protein. |
| 37 | G226 | gi15042124 | 1.40E−09 | *Zea luxurians* | CI protein. |
| 37 | G226 | gi20514371 | 1.40E−09 | *Cucumis sativus* | werewolf. |
| 39 | G241 | AB028650 | 3.00E−69 | *Nicotiana tabacum* | mRNA for myb-related transcription factor |
| 39 | G241 | PHMYBPH22 | 3.00E−68 | *Petunia* x *hybrida* | *P. Hybrida* myb.Ph2 gene encoding protein |
| 39 | G241 | LETHM18GE | 1.00E−65 | *Lycopersicon esculentum* | *L. esculentum* mRNA for myb-related |
| 39 | G241 | AB073017 | 2.00E−63 | *Vitis labrusca* x *Vitis vinifera* | VlmybB1-2 gene for myb-rela |
| 39 | G241 | OSMYB1202 | 5.00E−63 | *Oryza sativa* | *O. sativa* mRNA for myb factor, 1202 bp. |
| 39 | G241 | AB029162 | 2.00E−62 | *Glycine max* | gene for GmMYB293, complete cds. |
| 39 | G241 | BQ514539 | 1.00E−61 | *Solanum tuberosum* | EST621954 Generation of a set of potato c |
| 39 | G241 | AW981167 | 5.00E−61 | *Medicago truncatula* | EST392361 DSIL *Medicago truncatula* cDNA |
| 39 | G241 | BJ312394 | 4.00E−60 | *Triticum aestivum* | BJ312394 Y. Ogihara unpublished cDNA libr |
| 39 | G241 | BM816803 | 2.00E−59 | *Hordeum vulgare* | HC114B11_SK.ab1 HC *Hordeum vulgare* cDNA clo |
| 39 | G241 | gi6552361 | 1.50E−67 | *Nicotiana tabacum* | myb-related transcription factor LBM2. |
| 39 | G241 | gi20561 | 8.30E−67 | *Petunia* x *hybrida* | protein 2. |
| 39 | G241 | gi1370140 | 3.70E−64 | *Lycopersicon esculentum* | myb-related transcription factor. |
| 39 | G241 | gi6492385 | 3.80E−62 | *Glycine max* | GmMYB29A2. |
| 39 | G241 | gi1946265 | 2.70E−61 | *Oryza sativa* | myb. |
| 39 | G241 | gi22266675 | 9.70E−57 | *Vitis labrusca* x *Vitis vinifera* | myb-related transcription |
| 39 | G241 | gi127580 | 5.50E−54 | *Zea mays* | MYB-RELATED PROTEIN ZM1. |
| 39 | G241 | gi11526779 | 9.90E−52 | *Zea mays* subsp. *parviglumis* | P-like protein. |
| 39 | G241 | gi22795039 | 1.10E−48 | *Populus* x *canescens* | putative MYB transcription factor. |
| 39 | G241 | gi13346188 | 1.40E−48 | *Gossypium hirsutum* | GHMYB25. |
| 41 | G248 | BE642935 | 2.00E−25 | *Ceratopteris richardii* | Cri2_7_G20_SP6 *Ceratopteris* Spore Li |
| 41 | G248 | AF190304 | 1.00E−24 | *Adiantum raddianum* | c-myb-like transcription factor (MYB3R-1 |
| 41 | G248 | AW040511 | 1.00E−24 | *Lycopersicon esculentum* | EST283471 tomato mixed elicitor, BT |
| 41 | G248 | AF189786 | 2.00E−24 | *Physcomitrella patens* | putative c-myb-like transcription fac |
| 41 | G248 | CA755789 | 4.00E−24 | *Oryza sativa* (*japonica* cultivar-group) | BR030028000_PLATE_D1 |
| 41 | G248 | AB056123 | 2.00E−23 | *Nicotiana tabacum* | NtmybA2 mRNA for Myb, complete cds. |
| 41 | G248 | AF189788 | 2.00E−22 | *Hordeum vulgare* | putative c-myb-like transcription factor (M |
| 41 | G248 | AF236059 | 3.00E−22 | *Papaver rhoeas* | putative Myb-related domain (pmr) mRNA, part |
| 41 | G248 | AF190302 | 2.00E−20 | *Secale cereale* | c-myb-like transcription factor (MYB3R-1) mR |
| 41 | G248 | BH444284 | 1.00E−18 | *Brassica oleracea* | BOGON79TF BOGO *Brassica oleracea* genomic |
| 41 | G248 | gi24417180 | 6.50E−28 | *Oryza sativa* (*japonica* cultivar-group) | myb-like protein. |
| 41 | G248 | gi7677136 | 5.80E−27 | *Adiantum raddianum* | c-myb-like transcription factor. |
| 41 | G248 | gi8745325 | 7.30E−25 | *Hordeum vulgare* | putative c-myb-like transcription factor. |
| 41 | G248 | gi8745321 | 2.30E−24 | *Physcomitrella patens* | putative c-myb-like transcription f |
| 41 | G248 | gi16326135 | 9.40E−23 | *Nicotiana tabacum* | Myb. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 41 | G248 | gi7677132 | 1.50E−22 | Secale cereale | c-myb-like transcription factor. |
| 41 | G248 | gi7630236 | 2.30E−22 | Oryza sativa | Similar to Arabidopsis thaliana chromosome 4 |
| 41 | G248 | gi7230673 | 7.10E−22 | Papaver rhoeas | putative Myb-related domain. |
| 41 | G248 | gi14269337 | 1.50E−20 | Gossypium hirsutum | myb-like transcription factor Myb 3. |
| 41 | G248 | gi14269333 | 1.60E−19 | Gossypium raimondii | myb-like transcription factor Myb 3. |
| 43 | G254 | BU100118 | 4.00E−67 | Triticum aestivum | WHE3315_D06_H11ZS Chinese Spring wheat dr |
| 43 | G254 | BI921951 | 1.00E−60 | Lycopersicon esculentum | EST541854 tomato callus Lycopersico |
| 43 | G254 | AV909036 | 1.00E−57 | Hordeum vulgare subsp. vulgare | AV909036 K. Sato unpublished |
| 43 | G254 | AW000459 | 9.00E−54 | Zea mays | 614016D07.y1 614-root cDNA library from Walbot L |
| 43 | G254 | BG457702 | 2.00E−53 | Medicago truncatula | NF034C07PL1F1051 Phosphate starved leaf |
| 43 | G254 | BU025460 | 2.00E−53 | Helianthus annuus | QHF9I05.yg.ab1 QH_EFGHJ sunflower RHA280 |
| 43 | G254 | BG593097 | 3.00E−52 | Solanum tuberosum | EST491775 cSTS Solanum tuberosum cDNA clo |
| 43 | G254 | BU868480 | 3.00E−52 | Populus balsamifera subsp. trichocarpa | M116D03 Populus flow |
| 43 | G254 | BU815973 | 5.00E−52 | Populus tremula x Populus tremuloides | N058E04 Populus bark |
| 43 | G254 | BE330818 | 1.00E−51 | Glycine max | so85g03.y1 Gm-c1041 Glycine max cDNA clone GENO |
| 43 | G254 | gi15528628 | 1.80E−25 | Oryza sativa | hypothetical protein~similar to Oryza sativa |
| 43 | G254 | gi21213868 | 3.40E−24 | Phaseolus vulgaris | LHY protein. |
| 43 | G254 | gi18461206 | 1.20E−07 | Oryza sativa (japonica cultivar-group) | contains ESTs AU10 |
| 43 | G254 | gi12005328 | 1.10E−06 | Hevea brasiliensis | unknown. |
| 43 | G254 | gi12406993 | 1.30E−06 | Hordeum vulgare | MCB1 protein. |
| 43 | G254 | gi19911577 | 5.50E−06 | Glycine max | syringolide-induced protein 1-3-1A. |
| 43 | G254 | gi6688529 | 3.90E−05 | Lycopersicon esculentum | I-box binding factor. |
| 43 | G254 | gi18874265 | 3.90E−05 | Antirrhinum majus | MYB-like transcription factor DVL1. |
| 43 | G254 | gi20067661 | 4.10E−05 | Zea mays | one repeat myb transcriptional factor. |
| 43 | G254 | gi7705206 | 0.00072 | Solanum tuberosum | MybSt1. |
| 45 | G256 | LETHM6 | 1.00E−78 | Lycopersicon esculentum | L. esculentum mRNA for myb-related t |
| 45 | G256 | AY107969 | 4.00E−78 | Zea mays | PCO069276 mRNA sequence. |
| 45 | G256 | BF270109 | 3.00E−76 | Gossypium arboreum | GA_Eb0006M14f Gossypium arboreum 7-10 d |
| 45 | G256 | AW981415 | 5.00E−75 | Medicago truncatula | EST392568 DSIL Medicago truncatula cDNA |
| 45 | G256 | BE342909 | 1.00E−72 | Solanum tuberosum | EST395753 potato stolon, Cornell Universi |
| 45 | G256 | BQ623221 | 5.00E−72 | Citrus sinensis | USDA-FP_00312 Ridge pineapple sweet orange |
| 45 | G256 | AP005636 | 1.00E−70 | Oryza sativa (japonica cultivar-group) | ( ) chromosome 9 clo |
| 45 | G256 | AAAA01005623 | 1.00E−70 | Oryza sativa (indica cultivar-group) | ( ) scaffold005623 |
| 454 | G256 | AC084762 | 8.00E−70 | Oryza sativa | chromosome 3 clone OSJNBa0013O08, *** SEQUENCI |
| 45 | G256 | BM309647 | 8.00E−67 | Glycine max | sak65a08.y1 Gm-c1036 Glycine max cDNA clone SOY |
| 45 | G256 | gi256828 | 1.10E−80 | Antirrhinum majus | Myb oncoprotein homolog {clone 306} [An |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 45 | G256 | gi1430848 | 8.20E−76 | Lycopersicon esculentum | transcription factor. |
| 45 | G256 | gi18071376 | 6.80E−71 | Oryza sativa | putative transcription factor. |
| 45 | G256 | gi23616974 | 3.60E−66 | Oryza sativa (japonica cultivar-group) | contains EST C2815 |
| 45 | G256 | gi19072744 | 4.20E−65 | Zea mays | typical P-type R2R3 Myb protein. |
| 45 | G256 | gi20563 | 7.30E−52 | Petunia x hybrida | protein 1. |
| 45 | G256 | gi6552361 | 2.90E−50 | Nicotiana tabacum | myb-related transcription factor LBM2. |
| 45 | G256 | gi13346188 | 2.30E−48 | Gossypium hirsutum | GHMYB25. |
| 45 | G256 | gi5139802 | 4.70E−48 | Glycine max | GmMYB29A1. |
| 45 | G256 | gi11526775 | 1.60E−47 | Zea mays subsp. parviglumis | P2-t protein. |
| 47 | G278 | AF527176 | 1.0e−999 | Brassica napus | putative NPR1 (NPR1) mRNA, complete cds. |
| 47 | G278 | BD064079 | 1.0e−999 | Macadamia integrifolia | Method for protecting plants. |
| 47 | G278 | AF480488 | 1.00E−162 | Nicotiana tabacum | NPR1 mRNA, complete cds. |
| 47 | G278 | AX351141 | 1.00E−106 | Oryza sativa | Sequence 15 from Patent WO0166755. |
| 47 | G278 | AX041006 | 8.00E−97 | Zea mays | Sequence 1 from Patent WO0065037. |
| 47 | G278 | AX351145 | 3.00E−95 | Triticum aestivum | Sequence 19 from Patent WO0166755. |
| 47 | G278 | AC124609 | 2.00E−75 | Medicago truncatula | clone mth2-29b13, WORKING DRAFT SEQUENC |
| 47 | G278 | AAAA01004121 | 6.00E−70 | Oryza sativa (indica cultivar-group) | ( ) scaffold004121 |
| 47 | G278 | BZ056711 | 5.00E−67 | Brassica oleracea | lle49h07.b1 B. oleracea002 Brassica olerac |
| 47 | G278 | BE435499 | 3.00E−50 | Lycopersicon esculentum | EST406577 tomato breaker fruit, TIG |
| 47 | G278 | gi22003730 | 0.00E+00 | Brassica napus | putative NPR1. |
| 47 | G278 | gi21552981 | 9.30E−155 | Nicotiana tabacum | NPR1. |
| 47 | G278 | gi10934082 | 1.40E−128 | Oryza sativa | Arabidopsis thaliana regulatory protein NPR1 |
| 47 | G278 | gi18616499 | 5.00E−92 | Triticum aestivum | unnamed protein product. |
| 47 | G278 | gi22535593 | 2.60E−88 | Oryza sativa (japonica cultivar-group) | putative Regulator |
| 47 | G278 | gi11340603 | 3.40E−86 | Zea mays | unnamed protein product. |
| 47 | G278 | gi17645766 | 0.00027 | Glycine max | unnamed protein product. |
| 47 | G278 | gi549986 | 0.012 | Pennisetum ciliare | possible apospory-associated protein. |
| 47 | G278 | gi18700703 | 0.14 | Medicago sativa | putative ankyrin-kinase. |
| 47 | G278 | gi18700701 | 0.18 | Medicago truncatula | ankyrin-kinase. |
| 49 | G291 | AF014375 | 1.00E−170 | Medicago sativa | putative JUN kinase activation domain bindi |
| 49 | G291 | AF175964 | 1.00E−169 | Lycopersicon esculentum | JAB mRNA, complete cds. |
| 49 | G291 | AF072849 | 1.00E−159 | Oryza sativa subsp. indica | jab1 protein (jab1) mRNA, comple |
| 49 | G291 | AB055495 | 1.00E−159 | Oryza sativa | Jab1 mRNA for JUN-activation-domain-binding pr |
| 49 | G291 | BG594615 | 1.00E−132 | Solanum tuberosum | EST493293 cSTS Solanum tuberosum cDNA clo |
| 49 | G291 | BQ969736 | 1.00E−125 | Helianthus annuus | QHB39G11.yg.ab1 QH_ABCDI sunflower RHA801 |
| 49 | G291 | BQ871378 | 1.00E−123 | Lactuca sativa | QGI11K21.yg.ab1 QG_ABCDI lettuce salinas Lac |
| 49 | G291 | BE036313 | 1.00E−115 | Mesembryanthemum crystallinum | MO23B10 MO Mesembryanthemum c |
| 49 | G291 | BM066924 | 1.00E−113 | Capsicum annuum | KS07019G04 KS07 Capsicum annuum cDNA, mRNA |
| 49 | G291 | BQ281547 | 1.00E−106 | Triticum aestivum | WHE3022_F07_K14ZS Wheat unstressed seedli |
| 49 | G291 | gi3320379 | 1.80E−160 | Medicago sativa | putative JUN kinase activation domain bin |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 49 | G291 | gi12002865 | 3.00E−158 | *Lycopersicon esculentum* | JAB. |
| 49 | G291 | gi17025926 | 4.30E−150 | *Oryza sativa* | JUN-activation-domain-binding protein homolo |
| 49 | G291 | gi24636586 | 4.30E−150 | *Oryza sativa* (*japonica* cultivar-group) | JUN-activation-dom |
| 49 | G291 | gi3420299 | 4.30E−150 | *Oryza sativa* subsp. *indica* | jab1 protein. |
| 49 | G291 | gi13774977 | 0.73 | *Pinus mugo* | NADH dehydrogenase subunit 3. |
| 49 | G291 | gi13774980 | 0.73 | *Pinus sylvestris* | NADH dehydrogenase subunit 3. |
| 49 | G291 | gi13899006 | 0.89 | *Abies alba* | NADH dehydrogenase subunit 3. |
| 49 | G291 | gi23503480 | 1 | *Glycine max* | heat shock protein DnaJ. |
| 51 | G303 | BI677665 | 2.00E−40 | *Robinia pseudoacacia* | CLS342 CLS (Cambium and bark region of |
| 51 | G303 | BQ995023 | 2.00E−38 | *Lactuca sativa* | QGF8N12.yg.ab1 QG_EFGHJ lettuce serriola Lac |
| 51 | G303 | AAAA01003345 | 5.00E−36 | *Oryza sativa* (*indica* cultivar-group) | ( ) scaffold003345 |
| 51 | G303 | AC121489 | 6.00E−36 | *Oryza sativa* (*japonica* cultivar-group) | ( ) chromosome 3 clo |
| 51 | G303 | BE022329 | 6.00E−35 | *Glycine max* | sm73e05.y1 Gm-c1028 *Glycine max* cDNA clone GENO |
| 51 | G303 | BI480474 | 2.00E−32 | *Triticum aestivum* | WHE2903_F02_L03ZS Wheat aluminum-stressed |
| 51 | G303 | BH492255 | 7.00E−32 | *Brassica oleracea* | BOHLS25TR BOHL *Brassica oleracea* genomic |
| 51 | G303 | BI128898 | 2.00E−30 | *Populus tremula* x *Populus tremuloides* | G083P21Y *Populus* camb |
| 51 | G303 | CAR011013 | 1.00E−29 | *Cicer arietinum* | epicotyl EST, clone Can133. |
| 51 | G303 | AW573949 | 4.00E−27 | *Medicago truncatula* | EST316540 GVN *Medicago truncatula* cDNA |
| 51 | G303 | gi19920107 | 4.50E−43 | *Oryza sativa* (*japonica* cultivar-group) | Putative helix-loo |
| 51 | G303 | gi3641870 | 4.30E−31 | *Cicer arietinum* | hypothetical protein. |
| 51 | G303 | gi10998404 | 1.90E−09 | *Petunia* x *hybrida* | anthocyanin 1. |
| 51 | G303 | gi18568238 | 2.10E−08 | *Zea mays* | regulatory protein. |
| 51 | G303 | gi527661 | 2.90E−08 | *Phyllostachys acuta* | myc-like regulatory R gene product. |
| 51 | G303 | gi1086538 | 6.10E−08 | *Oryza rufipogon* | transcriptional activator Rb homolog. |
| 51 | G303 | gi527653 | 6.10E−08 | *Pennisetum glaucum* | myc-like regulatory R gene product. |
| 51 | G303 | gi1086534 | 7.90E−08 | *Oryza officinalis* | transcriptional activator Ra homolog. |
| 51 | G303 | gi1086540 | 1.90E−07 | *Oryza sativa* | Ra. |
| 51 | G303 | gi527663 | 4.70E−07 | *Tripsacum australe* | myc-like regulatory R gene product. |
| 53 | G312 | AAAA01008118 | 1.00E−137 | *Oryza sativa* (*indica* cultivar-group) | ( ) scaffold008118 |
| 53 | G312 | BH521755 | 1.00E−69 | *Brassica oleracea* | BOHEY85TF BOHE *Brassica oleracea* genomic |
| 53 | G312 | AW944694 | 4.00E−67 | *Euphorbia esula* | 00182 leafy spurge Lambda HybriZAP 2.1 two- |
| 53 | G312 | BQ296629 | 3.00E−66 | *Glycine max* | san83a05.y2 Gm-c1052 *Glycine max* cDNA clone SOY |
| 53 | G312 | BG446635 | 7.00E−64 | *Gossypium arboreum* | GA_Eb0036G15f *Gossypium arboreum* 7-10 d |
| 53 | G312 | BH873477 | 8.00E−60 | *Zea mays* | hp45c06.b2 WGS-ZmaysF (JM107 adapted methyl filter |
| 53 | G312 | BF257184 | 4.00E−56 | *Hordeum vulgare* | HVSMEf0012B22f *Hordeum vulgare* seedling roo |
| 53 | G312 | AV414014 | 1.00E−52 | *Lotus japonicus* | AV414014 *Lotus japonicus* young plants (two- |
| 53 | G312 | AF098674 | 4.00E−52 | *Lycopersicon esculentum* | lateral suppressor protein (Ls) mRN |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 53 | G312 | AB048713 | 2.00E−51 | Pisum sativum | PsSCR mRNA for SCARECROW, complete cds. |
| 53 | G312 | gi13365610 | 1.30E−57 | Pisum sativum | SCARECROW. |
| 53 | G312 | gi10178637 | 2.60E−53 | Zea mays | SCARECROW. |
| 53 | G312 | gi13620224 | 1.30E−52 | Lycopersicon esculentum | lateral suppressor. |
| 53 | G312 | gi13937306 | 4.80E−50 | Oryza sativa | gibberellin-insensitive protein OsGAI. |
| 53 | G312 | gi20334379 | 1.80E−48 | Vitis vinifera | GAI-like protein 1. |
| 53 | G312 | gi19571020 | 5.80E−48 | Oryza sativa (japonica cultivar-group) | contains ESTs AU16 |
| 53 | G312 | gi13620166 | 4.20E−47 | Capsella rubella | hypothetical protein. |
| 53 | G312 | gi13170126 | 1.30E−45 | Brassica napus | unnamed protein product. |
| 53 | G312 | gi20257438 | 7.60E−44 | Argyroxiphium sandwicense subsp. macrocephalum | GIA/RGA-li |
| 53 | G312 | gi20257420 | 9.60E−44 | Dubautia arborea | GIA/RGA-like gibberellin response modula |
| 55 | G325 | AB001888 | 6.00E−41 | Oryza sativa | mRNA for zinc finger protein, complete cds, |
| 55 | G325 | AAAA01003074 | 3.00E−32 | Oryza sativa (indica cultivar-group) | ( ) scaffold003074 |
| 55 | G325 | BQ458955 | 2.00E−31 | Hordeum vulgare | HA02L20r HA Hordeum vulgare cDNA clone HA02 |
| 55 | G325 | AP005113 | 3.00E−31 | Oryza sativa (japonica cultivar-group) | ( ) chromosome 2 clo |
| 55 | G325 | BJ209915 | 6.00E−31 | Triticum aestivum | BJ209915 Y. Ogihara unpublished cDNA libr |
| 55 | G325 | BG644908 | 2.00E−30 | Medicago truncatula | EST506527 KV3 Medicago truncatula cDNA |
| 55 | G325 | BG459023 | 2.00E−29 | Zea mays | 947052H08.y1 947-2 week shoot from Barkan lab Ze |
| 55 | G325 | BQ121038 | 4.00E−29 | Solanum tuberosum | EST606614 mixed potato tissues Solanum tu |
| 55 | G325 | AP004972 | 4.00E−29 | Lotus japonicus | genomic DNA, chromosome 3, clone: LjT41A07, |
| 55 | G325 | BH926519 | 1.00E−28 | Brassica oleracea | odj42f08.b1 B. oleracea002 Brassica olerac |
| 55 | G325 | gi3618320 | 9.80E−48 | Oryza sativa | zinc finger protein. |
| 55 | G325 | gi3341723 | 1.70E−15 | Raphanus sativus | CONSTANS-like 1 protein. |
| 55 | G325 | gi22854952 | 2.20E−15 | Brassica nigra | COL1 protein. |
| 55 | G325 | gi2303683 | 2.00E−14 | Brassica napus | unnamed protein product. |
| 55 | G325 | gi23495871 | 2.30E−13 | Oryza sativa (japonica cultivar-group) | putative zinc-fing |
| 55 | G325 | gi4091806 | 3.80E−13 | Malus x domestica | CONSTANS-like protein 2. |
| 55 | G325 | gi10946337 | 6.20E−13 | Ipomoea nil | CONSTANS-like protein. |
| 55 | G325 | gi21667475 | 2.00E−11 | Hordeum vulgare | CONSTANS-like protein. |
| 55 | G325 | gi4557093 | 1.10E−10 | Pinus radiata | zinc finger protein. |
| 55 | G325 | gi21655154 | 1.20E−09 | Hordeum vulgare subsp. vulgare | CONSTANS-like protein CO5. |
| 57 | G343 | AC069300 | 2.00E−50 | Oryza sativa | chromosome 10 clone OSJNBa0010C11, *** SEQUENC |
| 57 | G343 | BU827056 | 4.00E−50 | Populus tremula x Populus tremuloides | UK127TH09 Populus api |
| 57 | G343 | AAAA01001158 | 1.00E−47 | Oryza sativa (indica cultivar-group) | ( ) scaffold001158 |
| 57 | G343 | BQ462644 | 3.00E−41 | Hordeum vulgare | HI01J05T HI Hordeum vulgare cDNA clone HI01 |
| 57 | G343 | AW235021 | 4.00E−41 | Glycine max | sf21h11.y1 Gm-c1028 Glycine max cDNA clone GENO |
| 57 | G343 | BZ328210 | 8.00E−41 | Zea mays | id36b06.g1 WGS-ZmaysF (JM107 adapted methyl filter |
| 57 | G343 | BH534811 | 1.00E−40 | Brassica oleracea | BOGJZ23TF BOGJ Brassica oleracea genomic |
| 57 | G343 | BQ851743 | 2.00E−37 | Lactuca sativa | QGB16C22.yg.ab1 QG_ABCDI lettuce salinas Lac |
| 57 | G343 | AW922818 | 5.00E−37 | Sorghum bicolor | DG1_46_F02.g1_A002 Dark Grown 1 (DG1) Sorgh |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 57 | G343 | AC132491 | 9.00E−37 | Oryza sativa (japonica cultivar-group) | ( ) chromosome 5 clo |
| 57 | G343 | gi14165317 | 2.10E−57 | Oryza sativa | putative transcription factor. |
| 57 | G343 | gi21902044 | 6.50E−45 | Oryza sativa (japonica cultivar-group) | hypothetical prote |
| 57 | G343 | gi12711287 | 1.60E−31 | Nicotiana tabacum | GATA-1 zinc finger protein. |
| 57 | G343 | gi1076609 | 4.40E−22 | Nicotiana plumbaginifolia | NTL1 protein-curled-leaved to |
| 57 | G343 | gi20372847 | 0.34 | Hordeum vulgare subsp. vulgare | dof zinc finger protein. |
| 57 | G343 | gi19322 | 0.41 | Lycopersicon esculentum | glycine-rich protein. |
| 57 | G343 | gi21439754 | 0.55 | Zea mays | unnamed protein product. |
| 57 | G343 | gi3219155 | 0.55 | Mesembryanthemum crystallinum | transcription factor Vp1. |
| 57 | G343 | gi23504757 | 0.59 | Pisum sativum | nodule inception protein. |
| 57 | G343 | gi21439770 | 0.67 | Triticum aestivum | unnamed protein product. |
| 59 | G353 | BQ790831 | 5.00E−68 | Brassica rapa subsp. pekinensis | E4675 Chinese cabbage etiol |
| 59 | G353 | BZ019752 | 1.00E−67 | Brassica oleracea | oed85c06.g1 B. oleracea002 Brassica olerac |
| 59 | G353 | L46574 | 6.00E−40 | Brassica rapa | BNAF1975 Mustard flower buds Brassica rapa PL cD |
| 59 | G353 | AB006601 | 7.00E−26 | Petunia x hybrida | mRNA for ZPT2-14, complete cds. |
| 59 | G353 | BM437146 | 2.00E−25 | Vitis vinifera | VVA015A06_53787 An expressed sequence tag da |
| 59 | G353 | BI422808 | 1.00E−24 | Lycopersicon esculentum | EST533474 tomato callus, TAMU Lycop |
| 59 | G353 | BU867080 | 1.00E−24 | Populus tremula x Populus tremuloides | S074B01 Populus imbib |
| 59 | G353 | BM527789 | 3.00E−23 | Glycine max | sal65h07.y1 Gm-c1061 Glycine max cDNA clone SOY |
| 59 | G353 | BQ980246 | 5.00E−23 | Lactuca sativa | QGE10I12.yg.ab1 QG_EFGHJ lettuce serriola La |
| 59 | G353 | BQ121106 | 2.00E−22 | Solanum tuberosum | EST606682 mixed potato tissues Solanum tu |
| 59 | G353 | gi2346976 | 6.50E−28 | Petunia x hybrida | ZPT2-13. |
| 59 | G353 | gi15623820 | 4.40E−25 | Oryza sativa | hypothetical protein. |
| 59 | G353 | gi21104613 | 1.40E−18 | Oryza sativa (japonica cultivar-group) | contains ESTs AU07 |
| 59 | G353 | gi485814 | 3.10E−13 | Triticum aestivum | WZF1. |
| 59 | G353 | gi7228329 | 4.00E−12 | Medicago sativa | putative TFIIIA (or kruppel)-like zinc fi |
| 59 | G353 | gi1763063 | 1.70E−11 | Glycine max | SCOF-1. |
| 59 | G353 | gi2981169 | 2.60E−11 | Nicotiana tabacum | osmotic stress-induced zinc-finger prot |
| 59 | G353 | gi4666360 | 1.10E−10 | Datisca glomerata | zinc-finger protein 1. |
| 59 | G353 | gi2129892 | 2.30E−08 | Pisum sativum | probable finger protein Pszf1-garden pea. |
| 59 | G353 | gi2058504 | 0.00018 | Brassica rapa | zinc-finger protein-1. |
| 61 | G354 | BZ083260 | 5.00E−49 | Brassica oleracea | lle29f02.g1 B. oleracea002 Brassica olerac |
| 61 | G354 | BQ790831 | 8.00E−45 | Brassica rapa subsp. pekinensis | E4675 Chinese cabbage etiol |
| 61 | G354 | AB006600 | 6.00E−27 | Petunia x hybrida | mRNA for ZPT2-13, complete cds. |
| 61 | G354 | L46574 | 1.00E−26 | Brassica rapa | BNAF1975 Mustard flower buds Brassica rapa cD |
| 61 | G354 | BM437146 | 3.00E−24 | Vitis vinifera | VVA015A06_53787 An expressed sequence tag da |
| 61 | G354 | BQ121105 | 6.00E−24 | Solanum tuberosum | EST606681 mixed potato tissues Solanum tu |
| 61 | G354 | BM527789 | 2.00E−23 | Glycine max | sal65h07.y1 Gm-c1061 Glycine max cDNA clone SOY |
| 61 | G354 | AI898309 | 2.00E−23 | Lycopersicon esculentum | EST267752 tomato ovary, TAMU Lycope |
| 61 | G354 | BU867080 | 5.00E−22 | Populus tremula x Populus tremuloides | S074B01 Populus imbib |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 61 | G354 | BQ980246 | 1.00E−21 | Lactuca sativa | QGE10I12.yg.ab1 QG_EFGHJ lettuce serriola La |
| 61 | G354 | gi2346976 | 5.60E−29 | Petunia x hybrida | ZPT2-13. |
| 61 | G354 | gi15623820 | 1.90E−22 | Oryza sativa | hypothetical protein. |
| 61 | G354 | gi21104613 | 4.00E−19 | Oryza sativa (japonica cultivar-group) | contains ESTs AU07 |
| 61 | G354 | gi2981169 | 1.80E−17 | Nicotiana tabacum | osmotic stress-induced zinc-finger prot |
| 61 | G354 | gi1763063 | 4.10E−16 | Glycine max | SCOF-1. |
| 61 | G354 | gi4666360 | 8.90E−15 | Datisca glomerata | zinc-finger protein 1. |
| 61 | G354 | gi2058504 | 1.00E−14 | Brassica rapa | zinc-finger protein-1. |
| 61 | G354 | gi7228329 | 4.90E−14 | Medicago sativa | putative TFIIIA (or kruppel)-like zinc fi |
| 61 | G354 | gi485814 | 3.20E−13 | Triticum aestivum | WZF1. |
| 61 | G354 | gi2129892 | 1.20E−06 | Pisum sativum | probable finger protein Pszf1-garden pea. |
| 63 | G361 | BG135559 | 1.00E−24 | Lycopersicon esculentum | EST468451 tomato crown gall Lycoper |
| 63 | G361 | AW686309 | 4.00E−23 | Medicago truncatula | NF036D10NR1F1000 Nodulated root Medicag |
| 63 | G361 | BU891880 | 8.00E−23 | Populus tremula | P056E03 Populus petioles cDNA library Popul |
| 63 | G361 | BU877646 | 2.00E−22 | Populus balsamifera subsp. trichocarpa | V037D09 Populus flow |
| 63 | G361 | BH725134 | 9.00E−22 | Brassica oleracea | BOHWL71TF BO_2_3_KB Brassica oleracea gen |
| 63 | G361 | BI426538 | 2.00E−21 | Glycine max | sag04d12.y1 Gm-c1080 Glycine max cDNA clone GEN |
| 63 | G361 | AP003214 | 2.00E−21 | Oryza sativa | chromosome 1 clone OSJNBa0083M16, *** SEQUENCI |
| 63 | G361 | AAAA01004859 | 3.00E−21 | Oryza sativa (indica cultivar-group) | ( ) scaffold004859 |
| 63 | G361 | BU494379 | 1.00E−20 | Lotus japonicus | Ljirnpest50-154-h2 Ljirnp Lambda HybriZap t |
| 63 | G361 | BQ488216 | 2.00E−17 | Beta vulgaris | 35-E8143-006-003-J02-T3 Sugar beet MPIZ-ADIS- |
| 63 | G361 | gi15528588 | 4.00E−29 | Oryza sativa | hypothetical protein. |
| 63 | G361 | gi18390109 | 2.80E−13 | Sorghum bicolor | putative zinc finger protein. |
| 63 | G361 | gi18674684 | 1.50E−07 | Zea ramosa | unnamed protein product. |
| 63 | G361 | gi14275902 | 6.10E−07 | Petunia x hybrida | lateral shoot inducing factor. |
| 63 | G361 | gi21104613 | 0.00024 | Oryza sativa (japonica cultivar-group) | contains ESTs AU07 |
| 63 | G361 | gi2129892 | 0.00062 | Pisum sativum | probable finger protein Pszf1-garden pea. |
| 63 | G361 | gi2058504 | 0.0018 | Brassica rapa | zinc-finger protein-1. |
| 63 | G361 | gi4666360 | 0.018 | Datisca glomerata | zinc-finger protein 1. |
| 63 | G361 | gi7228329 | 0.047 | Medicago sativa | putative TFIIIA (or kruppel)-like zinc fi |
| 63 | G361 | gi1763063 | 0.084 | Glycine max | SCOF-1. |
| 65 | G362 | BF645161 | 6.00E−21 | Medicago truncatula | NF031C06EC1F1049 Elicited cell culture |
| 65 | G362 | BI206903 | 6.00E−21 | Lycopersicon esculentum | EST524943 cTOS Lycopersicon esculen |
| 65 | G362 | BG047435 | 1.00E−18 | Glycine max | saa71c12.y1 Gm-c1060 Glycine max cDNA clone GEN |
| 65 | G362 | BU877646 | 2.00E−15 | Populus balsamifera subsp. trichocarpa | V037D09 Populus flow |
| 65 | G362 | BU891880 | 2.00E−15 | Populus tremula | P056E03 Populus petioles cDNA library Popul |
| 65 | G362 | AP003214 | 3.00E−13 | Oryza sativa | chromosome 1 clone OSJNBa0083M16, *** SEQUENCI |
| 65 | G362 | AAAA01004859 | 3.00E−13 | Oryza sativa (indica cultivar-group) | ( ) scaffold004859 |
| 65 | G362 | BE358938 | 2.00E−11 | Sorghum bicolor | DG1_37_E12.b1_A002 Dark Grown 1 (DG1) Sorgh |
| 65 | G362 | BQ488435 | 2.00E−11 | Beta vulgaris | 05-E8886-006-003-J02-T3 Sugar beet MPIZ-ADIS- |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 65 | G362 | BU494379 | 3.00E−11 | Lotus japonicus | Ljirnpest50-154-h2 Ljirnp Lambda HybriZap t |
| 65 | G362 | gi15528588 | 2.70E−18 | Oryza sativa | hypothetical protein. |
| 65 | G362 | gi2346984 | 9.00E−09 | Petunia x hybrida | ZPT2-9. |
| 65 | G362 | gi18390109 | 9.90E−08 | Sorghum bicolor | putative zinc finger protein. |
| 65 | G362 | gi21104613 | 0.00015 | Oryza sativa (japonica cultivar-group) | contains ESTs AU07 |
| 65 | G362 | gi18674684 | 0.0028 | Zea ramosa | unnamed protein product. |
| 65 | G362 | gi7228329 | 0.0029 | Medicago sativa | putative TFIIIA (or kruppel)-like zinc fi |
| 65 | G362 | gi1763063 | 0.0039 | Glycine max | SCOF-1. |
| 65 | G362 | gi485814 | 0.0062 | Triticum aestivum | WZF1. |
| 65 | G362 | gi4666360 | 0.0072 | Datisca glomerata | zinc-finger protein 1. |
| 65 | G362 | gi2058504 | 0.019 | Brassica rapa | zinc-finger protein-1. |
| 67 | G371 | CA799489 | 2.00E−38 | Glycine max | sat34e06.y1 Gm-c1056 Glycine max cDNA clone SOY |
| 67 | G371 | AF265664 | 2.00E−32 | Solanum tuberosum | resistance gene cluster, complete sequenc |
| 67 | G371 | AJ497824 | 2.00E−31 | Medicago truncatula | AJ497824 MTFLOW Medicago truncatula cDN |
| 67 | G371 | AY129244 | 4.00E−31 | Populus x canescens | putative RING protein (RING) mRNA, comp |
| 67 | G371 | BM985575 | 1.00E−30 | Thellungiella halophila | 1_F12_T3 Ath Thellungiella halophil |
| 67 | G371 | BF051105 | 2.00E−30 | Lycopersicon esculentum | EST436280 tomato developing/immatur |
| 67 | G371 | BU834871 | 2.00E−30 | Populus tremula x Populus tremuloides | T066G02 Populus apica |
| 67 | G371 | BM300635 | 5.00E−25 | Mesembryanthemum crystallinum | MCA054H03_21640 Ice plant Lam |
| 67 | G371 | BQ586594 | 1.00E−24 | Beta vulgaris | E012388-024-012-I21-SP6 MPIZ-ADIS-024-leaf Be |
| 67 | G371 | BU880207 | 1.00E−24 | Populus balsamifera subsp. trichocarpa | UM42TH03 Populus flo |
| 67 | G371 | gi22795037 | 8.80E−24 | Populus x canescens | putative RING protein. |
| 67 | G371 | gi15289911 | 2.20E−21 | Oryza sativa | hypothetical protein~similar to Arabidopsis |
| 67 | G371 | gi22535577 | 2.20E−21 | Oryza sativa (japonica cultivar-group) | hypothetical prote |
| 67 | G371 | gi7688063 | 0.00026 | Pisum sativum | constitutively photomorphogenic 1 protein. |
| 67 | G371 | gi18129286 | 0.0057 | Pinus pinaster | putative RING zinc finger protein. |
| 67 | G371 | gi22775495 | 0.014 | Arabis gemmifera | similar to A. thaliana AT4g08590. |
| 67 | G371 | gi15029364 | 0.015 | Rosa hybrid cultivar | photoregulatory zinc-finger protein |
| 67 | G371 | gi7592844 | 0.025 | Oryza sativa subsp. japonica | COP1. |
| 67 | G371 | gi25044835 | 0.059 | Ananas comosus | RING zinc finger protein. |
| 67 | G371 | gi11127996 | 0.12 | Ipomoea nil | COP1. |
| 69 | G390 | AB084381 | 1.0e−999 | Zinnia elegans | ZeHB-11 mRNA for homoeobox leucine-zipper pr |
| 69 | G390 | AB032182 | 1.0e−999 | Physcomitrella patens | PpHB10 mRNA for homeobox protein PpHB |
| 69 | G390 | AY105765 | 1.0e−999 | Zea mays | PCO144112 mRNA sequence. |
| 69 | G390 | AAAA01006159 | 1.0e−999 | Oryza sativa (indica cultivar-group) | ( ) scaffold006159 |
| 69 | G390 | AP003197 | 1.00E−177 | Oryza sativa | chromosome 1 clone B1015E06, *** SEQUENCING IN |
| 69 | G390 | BQ857624 | 1.00E−106 | Lactuca sativa | QGB8A10.yg.ab1 QG_ABCDI lettuce salinas Lact |
| 69 | G390 | BI925551 | 1.00E−101 | Lycopersicon esculentum | EST545440 tomato flower, buds 0-3 m |
| 69 | G390 | AW686191 | 1.00E−100 | Medicago truncatula | NF035A10NR1F1000 Nodulated root Medicag |
| 69 | G390 | CA032516 | 1.00E−90 | Hordeum vulgare subsp. vulgare | HX13F16r HX Hordeum vulgare |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 69 | G390 | BQ116871 | 8.00E−90 | *Solanum tuberosum* | EST602447 mixed potato tissues *Solanum* tu |
| 69 | G390 | gi24417149 | 1.00E−299 | *Zinnia elegans* | homoeobox leucine-zipper protein. |
| 69 | G390 | gi13384370 | 8.40E−280 | *Oryza sativa* | putative homeodomain-leucine zipper protein. |
| 69 | G390 | gi24431605 | 4.10E−274 | *Oryza sativa (japonica* cultivar-group) | Putative homeodoma |
| 69 | G390 | gi7209912 | 2.80E−244 | *Physcomitrella patens* | homeobox protein PpHB10. |
| 69 | G390 | gi3868829 | 4.50E−32 | *Ceratopteris richardii* | CRHB1. |
| 69 | G390 | gi19070143 | 5.00E−22 | *Picea abies* | homeodomain protein HB2. |
| 69 | G390 | gi1173622 | 1.10E−21 | *Phalaenopsis* sp. SM9108 | homeobox protein. |
| 69 | G390 | gi2147484 | 1.10E−21 | *Phalaenopsis* sp. | homeotic protein, ovule-specific-Phala |
| 69 | G390 | gi8920427 | 2.30E−20 | *Zea mays* | OCL5 protein. |
| 69 | G390 | gi18481701 | 7.70E−19 | *Sorghum bicolor* | OCL5 protein. |
| 71 | G391 | AB084381 | 1.0e−999 | *Zinnia elegans* | ZeHB-11 mRNA for homoeobox leucine-zipper pr |
| 71 | G391 | AB032182 | 1.0e−999 | *Physcomitrella patens* | PpHB10 mRNA for homeobox protein PpHB |
| 71 | G391 | AY105765 | 1.0e−999 | *Zea mays* | PCO144112 mRNA sequence. |
| 71 | G391 | AAAA01006159 | 1.00E−146 | *Oryza sativa (indica* cultivar-group) | ( ) scaffold006159 |
| 71 | G391 | BQ857624 | 1.00E−111 | *Lactuca sativa* | QGB8A10.yg.ab1 QG_ABCDI lettuce salinas Lact |
| 71 | G391 | AP003197 | 1.00E−106 | *Oryza sativa* | chromosome 1 clone B1015E06, *** SEQUENCING IN |
| 71 | G391 | BI925551 | 1.00E−102 | *Lycopersicon esculentum* | EST545440 tomato flower, buds 0-3 m |
| 71 | G391 | AW686191 | 1.00E−102 | *Medicago truncatula* | NF035A10NR1F1000 Nodulated root Medicag |
| 71 | G391 | CA032516 | 1.00E−92 | *Hordeum vulgare* subsp. *vulgare* | HX13F16r HX *Hordeum vulgare* |
| 71 | G391 | BQ116871 | 6.00E−91 | *Solanum tuberosum* | EST602447 mixed potato tissues *Solanum* tu |
| 71 | G391 | gi24417149 | 5.3e−310 | *Zinnia elegans* | homoeobox leucine-zipper protein. |
| 71 | G391 | gi13384370 | 3.20E−296 | *Oryza sativa* | putative homeodomain-leucine zipper protein. |
| 71 | G391 | gi24431605 | 7.10E−283 | *Oryza sativa (japonica* cultivar-group) | Putative homeodoma |
| 71 | G391 | gi7209912 | 4.60E−255 | *Physcomitrella patens* | homeobox protein PpHB10. |
| 71 | G391 | gi3868829 | 6.30E−33 | *Ceratopteris richardii* | CRHB1. |
| 71 | G391 | gi18481701 | 9.10E−24 | *Sorghum bicolor* | OCL5 protein. |
| 71 | G391 | gi12002853 | 3.50E−23 | *Picea abies* | homeobox 1. |
| 71 | G391 | gi1173622 | 1.20E−22 | *Phalaenopsis* sp. SM9108 | homeobox protein. |
| 71 | G391 | gi2147484 | 1.20E−22 | *Phalaenopsis* sp. | homeotic protein, ovule-specific-Phala |
| 71 | G391 | gi8920427 | 9.30E−22 | *Zea mays* | OCL5 protein. |
| 73 | G409 | BG044206 | 2.00E−66 | *Glycine max* | saa25c02.y1 Gm-c1059 *Glycine max* cDNA clone GEN |
| 73 | G409 | AF443621 | 3.00E−66 | *Craterostigma plantagineum* | homeodomain leucine zipper prote |
| 73 | G409 | AW220361 | 6.00E−60 | *Lycopersicon esculentum* | EST302844 tomato root during/after |
| 73 | G409 | AF402606 | 5.00E−58 | *Phaseolus vulgaris* | homeodomain leucine zipper protein HDZ3 |
| 73 | G409 | AY105265 | 2.00E−56 | *Zea mays* | PCO062717 mRNA sequence. |
| 73 | G409 | BQ165293 | 2.00E−51 | *Medicago truncatula* | EST611162 KVKC *Medicago truncatula* cDNA |
| 73 | G409 | BH570275 | 1.00E−50 | *Brassica oleracea* | BOHAF65TF BOHA *Brassica oleracea* genomic |
| 73 | G409 | BF620380 | 1.00E−48 | *Hordeum vulgare* | HVSMEc0019K16f *Hordeum vulgare* seedling sho |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 73 | G409 | BF588126 | 2.00E−48 | Sorghum propinquum | FM1_38_A10.b1_A003 Floral-Induced Merist |
| 73 | G409 | AF145729 | 5.00E−45 | Oryza sativa | homeodomain leucine zipper protein (hox5) mRNA |
| 73 | G409 | gi18034441 | 4.10E−65 | Craterostigma plantagineum | homeodomain leucine zipper pro |
| 73 | G409 | gi15148920 | 1.10E−57 | Phaseolus vulgaris | homeodomain leucine zipper protein HDZ |
| 73 | G409 | gi5006855 | 7.20E−45 | Oryza sativa | homeodomain leucine zipper protein. |
| 73 | G409 | gi1435021 | 9.00E−38 | Daucus carota | DNA-binding protein. |
| 73 | G409 | gi6018089 | 1.50E−37 | Glycine max | homeodomain-leucine zipper protein 57. |
| 73 | G409 | gi1161575 | 2.20E−36 | Lycopersicon esculentum | homeobox. |
| 73 | G409 | gi11231065 | 1.40E−34 | Zinnia elegans | homeobox-leucine zipper protein. |
| 73 | G409 | gi7415614 | 1.40E−34 | Physcomitrella patens | homeobox protein PpHB1. |
| 73 | G409 | gi8133126 | 4.10E−33 | Brassica rapa subsp. pekinensis | hb-6-like protein. |
| 73 | G409 | gi22651698 | 1.80E−32 | Nicotiana tabacum | homeodomain protein Hfi22. |
| 75 | G427 | MDKNOX1 | 1.00E−143 | Malus domestica | M. domestica mRNA for knotted1-like homeobox |
| 75 | G427 | AB004797 | 1.00E−136 | Nicotiana tabacum | NTH23 mRNA, complete cds. |
| 75 | G427 | LEU76409 | 1.00E−132 | Lycopersicon esculentum | homeobox 1 protein (THox1) mRNA, pa |
| 75 | G427 | AB043957 | 1.00E−118 | Ceratopteris richardii | mRNA for CRKNOX3, complete cds. |
| 75 | G427 | AW560103 | 1.00E−115 | Medicago truncatula | EST315151 DSIR Medicago truncatula cDNA |
| 75 | G427 | AB061818 | 1.00E−112 | Oryza sativa | HOS59 mRNA for KNOX family class 2 homeodomain |
| 75 | G427 | BQ873924 | 1.00E−100 | Lactuca sativa | QGI2O22.yg.ab1 QG_ABCDI lettuce salinas Lact |
| 75 | G427 | BNHDIBOX | 9.00E−99 | Brassica napus | B. napus hd1 mRNA for homeodomain-containing |
| 75 | G427 | AY104273 | 8.00E−93 | Zea mays | PCO147946 mRNA sequence. |
| 75 | G427 | BM063854 | 1.00E−91 | Capsicum annuum | KS01060C11 KS01 Capsicum annuum cDNA, mRNA |
| 75 | G427 | gi1946222 | 5.10E−131 | Malus domestica | knotted1-like homeobox protein. |
| 75 | G427 | gi3116212 | 3.40E−125 | Nicotiana tabacum | homeobox gene. |
| 75 | G427 | gi4098244 | 8.10E−124 | Lycopersicon esculentum | homeobox 1 protein. |
| 75 | G427 | gi1805618 | 3.60E−121 | Oryza sativa | OSH45 transcript. |
| 75 | G427 | gi11463943 | 2.50E−113 | Ceratopteris richardii | CRKNOX3. |
| 75 | G427 | gi1076449 | 1.40E−94 | Brassica napus | homeodomain-containing protein-rape. |
| 75 | G427 | gi14348597 | 1.00E−93 | Physcomitrella patens | class 2 KNOTTED1-like protein MKN1- |
| 75 | G427 | gi6016216 | 2.80E−43 | Zea mays | HOMEOBOX PROTEIN KNOTTED-1 LIKE 2. |
| 75 | G427 | gi20977642 | 1.70E−34 | Helianthus annuus | knotted-1-like protein 1. |
| 75 | G427 | gi3327269 | 6.50E−34 | Ipomoea nil | PKn1. |
| 77 | G438 | ZEL312053 | 1.0e−999 | Zinnia elegans | mRNA for HD-Zip protein (hb1 gene). |
| 77 | G438 | AB032182 | 1.0e−999 | Physcomitrella patens | PpHB10 mRNA for homeobox protein PpHB |
| 77 | G438 | AY105765 | 1.0e−999 | Zea mays | PCO144112 mRNA sequence. |
| 77 | G438 | AAAA01006159 | 1.00E−165 | Oryza sativa (indica cultivar-group) | ( ) scaffold006159 |
| 77 | G438 | BU002601 | 1.00E−120 | Lactuca sativa | QGG31N03.yg.ab1 QG_EFGHJ lettuce serriola La |
| 77 | G438 | BE035416 | 1.00E−106 | Mesembryanthemum crystallinum | MO05A06 MO Mesembryanthemum c |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 77 | G438 | BQ578798 | 1.00E−104 | Triticum aestivum | WHE0309_H06_O11ZS Wheat unstressed seedli |
| 77 | G438 | BU927293 | 1.00E−103 | Glycine max | sas97g12.y1 Gm-c1036 Glycine max cDNA clone SOY |
| 77 | G438 | AW696625 | 1.00E−102 | Medicago truncatula | NF109B06ST1F1048 Developing stem Medica |
| 77 | G438 | BU041905 | 7.00E−89 | Prunus persica | PP_LEa0010O09f Peach developing fruit mesoca |
| 77 | G438 | gi18076736 | 1.0e−999 | Zinnia elegans | HD-Zip protein. |
| 77 | G438 | gi13384370 | 1.0e−999 | Oryza sativa | putative homeodomain-leucine zipper protein. |
| 77 | G438 | gi24431605 | 3.3e−317 | Oryza sativa (japonica cultivar-group) | Putative homeodoma |
| 77 | G438 | gi7209912 | 4.90E−238 | Physcomitrella patens | homeobox protein PpHB10. |
| 77 | G438 | gi3868829 | 3.40E−35 | Ceratopteris richardii | CRHB1. |
| 77 | G438 | gi18481701 | 4.00E−21 | Sorghum bicolor | OCL5 protein. |
| 77 | G438 | gi1173622 | 8.50E−21 | Phalaenopsis sp. SM9108 | homeobox protein. |
| 77 | G438 | gi2147484 | 8.50E−21 | Phalaenopsis sp. | homeotic protein, ovule-specific-Phala |
| 77 | G438 | gi12002853 | 1.40E−20 | Picea abies | homeobox 1. |
| 77 | G438 | gi8920427 | 3.20E−20 | Zea mays | OCL5 protein. |
| 79 | G450 | BQ155060 | 2.00E−84 | Medicago truncatula | NF075G11IR1F1088 Irradiated Medicago tr |
| 79 | G450 | PTR306829 | 5.00E−83 | Populus tremula x Populus tremuloides | mRNA for aux/IAA pro |
| 79 | G450 | BE053029 | 1.00E−81 | Gossypium arboreum | GA_Ea0031O18f Gossypium arboreum 7-10 d |
| 79 | G450 | BI179192 | 1.00E−79 | Solanum tuberosum | EST520137 cSTE Solanum tuberosum cDNA clo |
| 79 | G450 | BU006959 | 5.00E−78 | Lactuca sativa | QGH12O02.yg.ab1 QG_EFGHJ lettuce serriola La |
| 79 | G450 | AF123508 | 8.00E−75 | Nicotiana tabacum | Nt-iaa28 deduced protein mRNA, complete c |
| 79 | G450 | BQ623078 | 2.00E−72 | Citrus sinensis | USDA-FP_00169 Ridge pineapple sweet orange |
| 79 | G450 | BI470140 | 7.00E−72 | Glycine max | sah88c10.y1 Gm-c1050 Glycine max cDNA clone GEN |
| 79 | G450 | BU892057 | 7.00E−72 | Populus tremula | P058G09 Populus petioles cDNA library Popul |
| 79 | G450 | AA427337 | 4.00E−71 | Pisum sativum | P482 Whero seedling lambda ZapII cDNA library |
| 79 | G450 | gi20385508 | 4.20E−79 | Populus tremula x Populus tremuloides | auxin-regulated pro |
| 79 | G450 | gi4887020 | 2.90E−73 | Nicotiana tabacum | Nt-iaa28 deduced protein. |
| 79 | G450 | gi114734 | 1.10E−69 | Glycine max | AUXIN-INDUCED PROTEIN AUX28. |
| 79 | G450 | gi22725714 | 2.00E−65 | Mirabilis jalapa | auxin-responsive protein IAA1; MjAux/IAA |
| 79 | G450 | gi17976835 | 2.10E−61 | Pinus pinaster | putative auxin induced transcription facto |
| 79 | G450 | gi6136832 | 4.20E−57 | Cucumis sativus | CS-IAA2. |
| 79 | G450 | gi20257219 | 1.80E−56 | Zinnia elegans | auxin-regulated protein. |
| 79 | G450 | gi17154533 | 2.10E−54 | Oryza sativa | putative IAA1 protein. |
| 79 | G450 | gi22531416 | 5.30E−47 | Gossypium hirsutum | IAA16 protein. |
| 79 | G450 | gi21104740 | 1.00E−43 | Oryza sativa (japonica cultivar-group) | contains EST AU091 |
| 81 | G464 | BH998146 | 2.00E−50 | Brassica oleracea | oef97f09.g1 B. oleracea002 Brassica olerac |
| 81 | G464 | BU043737 | 2.00E−44 | Prunus persica | PP_LEa0017A10f Peach 81developing fruit mesoca |
| 81 | G464 | PTR306828 | 5.00E−44 | Populus tremula x Populus tremuloides | mRNA for aux/IAA pro |
| 81 | G464 | BI207567 | 6.00E−44 | Lycopersicon esculentum | EST525607 cTOS Lycopersicon esculen |
| 81 | G464 | BQ592350 | 1.00E−35 | Beta vulgaris | E012681-024-020-J14-SP6 MPIZ-ADIS-024-develop |
| 81 | G464 | AV933892 | 4.00E−35 | Hordeum vulgare subsp. vulgare | AV933892 K. Sato unpublished |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 81 | G464 | BQ505545 | 5.00E−35 | Solanum tuberosum | EST612960 Generation of a set of potato c |
| 81 | G464 | BE364015 | 3.00E−34 | Sorghum bicolor | PI1_11_G02.b1_A002 Pathogen induced 1 (PI1) |
| 81 | G464 | BI118786 | 3.00E−34 | Oryza sativa | EST174 Differentially expressed cDNA libraries |
| 81 | G464 | AI725624 | 9.00E−32 | Gossypium hirsutum | BNLGHi12459 Six-day Cotton fiber Gossypi |
| 81 | G464 | gi20269057 | 1.60E−38 | Populus tremula x Populus tremuloides | aux/IAA protein. |
| 81 | G464 | gi17976835 | 5.40E−32 | Pinus pinaster | putative auxin induced transcription facto |
| 81 | G464 | gi5139697 | 2.00E−30 | Cucumis sativus | expressed in cucumber hypocotyls. |
| 81 | G464 | gi22725714 | 6.30E−30 | Mirabilis jalapa | auxin-responsive protein IAA1; MjAux/IAA |
| 81 | G464 | gi17154533 | 1.30E−29 | Oryza sativa | putative IAA1 protein. |
| 81 | G464 | gi20257219 | 4.40E−29 | Zinnia elegans | auxin-regulated protein. |
| 81 | G464 | gi2388689 | 4.40E−29 | Glycine max | GH1 protein. |
| 81 | G464 | gi16610193 | 1.10E−27 | Nicotiana tabacum | IAA9 protein. |
| 81 | G464 | gi1352057 | 3.60E−27 | Pisum sativum | AUXIN-INDUCED PROTEIN IAA4. |
| 81 | G464 | gi21104740 | 5.80E−27 | Oryza sativa (japonica cultivar-group) | contains EST AU091 |
| 83 | G470 | AB071293 | 1.0e−999 | Oryza sativa | OsARF2 mRNA for auxin response factor 2, parti |
| 83 | G470 | OSA306306 | 1.0e−999 | Oryza sativa (japonica cultivar-group) | Oryza sativa subsp. |
| 83 | G470 | AC126794 | 1.0e−999 | Medicago truncatula | clone mth2-24j7, WORKING DRAFT SEQUENCE |
| 83 | G470 | AY106228 | 1.00E−131 | Zea mays | PCO137716 mRNA sequence. |
| 83 | G470 | BQ578824 | 1.00E−118 | Triticum aestivum | WHE0407_B10_D19ZS Wheat etiolated seedlin |
| 83 | G470 | BG045095 | 1.00E−108 | Glycine max | saa36f10.y1 Gm-c1059 Glycine max cDNA clone GEN |
| 83 | G470 | CA030942 | 1.00E−102 | Hordeum vulgare subsp. vulgare | HX08J07r HX Hordeum vulgare |
| 83 | G470 | BI098203 | 4.00E−96 | Sorghum bicolor | IP1_29_D05.b1_A002 Immature pannicle 1 (IP1 |
| 83 | G470 | BG886848 | 5.00E−96 | Solanum tuberosum | EST512699 cSTD Solanum tuberosum cDNA clo |
| 83 | G470 | AI774352 | 7.00E−95 | Lycopersicon esculentum | EST255368 tomato resistant, Cornell |
| 83 | G470 | gi20805236 | 8.60E−223 | Oryza sativa (japonica cultivar-group) | auxin response fac |
| 83 | G470 | gi19352039 | 6.10E−222 | Oryza sativa | auxin response factor 2. |
| 83 | G470 | gi24785191 | 7.00E−70 | Nicotiana tabacum | hypothetical protein. |
| 83 | G470 | gi23343944 | 5.70E−16 | Mirabilis jalapa | auxin-responsive factor protein. |
| 83 | G470 | gi20269053 | 1.70E−08 | Populus tremula x Populus tremuloides | aux/IAA protein. |
| 83 | G470 | gi6136834 | 4.80E−07 | Cucumis sativus | CS-IAA3. |
| 83 | G470 | gi287566 | 2.50E−06 | Vigna radiata | ORF. |
| 83 | G470 | gi16610209 | 5.20E−06 | Physcomitrella patens | IAA/AUX protein. |
| 83 | G470 | gi114733 | 8.60E−06 | Glycine max | AUXIN-INDUCED PROTEIN AUX22. |
| 83 | G470 | gi18697008 | 4.00E−05 | Zea mays | unnamed protein product. |
| 85 | G477 | BH981212 | 8.00E−48 | Brassica oleracea | odf77g01.b1 B. oleracea002 Brassica olerac |
| 85 | G477 | BI925786 | 5.00E−39 | Lycopersicon esculentum | EST545675 tomato flower, buds 0-3 m |
| 85 | G477 | BM408208 | 7.00E−38 | Solanum tuberosum | EST582535 potato roots Solanum tuberosum |
| 85 | G477 | BQ874863 | 1.00E−30 | Lactuca sativa | QGI6H22.yg.ab1 QG_ABCDI lettuce salinas Lact |
| 85 | G477 | AMA011622 | 4.00E−30 | Antirrhinum majus | mRNA for squamosa promoter binding |
| 85 | G477 | BQ594361 | 4.00E−30 | Beta vulgaris | S015246-024-024-K10-SP6 MPIZ-ADIS-024-develop |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 85 | G477 | CA516258 | 1.00E−28 | *Capsicum annuum* | KS09055D03 KS09 *Capsicum annuum* cDNA, mRNA |
| 85 | G477 | BU828403 | 2.00E−28 | *Populus tremula* x *Populus tremuloides* | K022P59P *Populus* apic |
| 85 | G477 | BG442540 | 2.00E−28 | *Gossypium arboreum* | GA_Ea0017G06f *Gossypium arboreum* 7-10 d |
| 85 | G477 | AW331087 | 7.00E−28 | *Zea mays* | 707047A12.x1 707-Mixed adult tissues from Walbot |
| 85 | G477 | gi5931641 | 9.90E−32 | *Antirrhinum majus* | squamosa promoter binding protein-homol |
| 85 | G477 | gi5931784 | 1.50E−28 | *Zea mays* | SBP-domain protein 4. |
| 85 | G477 | gi8468036 | 4.40E−28 | *Oryza sativa* | Similar to *Arabidopsis thaliana* chromosome 2 |
| 85 | G477 | gi9087308 | 1.20E−14 | Mitochondrion *Beta vulgaris* var. *altissima* | orf102a. |
| 85 | G477 | gi23630509 | 0.78 | *Triticum aestivum* | zinc finger protein. |
| 85 | G477 | gi14597634 | 1 | *Physcomitrella patens* | 15_ppprotl_080_c02. |
| 87 | G481 | BU238020 | 9.00E−71 | *Descurainia sophia* | Ds01_14a12_A Ds01_AAFC_ECORC_cold_stress |
| 87 | G481 | BG440251 | 2.00E−56 | *Gossypium arboreum* | GA_Ea0006K20f *Gossypium arboreum* 7-10 d |
| 87 | G481 | BF071234 | 1.00E−54 | *Glycine max* | st06h05.y1 Gm-c1065 *Glycine max* cDNA clone GENO |
| 87 | G481 | BQ799965 | 2.00E−54 | *Vitis vinifera* | EST 2134 Green Grape berries Lambda Zap II L |
| 87 | G481 | BQ488908 | 5.00E−53 | *Beta vulgaris* | 95-E9134-006-006-M23-T3 Sugar beet MPIZ-ADIS- |
| 87 | G481 | BU499457 | 1.00E−52 | *Zea mays* | 946175D02.y1 946-tassel primordium prepared by S |
| 87 | G481 | AI728916 | 2.00E−52 | *Gossypium hirsutum* | BNLGHi12022 Six-day Cotton fiber Gossypi |
| 87 | G481 | BG642751 | 3.00E−52 | *Lycopersicon esculentum* | EST510945 tomato shoot/meristem Lyc |
| 87 | G481 | BQ857127 | 3.00E−51 | *Lactuca sativa* | QGB6K24.yg.ab1 QG_ABCDI lettuce salinas Lact |
| 87 | G481 | BE413647 | 6.00E−51 | *Triticum aestivum* | SCU001.E10.R990714 ITEC SCU Wheat Endospe |
| 87 | G481 | gi115840 | 1.90E−51 | *Zea mays* | CCAAT-BINDING TRANSCRIPTION FACTOR SUBUNIT A (CB |
| 87 | G481 | gi20160792 | 2.60E−47 | *Oryza sativa* (*japonica* cultivar-group) | putative CAAT-box |
| 87 | G481 | gi15408794 | 7.10E−38 | *Oryza sativa* | putative CCAAT-binding transcription factor |
| 87 | G481 | gi22536010 | 3.20E−35 | *Phaseolus coccineus* | LEC1-like protein. |
| 87 | G481 | gi16902054 | 1.80E−32 | *Vernonia galamensis* | CCAAT-box binding factor HAP3 B domai |
| 87 | G481 | gi16902050 | 6.10E−32 | *Glycine max* | CCAAT-box binding factor HAP3 B domain. |
| 87 | G481 | gi16902056 | 1.60E−31 | *Argemone mexicana* | CCAAT-box binding factor HAP3 B domain. |
| 87 | G481 | gi16902058 | 2.20E−27 | *Triticum aestivum* | CCAAT-box binding factor HAP3 B domain. |
| 87 | G481 | gi388257 | 0.26 | *Lycopersicon esculentum* | glycine-rich protein. |
| 87 | G481 | gi18266049 | 0.92 | *Brassica oleracea* | myrosinase precursor. |
| 89 | G482 | BQ505706 | 7.00E−59 | *Solanum tuberosum* | EST613121 Generation of a set of potato c |
| 89 | G482 | AC122165 | 6.00E−57 | *Medicago truncatula* | clone mth2-32m22, WORKING DRAFT SEQUENC |
| 89 | G482 | BQ104671 | 2.00E−55 | *Rosa* hybrid cultivar | fc0546.e Rose Petals (Fragrant Cloud) |
| 89 | G482 | BI469382 | 4.00E−55 | *Glycine max* | sai11b10.y1 Gm-c1053 *Glycine max* cDNA clone GEN |
| 89 | G482 | AAAA01003638 | 1.00E−54 | *Oryza sativa* (*indica* cultivar-group) | ( ) scaffold003638 |
| 89 | G482 | AP005193 | 1.00E−54 | *Oryza sativa* (*japonica* cultivar-group) | ( ) chromosome 7 clo |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 89 | G482 | BU880488 | 1.00E−53 | Populus balsamifera subsp. trichocarpa | UM49TG09 Populus flo |
| 89 | G482 | BJ248969 | 2.00E−53 | Triticum aestivum | BJ248969 Y. Ogihara unpublished cDNA libr |
| 89 | G482 | AC120529 | 4.00E−53 | Oryza sativa | chromosome 3 clone OSJNBa0039N21, *** SEQUENCI |
| 89 | G482 | BU896236 | 7.00E−53 | Populus tremula x Populus tremuloides | X037F04 Populus wood |
| 89 | G482 | gi115840 | 1.40E−46 | Zea mays | CCAAT-BINDING TRANSCRIPTION FACTOR SUBUNIT A (CB |
| 89 | G482 | gi20160792 | 2.30E−41 | Oryza sativa (japonica cultivar-group) | putative CAAT-box |
| 89 | G482 | gi22536010 | 9.00E−38 | Phaseolus coccineus | LEC1-like protein. |
| 89 | G482 | gi15408794 | 1.50E−37 | Oryza sativa | putative CCAAT-binding transcription factor |
| 89 | G482 | gi16902054 | 7.50E−34 | Vernonia galamensis | CCAAT-box binding factor HAP3 B domai |
| 89 | G482 | gi16902050 | 5.30E−33 | Glycine max | CCAAT-box binding factor HAP3 B domain. |
| 89 | G482 | gi16902056 | 4.80E−32 | Argemone mexicana | CCAAT-box binding factor HAP3 B domain. |
| 89 | G482 | gi16902058 | 1.10E−30 | Triticum aestivum | CCAAT-box binding factor HAP3 B domain. |
| 89 | G482 | gi100582 | 0.0018 | Hordeum vulgare | glycine-rich protein precursor-barley. |
| 89 | G482 | gi7024451 | 0.0025 | Citrus unshiu | glycine-rich RNA-binding protein. |
| 91 | G484 | BQ412047 | 3.00E−68 | Gossypium arboreum | GA_Ed0053D06r Gossypium arboreum 7-10 d |
| 91 | G484 | AF464906 | 5.00E−67 | Glycine max | repressor protein (Dr1) mRNA, complete cds. |
| 91 | G484 | AW719575 | 2.00E−64 | Lotus japonicus | LjNEST6a11r Lotus japonicus nodule library, |
| 91 | G484 | BG648823 | 4.00E−64 | Medicago truncatula | EST510442 HOGA Medicago truncatula cDNA |
| 91 | G484 | BQ593791 | 4.00E−64 | Beta vulgaris | E012763-024-026-O09-SP6 MPIZ-ADIS-024-develop |
| 91 | G484 | BM436739 | 9.00E−64 | Vitis vinifera | VVA009B06_53061 An expressed sequence tag da |
| 91 | G484 | BF113032 | 1.00E−63 | Lycopersicon esculentum | EST440542 tomato breaker fruit Lyco |
| 91 | G484 | BG593107 | 7.00E−63 | Solanum tuberosum | EST491785 cSTS Solanum tuberosum cDNA clo |
| 91 | G484 | BU014508 | 1.00E−61 | Lactuca sativa | QGJ7I14.yg.ab1 QG_EFGHJ lettuce serriola Lac |
| 91 | G484 | AF464902 | 5.00E−59 | Oryza sativa | repressor protein (Dr1) mRNA, complete cds. |
| 91 | G484 | gi18481628 | 6.70E−65 | Glycine max | repressor protein. |
| 91 | G484 | gi18481620 | 4.80E−60 | Oryza sativa | repressor protein. |
| 91 | G484 | gi18481622 | 2.00E−58 | Triticum aestivum | repressor protein. |
| 91 | G484 | gi20160792 | 2.90E−16 | Oryza sativa (japonica cultivar-group) | putative CAAT-box |
| 91 | G484 | gi15321716 | 1.30E−15 | Zea mays | leafy cotyledon1. |
| 91 | G484 | gi22536010 | 1.10E−14 | Phaseolus coccineus | LEC1-like protein. |
| 91 | G484 | gi16902054 | 1.50E−14 | Vernonia galamensis | CCAAT-box binding factor HAP3 B domai |
| 91 | G484 | gi16902056 | 2.70E−13 | Argemone mexicana | CCAAT-box binding factor HAP3 B domain. |
| 91 | G484 | gi18129292 | 1 | Pinus pinaster | histone H2B protein. |
| 91 | G484 | gi1083950 | 1 | Canavalia lineata | subtilisin inhibitor CLSI-I-Canavalia |
| 93 | G489 | BH679015 | 1.00E−111 | Brassica oleracea | BOHXO96TF BO_2_3_KB Brassica oleracea gen |
| 93 | G489 | AC136503 | 1.00E−75 | Medicago truncatula | clone mth2-15n1, WORKING DRAFT SEQUENCE |
| 93 | G489 | BQ118033 | 8.00E−73 | Solanum tuberosum | EST603609 mixed potato tissues Solanum tu |
| 93 | G489 | BU873518 | 4.00E−68 | Populus balsamifera subsp. trichocarpa | Q056D09 Populus flow |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 93 | G489 | BI934205 | 2.00E−67 | Lycopersicon esculentum | EST554094 tomato flower, anthesis L |
| 93 | G489 | BQ797616 | 1.00E−66 | Vitis vinifera | EST 6554 Ripening Grape berries Lambda Zap I |
| 93 | G489 | BM064398 | 4.00E−63 | Capsicum annuum | KS01066E11 KS01 Capsicum annuum cDNA, mRNA |
| 93 | G489 | BU927107 | 4.00E−60 | Glycine max | sas95f12.y1 Gm-c1036 Glycine max cDNA clone SOY |
| 93 | G489 | BQ993879 | 6.00E−59 | Lactuca sativa | QGF5L12.yg.ab1 QG_EFGHJ lettuce serriola Lac |
| 93 | G489 | AP004113 | 1.00E−58 | Oryza sativa | chromosome 2 clone OJ1116_A06, *** SEQUENCING |
| 93 | G489 | gi5257260 | 6.20E−46 | Oryza sativa | Similar to sequence of BAC F7G19 from Arabid |
| 93 | G489 | gi20804442 | 6.60E−19 | Oryza sativa (japonica cultivar-group) | hypothetical prote |
| 93 | G489 | gi18481626 | 3.90E−09 | Lea mays | repressor protein. |
| 93 | G489 | gi1808688 | 0.051 | Sporobolus stapfianus | hypothetical protein. |
| 93 | G489 | gi8096192 | 0.21 | Lilium longiflorum | gH2A.1. |
| 93 | G489 | gi2130105 | 0.25 | Triticum aestivum | histone H2A.4-wheat. |
| 93 | G489 | gi297871 | 0.27 | Picea abies | histone H2A. |
| 93 | G489 | gi297887 | 0.31 | Daucus carota | glycine rich protein. |
| 93 | G489 | gi15214035 | 0.75 | Cicer arietinum | HISTONE H2A. |
| 93 | G489 | gi2317760 | 0.75 | Pinus taeda | H2A homolog. |
| 95 | G490 | AX180963 | 1.00E−19 | Physcomitrella patens | Sequence 14 from Patent WO0145493. |
| 95 | G490 | AP004836 | 1.00E−19 | Oryza sativa (japonica cultivar-group) | ( ) chromosome 2 clo |
| 95 | G490 | AU197697 | 1.00E−19 | Oryza sativa | AU197697 Rice mature leaf Oryza sativa cDNA cl |
| 95 | G490 | BJ193952 | 1.00E−19 | Physcomitrella patens subsp. patens | BJ193952 normalized ful |
| 95 | G490 | AAAA01011976 | 1.00E−19 | Oryza sativa (indica cultivar-group) | ( ) scaffold011976 |
| 95 | G490 | BM065544 | 2.00E−19 | Capsicum annuum | KS07004F12 KS07 Capsicum annuum cDNA, mRNA |
| 95 | G490 | AL749991 | 2.00E−19 | Pinus pinaster | AL749991 AS Pinus pinaster cDNA clone AS03E0 |
| 95 | G490 | BG440805 | 3.00E−19 | Gossypium arboreum | GA_Ea0010D12f Gossypium arboreum 7-10 d |
| 95 | G490 | BE460012 | 4.00E−19 | Lycopersicon esculentum | EST415304 tomato developing/immatur |
| 95 | G490 | BJ269516 | 4.00E−19 | Triticum aestivum | BJ269516 Y. Ogihara unpublished cDNA libr |
| 95 | G490 | gi5257260 | 7.50E−18 | Oryza sativa | Similar to sequence of BAC F7G19 from Arabid |
| 95 | G490 | gi22138475 | 4.00E−13 | Oryza sativa (japonica cultivar-group) | putative transcrip |
| 95 | G490 | gi18481626 | 7.00E−06 | Zea mays | repressor protein. |
| 95 | G490 | gi16902058 | 0.99 | Triticum aestivum | CCAAT-box binding factor HAP3 B domain. |
| 95 | G490 | gi16902056 | 1 | Argemone mexicana | CCAAT-box binding factor HAP3 B domain. |
| 95 | G490 | gi16902050 | 1 | Glycine max | CCAAT-box binding factor HAP3 B domain. |
| 95 | G490 | gi16902054 | 1 | Vernonia galamensis | CCAAT-box binding factor HAP3 B domai |
| 97 | G504 | BU895066 | 1.00E−82 | Populus tremula x Populus tremuloides | X018H04 Populus wood |
| 97 | G504 | BI422750 | 2.00E−80 | Lycopersicon esculentum | EST533416 tomato callus, TAMU Lycop |
| 97 | G504 | AW560823 | 5.00E−71 | Medicago truncatula | EST315871 DSIR Medicago truncatula cDNA |
| 97 | G504 | CA815703 | 1.00E−68 | Vitis vinifera | CA12EI204IVF_E10 Cabernet Sauvignon Leaf-C |
| 97 | G504 | BQ121923 | 2.00E−67 | Solanum tuberosum | EST607499 mixed potato tissues Solanum tu |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 97 | G504 | BM092513 | 2.00E−66 | *Glycine max* | sah14g06.y3 Gm-c1086 *Glycine max* cDNA clone GEN |
| 97 | G504 | BI246023 | 4.00E−66 | *Sorghum bicolor* | IP1_66_F11.b1_A002 Immature pannicle 1 (IP1 |
| 97 | G504 | BU041353 | 1.00E−63 | *Prunus persica* | PP_LEa0009B03f Peach developing fruit mesoca |
| 97 | G504 | BU672229 | 2.00E−63 | *Triticum aestivum* | WHE3302_A10_A20ZS Chinese Spring wheat dr |
| 97 | G504 | AF402603 | 4.00E−62 | *Phaseolus vulgaris* | NAC domain protein NAC2 mRNA, complete c |
| 97 | G504 | gi24417196 | 4.20E−72 | *Oryza sativa* (japonica cultivar-group) | contains ESTs C993 |
| 97 | G504 | gi15148914 | 2.70E−61 | *Phaseolus vulgaris* | NAC domain protein NAC2. |
| 97 | G504 | gi15528779 | 3.50E−59 | *Oryza sativa* | development regulation gene OsNAC4. |
| 97 | G504 | gi6175246 | 2.50E−58 | *Lycopersicon esculentum* | jasmonic acid 2. |
| 97 | G504 | gi21105748 | 4.10E−58 | *Petunia x hybrida* | nam-like protein 10. |
| 97 | G504 | gi14485513 | 1.60E−56 | *Solanum tuberosum* | putative NAC domain protein. |
| 97 | G504 | gi4218535 | 2.10E−54 | *Triticum sp.* | GRAB1 protein. |
| 97 | G504 | gi6732158 | 2.10E−54 | *Triticum monococcum* | unnamed protein product. |
| 97 | G504 | gi22597158 | 2.90E−50 | *Glycine max* | no apical meristem-like protein. |
| 97 | G504 | gi7716952 | 2.20E−34 | *Medicago truncatula* | NAC1. |
| 99 | G509 | BG646875 | 2.00E−68 | *Medicago truncatula* | EST508494 HOGA *Medicago truncatula* cDNA |
| 99 | G509 | BQ850404 | 2.00E−65 | *Lactuca sativa* | QGB12I10.yg.ab1 QG_ABCDI lettuce salinas Lac |
| 99 | G509 | BE363054 | 3.00E−59 | *Sorghum bicolor* | DG1_9_D04.b1_A002 Dark Grown 1 (DG1) Sorghu |
| 99 | G509 | BE434322 | 1.00E−56 | *Lycopersicon esculentum* | EST405400 tomato breaker fruit, TIG |
| 99 | G509 | BM112823 | 8.00E−50 | *Solanum tuberosum* | EST560359 potato roots *Solanum tuberosum* |
| 99 | G509 | AF402602 | 3.00E−49 | *Phaseolus vulgaris* | NAC domain protein NAC1 mRNA, complete c |
| 99 | G509 | PHRNANAM | 2.00E−48 | *Petunia x hybrida* | *P. hybrida* mRNA encoding NAM protein. |
| 99 | G509 | BZ034968 | 4.00E−48 | *Brassica oleracea* | oem78a04.b1 *B. oleracea*002 *Brassica olerac* |
| 99 | G509 | AV923588 | 3.00E−46 | *Hordeum vulgare* subsp. *vulgare* | AV923588 K. Sato unpublished |
| 99 | G509 | BE586058 | 4.00E−46 | *Triticum aestivum* | Est#8pT7_C09_c9_066 KSU wheat *Fusarium* gr |
| 99 | G509 | gi13129497 | 6.00E−57 | *Oryza sativa* | putative NAM (no apical meristem) protein. |
| 99 | G509 | gi15148912 | 4.80E−50 | *Phaseolus vulgaris* | NAC domain protein NAC1. |
| 99 | G509 | gi24476048 | 3.30E−47 | *Oryza sativa* (japonica cultivar-group) | Putative NAM (no a |
| 99 | G509 | gi1279640 | 5.40E−47 | *Petunia x hybrida* | NAM. |
| 99 | G509 | gi4218537 | 8.50E−42 | *Triticum sp.* | GRAB2 protein. |
| 99 | G509 | gi6732156 | 8.50E−42 | *Triticum monococcum* | unnamed protein product. |
| 99 | G509 | gi22597158 | 1.40E−41 | *Glycine max* | no apical meristem-like protein. |
| 99 | G509 | gi14485513 | 1.90E−37 | *Solanum tuberosum* | putative NAC domain protein. |
| 99 | G509 | gi6175246 | 8.40E−35 | *Lycopersicon esculentum* | jasmonic acid 2. |
| 99 | G509 | gi7716952 | 4.30E−32 | *Medicago truncatula* | NAC1. |
| 101 | G519 | BG543276 | 9.00E−93 | *Brassica rapa* subsp. *pekinensis* | E0770 Chinese cabbage etiol |
| 101 | G519 | BQ165234 | 2.00E−88 | *Medicago truncatula* | EST611103 KVKC *Medicago truncatula* cDNA |
| 101 | G519 | AF509866 | 4.00E−85 | *Petunia x hybrida* | nam-like protein 3 (NH3) mRNA, complete c |
| 101 | G519 | STU401151 | 9.00E−85 | *Solanum tuberosum* | mRNA for putative NAC domain protein (na |
| 101 | G519 | BH476033 | 1.00E−80 | *Brassica oleracea* | BOHNV27TF BOHN *Brassica oleracea* genomic |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 101 | G519 | CA820578 | 2.00E−80 | Glycine max | sau91c12.y1 Gm-c1048 Glycine max cDNA clone SOY |
| 101 | G519 | BM411425 | 1.00E−79 | Lycopersicon esculentum | EST585752 tomato breaker fruit Lyco |
| 101 | G519 | BQ970677 | 1.00E−78 | Helianthus annuus | QHB42M12.yg.ab1 QH_ABCDI sunflower RHA801 |
| 101 | G519 | AB028185 | 2.00E−78 | Oryza sativa | mRNA for OsNAC6 protein, complete cds. |
| 101 | G519 | BG441329 | 6.00E−78 | Gossypium arboreum | GA_Ea0012N05f Gossypium arboreum 7-10 d |
| 101 | G519 | gi14485513 | 2.20E−86 | Solanum tuberosum | putative NAC domain protein. |
| 101 | G519 | gi21105734 | 2.80E−86 | Petunia x hybrida | nam-like protein 3. |
| 101 | G519 | gi13272281 | 1.40E−80 | Oryza sativa | NAC6. |
| 101 | G519 | gi20161457 | 1.40E−80 | Oryza sativa (japonica cultivar-group) | OsNAC6 protein. |
| 101 | G519 | gi4218535 | 1.40E−62 | Triticum sp. | GRAB1 protein. |
| 101 | G519 | gi6732158 | 1.40E−62 | Triticum monococcum | unnamed protein product. |
| 101 | G519 | gi6175246 | 1.30E−54 | Lycopersicon esculentum | jasmonic acid 2. |
| 101 | G519 | gi15148914 | 4.30E−54 | Phaseolus vulgaris | NAC domain protein NAC2. |
| 101 | G519 | gi22597158 | 1.70E−43 | Glycine max | no apical meristem-like protein. |
| 101 | G519 | gi7716952 | 1.50E−35 | Medicago truncatula | NAC1. |
| 103 | G545 | BH552655 | 9.00E−96 | Brassica oleracea | BOGEH82TF BOGE Brassica oleracea genomic |
| 103 | G545 | BQ704580 | 7.00E−74 | Brassica napus | Bn01_02p11_A |
| 103 | G545 | AF119050 | 5.00E−59 | Datisca glomerata | zinc-finger protein 1 (zfp1) mRNA, comple |
| 103 | G545 | AP004523 | 9.00E−58 | Lotus japonicus | genomic DNA, chromosome 1, clone: LjT03J05, |
| 103 | G545 | PETZFP4 | 2.00E−56 | Petunia x hybrida | Petunia zinc-finger protein gene. |
| 103 | G545 | CA801331 | 4.00E−55 | Glycine max | sau04c04.y2 Gm-c1062 Glycine max cDNA clone SOY |
| 103 | G545 | MSY18788 | 1.00E−53 | Medicago sativa | mRNA for putative TFIIIA (or kruppel)-like |
| 103 | G545 | BG582865 | 2.00E−53 | Medicago truncatula | EST484611 GVN Medicago truncatula cDNA |
| 103 | G545 | BM437679 | 8.00E−51 | Vitis vinifera | VVA023E03_54853 An expressed sequence tag da |
| 103 | G545 | AF053077 | 8.00E−49 | Nicotiana tabacum | osmotic stress-induced zinc-finger protei |
| 103 | G545 | gi4666360 | 6.00E−57 | Datisca glomerata | zinc-finger protein 1. |
| 103 | G545 | gi7228329 | 2.70E−54 | Medicago sativa | putative TFIIIA (or kruppel)-like zinc fi |
| 103 | G545 | gi1763063 | 9.00E−54 | Glycine max | SCOF-1. |
| 103 | G545 | gi439487 | 4.70E−44 | Petunia x hybrida | zinc-finger DNA binding protein. |
| 103 | G545 | gi2058504 | 1.50E−35 | Brassica rapa | zinc-finger protein-1. |
| 103 | G545 | gi2981169 | 4.30E−31 | Nicotiana tabacum | osmotic stress-induced zinc-finger prot |
| 103 | G545 | gi485814 | 6.50E−28 | Triticum aestivum | WZF1. |
| 103 | G545 | gi12698882 | 2.90E−25 | Oryza sativa | zinc finger transcription factor ZF1. |
| 103 | G545 | gi21104613 | 1.90E−14 | Oryza sativa (japonica cultivar-group) | contains ESTs AU07 |
| 103 | G545 | gi2129892 | 4.70E−06 | Pisum sativum | probable finger protein Pszf1-garden pea. |
| 105 | G546 | BG544345 | 3.00E−61 | Brassica rapa subsp. pekinensis | E2200 Chinese cabbage etiol |
| 105 | G546 | BH424854 | 6.00E−49 | Brassica oleracea | BOGML16TF BOGM Brassica oleracea genomic |
| 105 | G546 | AW223952 | 2.00E−45 | Lycopersicon esculentum | EST300763 tomato fruit red ripe, TA |
| 105 | G546 | BG889076 | 4.00E−45 | Solanum tuberosum | EST514927 cSTD Solanum tuberosum cDNA clo |
| 105 | G546 | AC127019 | 3.00E−44 | Medicago truncatula | clone mth2-31b1, WORKING DRAFT SEQUENCE |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 105 | G546 | BF597949 | 9.00E−42 | *Glycine max* | su89e06.y1 Gm-c1055 *Glycine max* cDNA clone GENO |
| 105 | G546 | BE033932 | 2.00E−40 | *Mesembryanthemum crystallinum* | MG02C06 MG *Mesembryanthemum* c |
| 105 | G546 | OSJN00157 | 3.00E−37 | *Oryza sativa* | chromosome 4 clone OSJNBa0013K16, *** SEQUENC |
| 105 | G546 | BI418846 | 3.00E−37 | *Lotus japonicus* | LjNEST36e5r *Lotus japonicus* nodule library |
| 105 | G546 | AAAA01035793 | 3.00E−37 | *Oryza sativa* (*indica* cultivar-group) | ( ) scaffold035793 |
| 105 | G546 | gi2894379 | 3.10E−37 | *Hordeum vulgare* | ring finger protein. |
| 105 | G546 | gi12039329 | 9.00E−34 | *Oryza sativa* | putative ring finger protein. |
| 105 | G546 | gi19571069 | 1.80E−25 | *Oryza sativa* (*japonica* cultivar-group) | contains EST C7268 |
| 105 | G546 | gi17016985 | 3.00E−23 | *Cucumis melo* | RING-H2 zinc finger protein. |
| 105 | G546 | gi21645888 | 5.90E−18 | *Zea mays* | ring-H2 zinc finger protein. |
| 105 | G546 | gi23451086 | 2.10E−14 | *Medicago sativa* | RING-H2 protein. |
| 105 | G546 | gi12003386 | 6.30E−14 | *Nicotiana tabacum* | Avr9/Cf-9 rapidly elicited protein 132. |
| 105 | G546 | gi20152976 | 4.00E−12 | *Hordeum vulgare* subsp. *vulgare* | similar to *A. thaliana* C3H |
| 105 | G546 | gi22597166 | 8.70E−12 | *Glycine max* | RING-H2 finger protein. |
| 105 | G546 | gi1086225 | 3.50E−09 | *Lotus japonicus* | RING-finger protein-*Lotus japonicus*. |
| 107 | G561 | SAY16953 | 1.00E−146 | *Sinapis alba* | mRNA for G-box binding factor 2A. |
| 107 | G561 | BNGBBF2A | 1.00E−141 | *Brassica napus* | *B. napus* mRNA for G-Box binding factor 2A. |
| 107 | G561 | RSGBOX | 1.00E−141 | *Raphanus sativus* | *R. sativus* mRNA for G-box binding protein. |
| 107 | G561 | PVU41817 | 8.00E−78 | *Phaseolus vulgaris* | regulator of MAT2 (ROM2) mRNA, complete |
| 107 | G561 | AF084971 | 7.00E−77 | *Catharanthus roseus* | G-box binding protein 1 (GBF1) mRNA, co |
| 107 | G561 | SOAJ3624 | 2.00E−75 | *Spinacia oleracea* | mRNA for basic leucine zipper protein. |
| 107 | G561 | SOYGBFB | 1.00E−72 | *Glycine max* | G-box binding factor (GBF2A) mRNA, 3' end. |
| 107 | G561 | NTTAF2MR | 2.00E−70 | *Nicotiana tabacum* | *N. tabacum* mRNA for TAF-2. |
| 107 | G561 | PCCPRF1 | 5.00E−66 | *Petroselinum crispum* | *P. crispum* CPRF1 mRNA for light-inducib |
| 107 | G561 | ZMU10270 | 6.00E−49 | *Zea mays* | G-box binding factor 1 (GBF1) mRNA, complete cds. |
| 107 | G561 | gi2995462 | 1.00E−139 | *Sinapis alba* | G-box binding protein. |
| 107 | G561 | gi1076448 | 2.30E−135 | *Brassica napus* | G-box binding factor 2A-rape. |
| 107 | G561 | gi1033059 | 4.80E−135 | *Raphanus sativus* | G-Box binding protein. |
| 107 | G561 | gi1155054 | 2.30E−58 | *Phaseolus vulgaris* | regulator of MAT2. |
| 107 | G561 | gi5381311 | 3.50E−52 | *Catharanthus roseus* | G-box binding protein 1. |
| 107 | G561 | gi2815305 | 4.00E−51 | *Spinacia oleracea* | basic leucine zipper protein. |
| 107 | G561 | gi69959 | 1.20E−49 | *Glycine max* | G-box binding factor. |
| 107 | G561 | gi1076623 | 8.00E−46 | *Nicotiana tabacum* | G-box-binding protein TAF-2-common to |
| 107 | G561 | gi498643 | 1.30E−45 | *Zea mays* | G-box binding factor 1. |
| 107 | G561 | gi100162 | 5.20E−42 | *Petroselinum crispum* | light-induced protein CPRF-1-parsl |
| 109 | G562 | BNU27108 | 1.00E−160 | *Brassica napus* | transcription factor (BnGBF1) mRNA, partial |
| 109 | G562 | AF084971 | 1.00E−102 | *Catharanthus roseus* | G-box binding protein 1 (GBF1) mRNA, co |
| 109 | G562 | PVU41817 | 1.00E−96 | *Phaseolus vulgaris* | regulator of MAT2 (ROM2) mRNA, complete |
| 109 | G562 | SOYGBFB | 2.00E−94 | *Glycine max* | G-box binding factor (GBF2A) mRNA, 3' end. |
| 109 | G562 | SOAJ3624 | 9.00E−94 | *Spinacia oleracea* | mRNA for basic leucine zipper protein. |
| 109 | G562 | NTTAF2MR | 4.00E−89 | *Nicotiana tabacum* | *N. tabacum* mRNA for TAF-2. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 109 | G562 | PCCPRF1 | 1.00E−84 | Petroselinum crispum | P. crispum CPRF1 mRNA for light-inducib |
| 109 | G562 | SAY16953 | 2.00E−81 | Sinapis alba | mRNA for G-box binding factor 2A. |
| 109 | G562 | RSGBOX | 6.00E−79 | Raphanus sativus | R. sativus mRNA for G-box binding protein. |
| 109 | G562 | BF271790 | 6.00E−58 | Gossypium arboreum | GA_Eb0012L24f Gossypium arboreum 7-10 d |
| 109 | G562 | gi1399005 | 2.00E−159 | Brassica napus | transcription factor. |
| 109 | G562 | gi2995462 | 6.70E−81 | Sinapis alba | G-box binding protein. |
| 109 | G562 | gi1033059 | 1.80E−78 | Raphanus sativus | G-Box binding protein. |
| 109 | G562 | gi5381311 | 1.20E−60 | Catharanthus roseus | G-box binding protein 1. |
| 109 | G562 | gi2815305 | 1.20E−60 | Spinacia oleracea | basic leucine zipper protein. |
| 109 | G562 | gi1169081 | 2.20E−59 | Petroselinum crispum | COMMON PLANT REGULATORY FACTOR CPRF- |
| 109 | G562 | gi169959 | 5.40E−56 | Glycine max | G-box binding factor. |
| 109 | G562 | gi1155054 | 1.80E−55 | Phaseolus vulgaris | regulator of MAT2. |
| 109 | G562 | gi498643 | 2.10E−52 | Zea mays | G-box binding factor 1. |
| 109 | G562 | gi1076624 | 1.30E−47 | Nicotiana tabacum | G-box-binding protein TAF-3-common to |
| 111 | G567 | PCCPRF2 | 1.00E−55 | Petroselinum crispum | P. crispum CPRF2 mRNA for DNA-binding p |
| 111 | G567 | AY061648 | 8.00E−53 | Nicotiana tabacum | bZIP transcription factor (BZI-1) mRNA, c |
| 111 | G567 | BH590739 | 2.00E−48 | Brassica oleracea | BOHCB55TR BOHC Brassica oleracea genomic |
| 111 | G567 | GMGHBF1 | 2.00E−47 | Glycine max | G. max mRNA for G/HBF-1. |
| 111 | G567 | RICBZIPPA | 2.00E−44 | Oryza sativa | mRNA for bZIP protein, complete cds. |
| 111 | G567 | MZEBZIP | 2.00E−43 | Zea mays | opaque2 heterodimerizing protein 2 mRNA, complete |
| 111 | G567 | BU041142 | 3.00E−43 | Prunus persica | PP_LEa0008G18f Peach developing fruit mesoca |
| 111 | G567 | BG645542 | 4.00E−42 | Medicago truncatula | EST507161 KV3 Medicago truncatula cDNA |
| 111 | G567 | AJ487392 | 4.00E−41 | Solanum tuberosum | AJ487392 Solanum tuberosum cv. Provita So |
| 111 | G567 | AW647973 | 9.00E−41 | Lycopersicon esculentum | EST326427 tomato germinating seedli |
| 111 | G567 | gi1806261 | 1.60E−49 | Petroselinum crispum | DNA-binding protein; bZIP type. |
| 111 | G567 | gi1783305 | 1.80E−46 | Oryza sativa | bZIP protein. |
| 111 | G567 | gi16797791 | 8.20E−44 | Nicotiana tabacum | bZIP transcription factor. |
| 111 | G567 | gi168428 | 8.20E−44 | Zea mays | opaque2 heterodimerizing protein 2. |
| 111 | G567 | gi1905785 | 2.20E−43 | Glycine max | G/HBF-1. |
| 111 | G567 | gi1869928 | 9.70E−41 | Hordeum vulgare | blz-1 protein. |
| 111 | G567 | gi463212 | 4.40E−34 | Coix lacryma-jobi | opaque 2. |
| 111 | G567 | gi1362178 | 1.00E−32 | Sorghum bicolor | opaque-2 protein-sorghum. |
| 111 | G567 | gi21435101 | 2.90E−32 | Pennisetum glaucum | opaque-2-like protein. |
| 111 | G567 | gi1654099 | 2.30E−24 | Triticum aestivum | transcriptional activator. |
| 113 | G568 | BH994972 | 1.00E−64 | Brassica oleracea | oeh20b03.b1 B. oleracea002 Brassica olerac |
| 113 | G568 | AF288616 | 2.00E−42 | Populus balsamifera subsp. trichocarpa x Populus deltoides | |
| 113 | G568 | BU834855 | 1.00E−25 | Populus tremula x Populus tremuloides | T066E09 Populus apica |
| 113 | G568 | BU819252 | 5.00E−23 | Populus tremula | UA41BPE07 Populus tremula cambium cDNA libr |
| 113 | G568 | AC123571 | 7.00E−17 | Medicago truncatula | clone mth1-14n3, WORKING DRAFT SEQUENCE |
| 113 | G568 | AV914686 | 8.00E−14 | Hordeum vulgare subsp. vulgare | AV914686 K. Sato unpublished |
| 113 | G568 | AF001454 | 8.00E−14 | Helianthus annuus | Dc3 promoter-binding factor-2 (DPBF-2) mR |
| 113 | G568 | BE657320 | 1.00E−13 | Glycine max | GM700001A20B6 Gm-r1070 Glycine max cDNA clone G |
| 113 | G568 | CA765468 | 2.00E−13 | Oryza sativa (indica cultivar-group) | AF53-Rpf_07_J23_T7_086 |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 113 | G568 | AL819191 | 2.00E−13 | *Triticum aestivum* | AL819191 n: 129 *Triticum aestivum* cDNA clo |
| 113 | G568 | gi13435335 | 4.20E−47 | *Populus* x *generosa* | basic leucine zipper transcription fac |
| 113 | G568 | gi22324425 | 6.30E−23 | *Oryza sativa* (*japonica* cultivar-group) | bZIP transcription |
| 113 | G568 | gi2228773 | 3.30E−17 | *Helianthus annuus* | Dc3 promoter-binding factor-2. |
| 113 | G568 | gi21693583 | 8.70E−15 | *Triticum aestivum* | ABA response element binding factor. |
| 113 | G568 | gi5821255 | 4.90E−13 | *Oryza sativa* | TRAB1. |
| 113 | G568 | gi13775111 | 4.20E−12 | *Phaseolus vulgaris* | bZIP transcription factor 6. |
| 113 | G568 | gi7406677 | 3.30E−11 | *Vitis vinifera* | putative ripening-related bZIP protein. |
| 113 | G568 | gi14571808 | 2.90E−10 | *Nicotiana tabacum* | phi-2. |
| 113 | G568 | gi6018699 | 3.10E−10 | *Lycopersicon esculentum* | THY5 protein. |
| 113 | G568 | gi1352613 | 3.20E−10 | *Zea mays* | OCS-ELEMENT BINDING FACTOR 1 (OCSBF-1). |
| 115 | G584 | PVU18348 | 1.00E−166 | *Phaseolus vulgaris* | phaseolin G-box binding protein PG1 (PG1 |
| 115 | G584 | BH696428 | 5.00E−94 | *Brassica oleracea* | BOMCR67TF BO_2_3_KB *Brassica oleracea* gen |
| 115 | G584 | AF011557 | 7.00E−80 | *Lycopersicon esculentum* | jasmonic acid 3 (LEJA3) mRNA, parti |
| 115 | G584 | BI434651 | 9.00E−75 | *Solanum tuberosum* | EST537412 P. infestans-challenged leaf So |
| 115 | G584 | AF061107 | 2.00E−70 | *Zea mays* | transcription factor MYC7E mRNA, partial cds. |
| 115 | G584 | BG453241 | 3.00E−70 | *Medicago truncatula* | NF090G06LF1F1049 Developing leaf Medica |
| 115 | G584 | AAAA01004195 | 2.00E−68 | *Oryza sativa* (*indica* cultivar-group) | ( ) scaffold004195 |
| 115 | G584 | AC060755 | 6.00E−68 | *Oryza sativa* | chromosome 10 clone OSJNBa0003O19, *** SEQUENC |
| 115 | G584 | BG446831 | 7.00E−67 | *Gossypium arboreum* | GA_Eb0039H18f *Gossypium arboreum* 7-10 d |
| 115 | G584 | BI968400 | 2.00E−62 | *Glycine max* | GM830005A12E12 Gm-r1083 *Glycine max* cDNA clone |
| 115 | G584 | gi1142619 | 3.90E−155 | *Phaseolus vulgaris* | phaseolin G-box binding protein PG1. |
| 115 | G584 | gi12643064 | 1.00E−131 | *Oryza sativa* | putative MYC transcription factor. |
| 115 | G584 | gi4321762 | 4.30E−130 | *Zea mays* | transcription factor MYC7E. |
| 115 | G584 | gi6175252 | 2.30E−62 | *Lycopersicon esculentum* | jasmonic acid 3. |
| 115 | G584 | gi19571087 | 2.70E−47 | *Oryza sativa* (*japonica* cultivar-group) | contains EST AU031 |
| 115 | G584 | gi10998404 | 1.40E−37 | *Petunia* x *hybrida* | anthocyanin 1. |
| 115 | G584 | gi4519201 | 9.30E−30 | *Perilla frutescens* | MYC-GP. |
| 115 | G584 | gi166428 | 8.00E−28 | *Antirrhinum majus* | DEL. |
| 115 | G584 | gi13346182 | 3.00E−27 | *Gossypium hirsutum* | GHDEL65. |
| 115 | G584 | gi3650292 | 5.10E−18 | *Gerbera hybrida* | GMYC1 protein. |
| 117 | G585 | AF336280 | 1.00E−165 | *Gossypium hirsutum* | GHDEL65 (ghdel65) mRNA, complete cds. |
| 117 | G585 | AMADEL | 1.00E−147 | *Antirrhinum majus* | DEL (delila) mRNA, complete cds. |
| 117 | G585 | AB024050 | 1.00E−142 | *Perilla frutescens* | mRNA for MYC-RP, complete cds. |
| 117 | G585 | AF020545 | 1.00E−135 | *Petunia* x *hybrida* | bHLH transcription factor JAF13 (jaf13) m |
| 117 | G585 | GHY7709 | 1.00E−107 | *Gerbera hybrida* | mRNA for bHLH transcription factor. |
| 117 | G585 | AX540498 | 1.00E−104 | *Lotus uliginosus* | Sequence 2 from Patent WO0210412. |
| 117 | G585 | ZMA251719 | 9.00E−81 | *Zea mays* | mRNA for transcription factor (hopi gene). |
| 117 | G585 | AF503363 | 3.00E−67 | *Lotus japonicus* | myc-like regulatory protein (TAN1) mRNA, pa |
| 117 | G585 | BI308638 | 7.00E−67 | *Medicago truncatula* | EST530048 GPOD *Medicago truncatula* cDNA |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 117 | G585 | BU875274 | 1.00E−57 | *Populus balsamifera* subsp. *trichocarpa* | V004CE04 *Populus* flo |
| 117 | G585 | gi13346182 | 6.30E−156 | *Gossypium hirsutum* | GHDEL65. |
| 117 | G585 | gi166428 | 5.70E−139 | *Antirrhinum majus* | DEL. |
| 117 | G585 | gi4519199 | 2.60E−127 | *Perilla frutescens* | MYC-RP. |
| 117 | G585 | gi3127045 | 5.40E−127 | *Petunia* x *hybrida* | bHLH transcription factor JAF13. |
| 117 | G585 | gi3650292 | 1.30E−93 | *Gerbera hybrida* | GMYC1 protein. |
| 117 | G585 | gi8052457 | 2.00E−87 | *Zea mays* | transcription factor. |
| 117 | G585 | gi1086540 | 2.20E−86 | *Oryza sativa* | Ra. |
| 117 | G585 | gi20467247 | 2.40E−83 | *Lotus uliginosus* | myc-like regulatory protein. |
| 117 | G585 | gi20467249 | 5.90E−66 | *Lotus japonicus* | myc-like regulatory protein. |
| 117 | G585 | gi21429235 | 1.70E−50 | *Onobrychis viciifolia* | basic helix-loop-helix regulatory p |
| 119 | G590 | AW782148 | 1.00E−49 | *Glycine max* | sm02b05.y1 Gm-c1027 *Glycine max* cDNA clone GENO |
| 119 | G590 | AW649972 | 5.00E−45 | *Lycopersicon esculentum* | EST328426 tomato germinating seedli |
| 119 | G590 | BZ045178 | 2.00E−37 | *Brassica oleracea* | 1kf53d05.g1 *B. oleracea*002 *Brassica olerac* |
| 119 | G590 | BM408345 | 3.00E−31 | *Solanum tuberosum* | EST582672 potato roots *Solanum tuberosum* |
| 119 | G590 | BM065639 | 4.00E−31 | *Capsicum annuum* | KS07005G09 KS07 *Capsicum annuum* cDNA, mRNA |
| 119 | G590 | BI308330 | 1.00E−30 | *Medicago truncatula* | EST529740 GPOD *Medicago truncatula* cDNA |
| 119 | G590 | BQ134415 | 5.00E−28 | *Zea mays* | 1091016H12.y2 1091-Immature ear with common ESTs |
| 119 | G590 | BU866069 | 1.00E−25 | *Populus tremula* x *Populus tremuloides* | S062C11 *Populus* imbib |
| 119 | G590 | AU290290 | 1.00E−24 | *Zinnia elegans* | AU290290 *zinnia* cultured mesophyll cell equa |
| 119 | G590 | BU574318 | 1.00E−24 | *Prunus dulcis* | PA_Ea0007A10f Almond developing seed *Prunus* |
| 119 | G590 | gi15451582 | 7.80E−32 | *Oryza sativa* | Putative SPATULA. |
| 119 | G590 | gi23495742 | 8.20E−28 | *Oryza sativa* (*japonica* cultivar-group) | putative phytochro |
| 119 | G590 | gi5923912 | 5.40E−10 | *Tulipa gesneriana* | bHLH transcription factor GBOF-1. |
| 119 | G590 | gi527657 | 1.40E−09 | *Pennisetum glaucum* | myc-like regulatory R gene product. |
| 119 | G590 | gi6166283 | 2.30E−09 | *Pinus taeda* | helix-loop-helix protein 1A. |
| 119 | G590 | gi527665 | 4.80E−09 | *Sorghum bicolor* | myc-like regulatory R gene product. |
| 119 | G590 | gi527661 | 1.00E−08 | *Phyllostachys acuta* | myc-like regulatory R gene product. |
| 119 | G590 | gi1086534 | 1.70E−08 | *Oryza officinalis* | transcriptional activator Ra homolog. |
| 119 | G590 | gi1086526 | 2.80E−08 | *Oryza australiensis* | transcriptional activator Ra homolog. |
| 119 | G590 | gi1086538 | 4.60E−08 | *Oryza rufipogon* | transcriptional activator Rb homolog. |
| 121 | G594 | BE807866 | 4.00E−38 | *Glycine max* | ss31c06.y1 Gm-c1061 *Glycine max* cDNA clone GENO |
| 121 | G594 | BQ875608 | 5.00E−38 | *Lactuca sativa* | QGI8J14.yg.ab1 QG_ABCDI lettuce salinas Lact |
| 121 | G594 | BU791131 | 1.00E−36 | *Populus balsamifera* subsp. *trichocarpa* x *Populus* deltoides | |
| 121 | G594 | CA015610 | 9.00E−35 | *Hordeum vulgare* subsp. *vulgare* | HT14N12r HT *Hordeum vulgare* |
| 121 | G594 | BF200249 | 2.00E−34 | *Triticum monococcum* | WHE2254_F11_L22ZE *Triticum monococcum* s |
| 121 | G594 | BM497415 | 6.00E−34 | *Avicennia marina* | 901269 *Avicennia marina* leaf cDNA Library |
| 121 | G594 | AW906522 | 4.00E−33 | *Solanum tuberosum* | EST342644 potato stolon, Cornell Universi |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 121 | G594 | AI731417 | 5.00E−33 | Gossypium hirsutum | BNLGHi9478 Six-day Cotton fiber Gossypiu |
| 121 | G594 | BE455695 | 5.00E−33 | Hordeum vulgare | HVSMEg0019A10f Hordeum vulgare pre-anthesis |
| 121 | G594 | BE360329 | 5.00E−33 | Sorghum bicolor | DG1_62_C04.g1_A002 Dark Grown 1 (DG1) Sorgh |
| 121 | G594 | gi20804997 | 2.20E−34 | Oryza sativa (japonica cultivar-group) | DNA-binding protei |
| 121 | G594 | gi11862964 | 6.00E−34 | Oryza sativa | hypothetical protein. |
| 121 | G594 | gi5923912 | 3.40E−31 | Tulipa gesneriana | bHLH transcription factor GBOF-1. |
| 121 | G594 | gi6166283 | 4.30E−10 | Pinus taeda | helix-loop-helix protein 1A. |
| 121 | G594 | gi13346182 | 3.80E−06 | Gossypium hirsutum | GHDEL65. |
| 121 | G594 | gi527665 | 4.80E−06 | Sorghum bicolor | myc-like regulatory R gene product. |
| 121 | G594 | gi527661 | 6.20E−06 | Phyllostachys acuta | myc-like regulatory R gene product. |
| 121 | G594 | gi4206118 | 6.60E−06 | Mesembryanthemum crystallinum | transporter homolog. |
| 121 | G594 | gi527657 | 1.30E−05 | Pennisetum glaucum | myc-like regulatory R gene product. |
| 121 | G594 | gi1086526 | 0.0001 | Oryza australiensis | transcriptional activator Ra homolog. |
| 123 | G597 | BE600816 | 5.00E−62 | Sorghum bicolor | PI1_90_E07.b1_A002 Pathogen induced 1 (PI1) |
| 123 | G597 | AY106980 | 3.00E−60 | Zea mays | PCO106555 mRNA sequence. |
| 123 | G597 | BQ765321 | 3.00E−58 | Hordeum vulgare | EBro03_SQ006_H21_R root, 3 week, waterlogge |
| 123 | G597 | CA501339 | 2.00E−57 | Triticum aestivum | WHE4032_D07_H14ZT Wheat meiotic anther cD |
| 123 | G597 | BQ841090 | 1.00E−56 | Aegilops speltoides | WHE4206_H10_O20ZS Aegilops speltoides p |
| 123 | G597 | BG465540 | 8.00E−56 | Sorghum propinquum | RHIZ2_45_G09.b1_A003 Rhizome2 (RHIZ2) So |
| 123 | G597 | AW928863 | 7.00E−53 | Lycopersicon esculentum | EST337651 tomato flower buds 8 mm t |
| 123 | G597 | BQ856774 | 4.00E−51 | Lactuca sativa | QGB5L17.yg.ab1 QG_ABCDI lettuce salinas Lact |
| 123 | G597 | BU926769 | 5.00E−51 | Glycine max | sas91d09.y1 Gm-c1036 Glycine max cDNA clone SOY |
| 123 | G597 | BJ473026 | 1.00E−50 | Hordeum vulgare subsp. vulgare | BJ473026 K. Sato unpublished |
| 123 | G597 | gi12643044 | 1.60E−65 | Oryza sativa | putative AT-Hook DNA-binding protein. |
| 123 | G597 | gi2213536 | 3.20E−49 | Pisum sativum | DNA-binding protein PD1. |
| 123 | G597 | gi4165183 | 2.90E−41 | Antirrhinum majus | SAP1 protein. |
| 123 | G597 | gi24418033 | 4.20E−15 | Oryza sativa (japonica cultivar-group) | Hypothetical prote |
| 123 | G597 | gi13992574 | 0.00058 | Triticum timopheevii | glutenin HMW subunit 1Ax. |
| 123 | G597 | gi100787 | 0.0011 | Triticum aestivum | glutenin high molecular weight chain 1A |
| 123 | G597 | gi7188720 | 0.0032 | Aegilops ventricosa | x-type high molecular weight glutenin |
| 123 | G597 | gi456124 | 0.066 | Nicotiana tabacum | DNA-binding protein. |
| 123 | G597 | gi21218057 | 0.076 | Chlamydomonas reinhardtii | putative Pi-transporter homolog |
| 123 | G597 | gi21779920 | 0.14 | Aegilops tauschii | HMW-glutenin. |
| 125 | G598 | BH488116 | 9.00E−41 | Brassica oleracea | BOHPM37TF BOHP Brassica oleracea genomic |
| 125 | G598 | BG455043 | 9.00E−38 | Medicago truncatula | NF112G09LF1F1069 Developing leaf Medica |
| 125 | G598 | BQ856793 | 3.00E−35 | Lactuca sativa | QGB5M13.yg.ab1 QG_ABCDI lettuce salinas Lact |
| 125 | G598 | AW932217 | 3.00E−33 | Lycopersicon esculentum | EST358060 tomato fruit mature green |
| 125 | G598 | BQ511117 | 5.00E−31 | Solanum tuberosum | EST618532 Generation of a set of potato c |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 125 | G598 | AP003981 | 3.00E−30 | Oryza sativa | chromosome 7 clone OJ1019_E02, *** SEQUENCING |
| 125 | G598 | AAAA01001857 | 3.00E−30 | Oryza sativa (indica cultivar-group) | ( ) scaffold001857 |
| 125 | G598 | AC135958 | 7.00E−30 | Oryza sativa (japonica cultivar-group) | ( ) chromosome 3 clo |
| 125 | G598 | BG319716 | 9.00E−23 | Zea mays | Zm03_06a07_A Zm03_AAFC_ECORC_cold_stressed_maize_s |
| 125 | G598 | BU025013 | 2.00E−20 | Helianthus annuus | QHF7D11.yg.ab1 QH_EFGHJ sunflower RHA280 |
| 125 | G598 | gi1881585 | 0.059 | Solanum tuberosum | remorin. |
| 125 | G598 | gi15289949 | 0.11 | Oryza sativa (japonica cultivar-group) | hypothetical prote |
| 125 | G598 | gi4883530 | 0.32 | Lycopersicon esculentum | remorin 2. |
| 125 | G598 | gi13161367 | 0.96 | Oryza sativa | hypothetical protein. |
| 125 | G598 | gi13775109 | 0.97 | Phaseolus vulgaris | bZIP transcription factor 3. |
| 125 | G598 | gi8096269 | 0.98 | Nicotiana tabacum | KED. |
| 125 | G598 | gi2598161 | 0.98 | Pinus strobus | NADPH: protochlorophyllide oxidoreductase po |
| 125 | G598 | gi1183880 | 0.99 | Brassica napus | oleosin-like protein. |
| 125 | G598 | gi22002966 | 1 | Hordeum vulgare subsp. vulgare | putative CENP-E like kinet |
| 125 | G598 | gi4185307 | 1 | Zea mays | unknown. |
| 127 | G634 | OSGT2 | 2.00E−47 | Oryza sativa | O. sativa gt-2 gene. |
| 127 | G634 | BU049946 | 1.00E−46 | Zea mays | 1111017E09.y1 1111-Unigene III from Maize Genome |
| 127 | G634 | AF372499 | 6.00E−38 | Glycine max | GT-2 factor mRNA, partial cds. |
| 127 | G634 | AB052729 | 4.00E−37 | Pisum sativum | mRNA for DNA-binding protein DF1, complete cd |
| 127 | G634 | BU889446 | 4.00E−36 | Populus tremula | P021A05 Populus petioles cDNA library Popul |
| 127 | G634 | BH436958 | 2.00E−35 | Brassica oleracea | BOHBE67TF BOHB Brassica oleracea genomic |
| 127 | G634 | AI777252 | 3.00E−35 | Lycopersicon esculentum | EST258217 tomato resistant, Cornell |
| 127 | G634 | AW686754 | 1.00E−33 | Medicago truncatula | NF042C08NR1F1000 Nodulated root Medicag |
| 127 | G634 | AV410715 | 4.00E−33 | Lotus japonicus | AV410715 Lotus japonicus young plants (two- |
| 127 | G634 | AI730933 | 8.00E−30 | Gossypium hirsutum | BNLGHi8208 Six-day Cotton fiber Gossypiu |
| 127 | G634 | gi13786451 | 3.20E−78 | Oryza sativa | putative transcription factor. |
| 127 | G634 | gi13646986 | 3.50E−66 | Pisum sativum | DNA-binding protein DF1. |
| 127 | G634 | gi18182311 | 2.70E−38 | Glycine max | GT-2 factor. |
| 127 | G634 | gi20161567 | 8.90E−11 | Oryza sativa (japonica cultivar-group) | hypothetical prote |
| 127 | G634 | gi170271 | 4.70E−08 | Nicotiana tabacum | DNA-binding protein. |
| 127 | G634 | gi18349 | 0.0027 | Daucus carota | glycine rich protein (AA 1-96). |
| 127 | G634 | gi21388658 | 0.027 | Physcomitrella patens | glycine-rich RNA binding protein. |
| 127 | G634 | gi21322752 | 0.052 | Triticum aestivum | cold shock protein-1. |
| 127 | G634 | gi3126963 | 0.057 | Elaeagnus umbellata | acidic chitinase. |
| 127 | G634 | gi1166450 | 0.087 | Lycopersicon esculentum | Tfm5. |
| 129 | G635 | BH528345 | 1.00E−117 | Brassica oleracea | BOGNZ34TR BOGN Brassica oleracea genomic |
| 129 | G635 | BQ916526 | 4.00E−71 | Helianthus annuus | QHB18C05.yg.ab1 QH_ABCDI sunflower RHA801 |
| 129 | G635 | AY110231 | 1.00E−68 | Zea mays | CL852_1 mRNA sequence. |
| 129 | G635 | BI139375 | 3.00E−42 | Populus balsamifera subsp. trichocarpa | F130P49Y Populus flo |
| 129 | G635 | BQ850859 | 3.00E−42 | Lactuca sativa | QGB13M04.yg.ab1 QG_ABCDI lettuce salinas Lac |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 129 | G635 | AC137603 | 6.00E−40 | *Medicago truncatula* | clone mth2-14b10, WORKING DRAFT SEQUENC |
| 129 | G635 | BF269947 | 6.00E−37 | *Gossypium arboreum* | GA_Eb0006B11f *Gossypium arboreum* 7-10 d |
| 129 | G635 | AW760602 | 5.00E−34 | *Glycine max* | s152e02.y1 Gm-c1027 *Glycine max* cDNA clone GENO |
| 129 | G635 | BJ464004 | 1.00E−30 | *Hordeum vulgare* subsp. *vulgare* | BJ464004 K. Sato unpublished |
| 129 | G635 | AAAA01000007 | 1.00E−30 | *Oryza sativa* (*indica* cultivar-group) | ( ) scaffold000007 |
| 129 | G635 | gi21741458 | 3.30E−08 | *Oryza sativa* | OJ000223_09.14. |
| 129 | G635 | gi170271 | 1.20E−07 | *Nicotiana tabacum* | DNA-binding protein. |
| 129 | G635 | gi18182309 | 3.00E−06 | *Glycine max* | GT-2 factor. |
| 129 | G635 | gi13646986 | 3.10E−05 | *Pisum sativum* | DNA-binding protein DF1. |
| 129 | G635 | gi22128704 | 0.02 | *Oryza sativa* (*japonica* cultivar-group) | hypothetical prote |
| 129 | G635 | gi7208779 | 0.04 | *Cicer arietinum* | hypothetical protein. |
| 129 | G635 | gi1279563 | 0.056 | *Medicago sativa* | nuM1. |
| 129 | G635 | gi15144506 | 0.066 | *Lycopersicon esculentum* | unknown. |
| 129 | G635 | gi349585 | 0.36 | *Volvox carteri* | histone H1-I. |
| 129 | G635 | gi2911292 | 0.49 | *Capsicum annuum* | prosystemin. |
| 131 | G636 | AB052729 | 1.00E−134 | *Pisum sativum* | mRNA for DNA-binding protein DF1, complete cd |
| 131 | G636 | OSGT2 | 1.00E−109 | *Oryza sativa* | *O. sativa* gt-2 gene. |
| 131 | G636 | AF372498 | 1.00E−103 | *Glycine max* | GT-2 factor mRNA, partial cds. |
| 131 | G636 | AAAA01017145 | 1.00E−101 | *Oryza sativa* (*indica* cultivar-group) | ( ) scaffold017145 |
| 131 | G636 | BH521870 | 4.00E−89 | *Brassica oleracea* | BOGMP76TF BOGM *Brassica oleracea* genomic |
| 131 | G636 | AP004868 | 2.00E−79 | *Oryza sativa* (*japonica* cultivar-group) | ( ) chromosome 2 clo |
| 131 | G636 | BU894555 | 2.00E−69 | *Populus tremula* x *Populus tremuloides* | X011B09 *Populus* wood |
| 131 | G636 | BG446849 | 2.00E−57 | *Gossypium arboreum* | GA_Eb0039I22f *Gossypium arboreum* 7-10 d |
| 131 | G636 | AW032956 | 3.00E−52 | *Lycopersicon esculentum* | EST276515 tomato callus, TAMU Lycop |
| 131 | G636 | AC135565 | 4.00E−49 | *Medicago truncatula* | clone mth2-19b12, WORKING DRAFT SEQUENC |
| 131 | G636 | gi13646986 | 4.50E−111 | *Pisum sativum* | DNA-binding protein DF1. |
| 131 | G636 | gi18182309 | 4.00E−99 | *Glycine max* | GT-2 factor. |
| 131 | G636 | gi13786451 | 5.30E−98 | *Oryza sativa* | putative transcription factor. |
| 131 | G636 | gi170271 | 4.30E−13 | *Nicotiana tabacum* | DNA-binding protein. |
| 131 | G636 | gi20161567 | 4.00E−09 | *Oryza sativa* (*japonica* cultivar-group) | hypothetical prote |
| 131 | G636 | gi10636140 | 0.00014 | *Aegilops speltoides* | gamma-gliadin. |
| 131 | G636 | gi442524 | 0.00015 | *Hordeum vulgare* | C-hordein. |
| 131 | G636 | gi15148391 | 0.00021 | *Triticum aestivum* | gamma-gliadin. |
| 131 | G636 | gi225589 | 0.00021 | *Hordeum vulgare* var. *distichum* | hordein C. |
| 131 | G636 | gi4584086 | 0.00061 | *Spermatozopsis similis* | p210 protein. |
| 133 | G638 | BZ034676 | 3.00E−87 | *Brassica oleracea* | oef83a05.g1 *B. oleracea*002 *Brassica* olerac |
| 133 | G638 | BQ866994 | 6.00E−55 | *Lactuca sativa* | QGC9I02.yg.ab1 QG_ABCDI lettuce salinas Lact |
| 133 | G638 | BM110736 | 1.00E−54 | *Solanum tuberosum* | EST558272 potato roots *Solanum tuberosum* |
| 133 | G638 | BF646615 | 9.00E−48 | *Medicago truncatula* | NF066C08EC1F1065 Elicited cell culture |
| 133 | G638 | OSGT2 | 3.00E−36 | *Oryza sativa* | *O. sativa* gt-2 gene. |
| 133 | G638 | AP004868 | 4.00E−33 | *Oryza sativa* (*japonica* cultivar-group) | ( ) chromosome 2 clo |
| 133 | G638 | AB052729 | 2.00E−32 | *Pisum sativum* | mRNA for DNA-binding protein DF1, complete cd |
| 133 | G638 | AI777252 | 4.00E−29 | *Lycopersicon esculentum* | EST258217 tomato resistant, Cornell |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 133 | G638 | BM500043 | 2.00E−28 | Zea mays | 952036C09.y1 952-BMS tissue from Walbot Lab (red |
| 133 | G638 | AF372499 | 5.00E−28 | Glycine max | GT-2 factor mRNA, partial cds. |
| 133 | G638 | gi20249 | 2.00E−49 | Oryza sativa | gt-2. |
| 133 | G638 | gi13646986 | 4.30E−45 | Pisum sativum | DNA-binding protein DF1. |
| 133 | G638 | gi18182311 | 1.10E−30 | Glycine max | GT-2 factor. |
| 133 | G638 | gi20161567 | 2.60E−07 | Oryza sativa (japonica cultivar-group) | hypothetical prote |
| 133 | G638 | gi170271 | 3.40E−06 | Nicotiana tabacum | DNA-binding protein. |
| 133 | G638 | gi21068672 | 3.60E−05 | Cicer arietinum | putative glicine-rich protein. |
| 133 | G638 | gi20257673 | 4.60E−05 | Zea mays | glycine-rich RNA binding protein. |
| 133 | G638 | gi21388660 | 0.00014 | Physcomitrella patens | glycine-rich RNA-binding protein. |
| 133 | G638 | gi9755844 | 0.00033 | Brassica napus | putative glycine-rich protein. |
| 133 | G638 | gi1166450 | 0.00037 | Lycopersicon esculentum | Tfm5. |
| 135 | G652 | BH926980 | 5.00E−90 | Brassica oleracea | odi21g11.g1 B. oleracea002 Brassica olerac |
| 135 | G652 | NSGRP2MR | 1.00E−71 | Nicotiana sylvestris | N. sylvestris mRNA for glycine rich pro |
| 135 | G652 | AI812203 | 7.00E−65 | Zea mays | 605086G09.y1 605-Endosperm cDNA library from Sch |
| 135 | G652 | BM408211 | 4.00E−64 | Solanum tuberosum | EST582538 potato roots Solanum tuberosum |
| 135 | G652 | AP003879 | 6.00E−64 | Oryza sativa | chromosome 8 clone OJ1123_A02, *** SEQUENCING |
| 135 | G652 | AP004591 | 6.00E−64 | Oryza sativa (japonica cultivar-group) | ( ) chromosome 8 clo |
| 135 | G652 | AAAA01000576 | 7.00E−63 | Oryza sativa (indica cultivar-group) | ( ) scaffold000576 |
| 135 | G652 | AB066265 | 1.00E−62 | Triticum aestivum | WCSP1 mRNA for cold shock protein-1, comp |
| 135 | G652 | BQ840577 | 2.00E−62 | Aegilops speltoides | WHE4201_B07_C13ZS Aegilops speltoides p |
| 135 | G652 | BE035242 | 1.00E−53 | Mesembryanthemum crystallinum | MO03A01 MO Mesembryanthemum c |
| 135 | G652 | gi121631 | 9.30E−68 | Nicotiana sylvestris | GLYCINE-RICH CELL WALL STRUCTURAL PR |
| 135 | G652 | gi21322752 | 1.70E−61 | Triticum aestivum | cold shock protein-1. |
| 135 | G652 | gi121628 | 5.00E−26 | Phaseolus vulgaris | GLYCINE-RICH CELL WALL STRUCTURAL PROT |
| 135 | G652 | gi395147 | 7.10E−25 | Nicotiana tabacum | glycine-rich protein. |
| 135 | G652 | gi17821 | 1.40E−23 | Brassica napus | glycine-rich_protein_(aa1-291). |
| 135 | G652 | gi121627 | 1.80E−23 | Petunia x hybrida | GLYCINE-RICH CELL WALL STRUCTURAL PROTE |
| 135 | G652 | gi225181 | 1.80E−23 | Petunia sp. | Gly rich structural protein. |
| 135 | G652 | gi15528745 | 2.00E−22 | Oryza sativa | contains ESTs AU093876(E1018), AU093877 (E1018 |
| 135 | G652 | gi21327989 | 2.00E−22 | Oryza sativa (japonica cultivar-group) | contains ESTs AU09 |
| 135 | G652 | gi21388660 | 4.40E−22 | Physcomitrella patens | glycine-rich RNA-binding protein. |
| 137 | G663 | AF146702 | 6.00E−54 | Petunia x hybrida | An2 protein (an2) mRNA, an2-V26 allele, c |
| 137 | G663 | AF146703 | 3.00E−53 | Petunia integrifolia | An2 protein (an2) mRNA, an2-S9 allele, |
| 137 | G663 | BQ990780 | 4.00E−51 | Lactuca sativa | QGF21B10.yg.ab1 QG_EFGHJ lettuce serriola La |
| 137 | G663 | BE462282 | 3.00E−50 | Lycopersicon esculentum | EST324546 tomato flower buds 0-3 mm |
| 137 | G663 | AB073013 | 6.00E−50 | Vitis labrusca x Vitis vinifera | VlmybA2 gene for myb-relate |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 137 | G663 | AF146709 | 2.00E−49 | Petunia axillaris | An2 truncated protein (an2) mRNA, an2-S7 |
| 137 | G663 | BH480961 | 3.00E−47 | Brassica oleracea | BOGZT54TF BOGZ Brassica oleracea genomic |
| 137 | G663 | BF635572 | 6.00E−42 | Medicago truncatula | NF104H01DT1F1014 Drought Medicago trunc |
| 137 | G663 | BQ105368 | 2.00E−41 | Rosa hybrid cultivar | fc0707.e Rose Petals (Fragrant Cloud) |
| 137 | G663 | AF336278 | 2.00E−41 | Gossypium hirsutum | BNLGHi233 (bnlghi6233) mRNA, complete cd |
| 137 | G663 | gi7673084 | 1.10E−53 | Petunia x hybrida | An2 protein. |
| 137 | G663 | gi7673086 | 3.90E−53 | Petunia integrifolia | An2 protein. |
| 137 | G663 | gi22266667 | 2.30E−50 | Vitis labrusca x Vitis vinifera | myb-related transcription |
| 137 | G663 | gi7673096 | 1.30E−47 | Petunia axillaris | An2 truncated protein. |
| 137 | G663 | gi13346178 | 2.30E−41 | Gossypium hirsutum | BNLGHi233. |
| 137 | G663 | gi1101770 | 8.40E−41 | Picea mariana | MYB-like transcriptional factor MBF1. |
| 137 | G663 | gi22535556 | 1.20E−39 | Oryza sativa (japonica cultivar-group) | myb-related protei |
| 137 | G663 | gi2605623 | 1.20E−39 | Oryza sativa | OSMYB4. |
| 137 | G663 | gi2343273 | 4.80E−39 | Zea mays | PL transcription factor. |
| 137 | G663 | gi4138299 | 4.80E−39 | Oryza sativa subsp. indica | transcriptional activator. |
| 139 | G664 | AF336286 | 2.00E−89 | Gossypium hirsutum | GHMYB9 (ghmyb9) mRNA, complete cds. |
| 139 | G664 | LETHM27 | 7.00E−88 | Lycopersicon esculentum | L. esculentum mRNA for THM27 protein |
| 139 | G664 | BG442984 | 9.00E−83 | Gossypium arboreum | GA_Ea0019B05f Gossypium arboreum 7-10 d |
| 139 | G664 | BM112753 | 1.00E−80 | Solanum tuberosum | EST560289 potato roots Solanum tuberosum |
| 139 | G664 | AY108280 | 5.00E−78 | Zea mays | PCO132931 mRNA sequence. |
| 139 | G664 | BF716393 | 2.00E−76 | Glycine max | saa19f01.y1 Gm-c1058 Glycine max cDNA clone GEN |
| 139 | G664 | BH537477 | 5.00E−76 | Brassica oleracea | BOGIR45TF BOGI Brassica oleracea genomic |
| 139 | G664 | HVMYB1 | 1.00E−75 | Hordeum vulgare | H. vulgare myb1 mRNA. |
| 139 | G664 | AW775893 | 1.00E−74 | Medicago truncatula | EST334958 DSIL Medicago truncatula cDNA |
| 139 | G664 | BQ855835 | 8.00E−73 | Lactuca sativa | QGB27N20.yg.ab1 QG_ABCDI lettuce salinas Lac |
| 139 | G664 | gi13346194 | 3.50E−88 | Gossypium hirsutum | GHMYB9. |
| 139 | G664 | gi1167484 | 8.00E−85 | Lycopersicon esculentum | transcription factor. |
| 139 | G664 | gi82308 | 3.20E−74 | Antirrhinum majus | myb protein 308-garden snapdragon. |
| 139 | G664 | gi19072766 | 5.30E−73 | Oryza sativa | typical P-type R2R3 Myb protein. |
| 139 | G664 | gi127579 | 3.80E−71 | Hordeum vulgare | MYB-RELATED PROTEIN HV1. |
| 139 | G664 | gi227030 | 3.80E−71 | Hordeum vulgare var. distichum | myb-related gene Hv1. |
| 139 | G664 | gi19386839 | 3.00E−69 | Oryza sativa (japonica cultivar-group) | putative myb-relat |
| 139 | G664 | gi127582 | 8.10E−69 | Zea mays | MYB-RELATED PROTEIN ZM38. |
| 139 | G664 | gi23476285 | 2.10E−61 | Gossypioides kirkii | myb-like transcription factor 1. |
| 139 | G664 | gi23476281 | 9.10E−61 | Gossypium raimondii | myb-like transcription factor 1. |
| 141 | G674 | BE021475 | 2.00E−47 | Glycine max | sm59a03.y1 Gm-c1028 Glycine max cDNA clone GENO |
| 141 | G674 | AY104558 | 1.00E−43 | Zea mays | PCO116495 mRNA sequence. |
| 141 | G674 | BE402501 | 3.00E−43 | Triticum aestivum | CSB008F03F990908 ITEC CSB Wheat Endosperm |
| 141 | G674 | AW672062 | 2.00E−42 | Sorghum bicolor | LG1_354_G05.b1_A002 Light Grown 1 (LG1) Sor |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 141 | G674 | CA002506 | 2.00E−42 | Hordeum vulgare subsp. vulgare | HS07L12r HS Hordeum vulgare |
| 141 | G674 | AW691296 | 3.00E−42 | Medicago truncatula | NF040A12ST1F1000 Developing stem Medica |
| 141 | G674 | BM356984 | 2.00E−41 | Triphysaria versicolor | 12II-D5 Triphysaria versicolor root- |
| 141 | G674 | BQ290999 | 2.00E−41 | Pinus taeda | NXRV054_D07_FNXRV (Nsf Xylem Root wood Vertica |
| 141 | G674 | AW626100 | 3.00E−40 | Lycopersicon esculentum | EST320007 tomato radicle, 5 d post- |
| 141 | G674 | BQ802392 | 6.00E−40 | Triticum monococcum | WHE2825_D09_G17ZS Triticum monococcum v |
| 141 | G674 | gi13486737 | 5.20E−42 | Oryza sativa | putative transcription factor (myb). |
| 141 | G674 | gi22093837 | 3.70E−41 | Oryza sativa (japonica cultivar-group) | contains ESTs AU10 |
| 141 | G674 | gi19059 | 2.40E−37 | Hordeum vulgare | MybHv33. |
| 141 | G674 | gi5139802 | 8.10E−37 | Glycine max | GmMYB29A1. |
| 141 | G674 | gi1167486 | 1.30E−36 | Lycopersicon esculentum | transcription factor. |
| 141 | G674 | gi82310 | 9.30E−36 | Antirrhinum majus | myb protein 330-garden snapdragon. |
| 141 | G674 | gi13346188 | 3.20E−35 | Gossypium hirsutum | GHMYB25. |
| 141 | G674 | gi22266673 | 4.00E−35 | Vitis labrusca x Vitis vinifera | myb-related transcription |
| 141 | G674 | gi6552389 | 1.40E−34 | Nicotiana tabacum | myb-related transcription factor LBM4. |
| 141 | G674 | gi15082210 | 1.70E−34 | Fragaria x ananassa | transcription factor MYB1. |
| 143 | G676 | AF502295 | 1.00E−109 | Cucumis sativus | werewolf (WER) mRNA, partial cds. |
| 143 | G676 | BF275643 | 2.00E−56 | Gossypium arboreum | GA_Eb0024J14f Gossypium arboreum 7-10 d |
| 143 | G676 | BZ078562 | 3.00E−47 | Brassica oleracea | lkz44b07.b1 B. oleracea002 Brassica olerac |
| 143 | G676 | AF034130 | 3.00E−42 | Gossypium hirsutum | MYB-like DNA-binding domain protein (Cmy |
| 143 | G676 | BU830456 | 4.00E−42 | Populus tremula x Populus tremuloides | T008E08 Populus apica |
| 143 | G676 | AF401220 | 6.00E−42 | Fragaria x ananassa | transcription factor MYB1 (MYB1) mRNA, |
| 143 | G676 | AI771837 | 2.00E−41 | Lycopersicon esculentum | EST252937 tomato ovary, TAMU Lycope |
| 143 | G676 | BE124666 | 4.00E−41 | Medicago truncatula | EST393701 GVN Medicago truncatula cDNA |
| 143 | G676 | BG881996 | 9.00E−41 | Glycine max | sae92f10.y1 Gm-c1065 Glycine max cDNA clone GEN |
| 143 | G676 | AF474115 | 2.00E−40 | Zea mays | typical P-type R2R3 Myb protein (Myb1) gene, parti |
| 143 | G676 | gi20514371 | 1.10E−103 | Cucumis sativus | werewolf. |
| 143 | G676 | gi1101770 | 4.10E−43 | Picea mariana | MYB-like transcriptional factor MBF1. |
| 143 | G676 | gi23476291 | 2.50E−42 | Gossypium raimondii | myb-like transcription factor 2. |
| 143 | G676 | gi2921332 | 3.20E−42 | Gossypium hirsutum | MYB-like DNA-binding domain protein. |
| 143 | G676 | gi23476293 | 6.60E−42 | Gossypium herbaceum | myb-like transcription factor 2. |
| 143 | G676 | gi15082210 | 1.10E−41 | Fragaria x ananassa | transcription factor MYB1. |
| 143 | G676 | gi23476297 | 1.40E−41 | Gossypioides kirkii | myb-like transcription factor 3. |
| 143 | G676 | gi19072734 | 6.00E−41 | Zea mays | typical P-type R2R3 Myb protein. |
| 143 | G676 | gi82308 | 1.20E−40 | Antirrhinum majus | myb protein 308-garden snapdragon. |
| 143 | G676 | gi1167484 | 3.30E−40 | Lycopersicon esculentum | transcription factor. |
| 145 | G680 | PVU420902 | 1.00E−149 | Phaseolus vulgaris | mRNA for LHY protein. |
| 145 | G680 | BH579338 | 8.00E−93 | Brassica oleracea | BOGDR44TF BOGD Brassica oleracea genomic |
| 145 | G680 | AAAA01009649 | 3.00E−59 | Oryza sativa (indica cultivar-group) | ( ) scaffold009649 |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 145 | G680 | AP004460 | 2.00E−58 | Oryza sativa (japonica cultivar-group) | ( ) chromosome 8 clo |
| 145 | G680 | BU868664 | 3.00E−56 | Populus balsamifera subsp. trichocarpa | M118F07 Populus flow |
| 145 | G680 | BE331563 | 2.00E−54 | Glycine max | sp15d08.y1 Gm-c1042 Glycine max cDNA clone GENO |
| 145 | G680 | BG524104 | 2.00E−49 | Stevia rebaudiana | 38-82 Stevia field grown leaf cDNA Stevia |
| 145 | G680 | AW979367 | 2.00E−46 | Lycopersicon esculentum | EST310415 tomato root deficiency, C |
| 145 | G680 | BM322287 | 3.00E−45 | Sorghum bicolor | PIC1_2_F02.b1_A002 Pathogen-infected compat |
| 145 | G680 | AY103618 | 5.00E−45 | Zea mays | PCO118792 mRNA sequence. |
| 145 | G680 | gi21213868 | 1.40E−144 | Phaseolus vulgaris | LHY protein. |
| 145 | G680 | gi15528628 | 4.80E−24 | Oryza sativa | hypothetical protein~similar to Oryza sativa |
| 145 | G680 | gi18461206 | 1.10E−07 | Oryza sativa (japonica cultivar-group) | contains ESTs AU10 |
| 145 | G680 | gi18874263 | 6.60E−07 | Antirrhinum majus | MYB-like transcription factor DIVARICAT |
| 145 | G680 | gi12406993 | 1.70E−06 | Hordeum vulgare | MCB1 protein. |
| 145 | G680 | gi12005328 | 3.20E−06 | Hevea brasiliensis | unknown. |
| 145 | G680 | gi20067661 | 3.40E−06 | Zea mays | one repeat myb transcriptional factor. |
| 145 | G680 | gi6688529 | 1.20E−05 | Lycopersicon esculentum | I-box binding factor. |
| 145 | G680 | gi19911577 | 0.00036 | Glycine max | syringolide-induced protein 1-3-1A. |
| 145 | G680 | gi7677132 | 0.012 | Secale cereale | c-myb-like transcription factor. |
| 147 | G682 | BU831849 | 8.00E−25 | Populus tremula x Populus tremuloides | T026E01 Populus apica |
| 147 | G682 | BU872107 | 8.00E−25 | Populus balsamifera subsp. trichocarpa | Q039C07 Populus flow |
| 147 | G682 | BM437313 | 1.00E−20 | Vitis vinifera | VVA017F06_54121 An expressed sequence tag da |
| 147 | G682 | BI699876 | 4.00E−19 | Glycine max | sag49b09.y1 Gm-c1081 Glycine max cDNA clone GEN |
| 147 | G682 | BH961028 | 1.00E−16 | Brassica oleracea | odj30d06.g1 B. oleracea002 Brassica olerac |
| 147 | G682 | AL750151 | 2.00E−14 | Pinus pinaster | AL750151 AS Pinus pinaster cDNA clone AS06C1 |
| 147 | G682 | BJ476463 | 1.00E−13 | Hordeum vulgare subsp. vulgare | BJ476463 K. Sato unpublished |
| 147 | G682 | AJ485557 | 1.00E−13 | Hordeum vulgare | AJ485557 S00011 Hordeum vulgare cDNA clone |
| 147 | G682 | CA762299 | 2.00E−13 | Oryza sativa (indica cultivar-group) | BR060003B10F03.ab1 IRR |
| 147 | G682 | CA736777 | 2.00E−12 | Triticum aestivum | wpi1s.pk008.n12 wpi1s Triticum aestivum c |
| 147 | G682 | gi23476287 | 8.30E−12 | Gossypium hirsutum | myb-like transcription factor 2. |
| 147 | G682 | gi23476291 | 8.30E−12 | Gossypium raimondii | myb-like transcription factor 2. |
| 147 | G682 | gi23476293 | 8.30E−12 | Gossypium herbaceum | myb-like transcription factor 2. |
| 147 | G682 | gi23476295 | 8.30E−12 | Gossypioides kirkii | myb-like transcription factor 2. |
| 147 | G682 | gi15042120 | 2.20E−11 | Zea luxurians | CI protein. |
| 147 | G682 | gi19548449 | 2.20E−11 | Zea mays | P-type R2R3 Myb protein. |
| 147 | G682 | gi9954118 | 2.80E−11 | Solanum tuberosum | tuber-specific and sucrose-responsive e |
| 147 | G682 | gi15042108 | 4.60E−11 | Zea mays subsp. parviglumis | CI protein. |
| 147 | G682 | gi15082210 | 1.50E−10 | Fragaria x ananassa | transcription factor MYB1. |
| 147 | G682 | gi22266669 | 1.50E−10 | Vitis labrusca x Vitis vinifera | myb-related transcription |
| 149 | G715 | BG591677 | 9.00E−91 | Solanum tuberosum | EST499519 P. infestans-challenged leaf So |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 149 | G715 | AW776719 | 2.00E−89 | Medicago truncatula | E5T335784 DSIL Medicago truncatula cDNA |
| 149 | G715 | BE208917 | 2.00E−87 | Citrus × paradisi | GF-FV-P3F5 Marsh grapefruit young flavedo |
| 149 | G715 | BQ411597 | 1.00E−86 | Gossypium arboreum | GA_Ed0041B06f Gossypium arboreum 7-10 d |
| 149 | G715 | BM065544 | 4.00E−86 | Capsicum annuum | KS07004F12 KS07 Capsicum annuum cDNA, mRNA |
| 149 | G715 | BI701620 | 4.00E−83 | Glycine max | sai18a04.y1 Gm-c1053 Glycine max cDNA clone GEN |
| 149 | G715 | BH725354 | 2.00E−79 | Brassica oleracea | BOHVO37TF BO_2_3_KB Brassica oleracea gen |
| 149 | G715 | AW093662 | 6.00E−77 | Lycopersicon esculentum | EST286842 tomato mixed elicitor, BT |
| 149 | G715 | AW399586 | 2.00E−67 | Lycopersicon pennellii | EST310086 L. pennellii trichome, Cor |
| 149 | G715 | AC134235 | 8.00E−66 | Oryza sativa (japonica cultivar-group) | ( ) chromosome 3 clo |
| 149 | G715 | gi5257260 | 2.00E−52 | Oryza sativa | Similar to sequence of BAC F7G19 from Arabid |
| 149 | G715 | gi20804442 | 1.80E−20 | Oryza sativa (japonica cultivar-group) | hypothetical prote |
| 149 | G715 | gi18481626 | 3.70E−08 | Zea mays | repressor protein. |
| 149 | G715 | gi1778097 | 0.19 | Pinus taeda | expansin. |
| 149 | G715 | gi2130105 | 0.44 | Triticum aestivum | histone H2A.4-wheat. |
| 149 | G715 | gi297871 | 0.47 | Picea abies | histone H2A. |
| 149 | G715 | gi5106924 | 0.56 | Medicago truncatula | putative cell wall protein. |
| 149 | G715 | gi1247386 | 0.6 | Nicotiana alata | PRP2. |
| 149 | G715 | gi121981 | 0.8 | Volvox carteri | HISTONE H2A-III. |
| 149 | G715 | gi1708102 | 0.8 | Chlamydomonas reinhardtii | HISTONE H2A. |
| 151 | G720 | BH650015 | 1.00E−68 | Brassica oleracea | BOMOG70TF BO_2_3_KB Brassica oleracea gen |
| 151 | G720 | BG450227 | 3.00E−55 | Medicago truncatula | NF015E11DT1F1087 Drought Medicago trunc |
| 151 | G720 | BG642566 | 7.00E−50 | Lycopersicon esculentum | EST510760 tomato shoot/meristem Lyc |
| 151 | G720 | BG887673 | 3.00E−45 | Solanum tuberosum | EST513524 cSTD Solanum tuberosum cDNA clo |
| 151 | G720 | BU878634 | 5.00E−45 | Populus balsamifera subsp. trichocarpa | V049F07 Populus flow |
| 151 | G720 | BQ594416 | 4.00E−42 | Beta vulgaris | E012444-024-024-N22-SP6 MPIZ-ADIS-024-develop |
| 151 | G720 | AF318581 | 4.00E−41 | Oryza sativa | putative transcription factor OsGLK1 (Glk1) mR |
| 151 | G720 | AF318579 | 1.00E−39 | Zea mays | putative transcription factor GOLDEN 2 mRNA, compl |
| 151 | G720 | BU004944 | 5.00E−37 | Lactuca sativa | QGG6K14.yg.ab1 QG_EFGHJ lettuce serriola Lac |
| 151 | G720 | AW618051 | 4.00E−34 | Lycopersicon pennellii | EST314101 L. pennellii trichome, Cor |
| 151 | G720 | gi13940496 | 1.20E−38 | Zea mays | putative transcription factor ZmGLK1. |
| 151 | G720 | gi24308616 | 2.20E−27 | Oryza sativa (japonica cultivar-group) | Putative response |
| 151 | G720 | gi13940498 | 2.10E−26 | Oryza sativa | putative transcription factor OsGLK1. |
| 151 | G720 | gi4519671 | 1.10E−08 | Nicotiana tabacum | transfactor. |
| 151 | G720 | gi6942190 | 3.50E−08 | Mesembryanthemum crystallinum | CDPK substrate protein 1; C |
| 151 | G720 | gi5916207 | 1.90E−06 | Chlamydomonas reinhardtii | regulatory protein of P-starvat |
| 151 | G720 | gi10198182 | 0.016 | Cladrastis kentukea | ENOD2. |
| 151 | G720 | gi100216 | 0.02 | Lycopersicon esculentum | extensin class II (clone uJ-2)- |
| 151 | G720 | gi169878 | 0.032 | Sesbania rostrata | nodulin. |
| 151 | G720 | gi1808688 | 0.041 | Sporobolus stapfianus | hypothetical protein. |
| 153 | G736 | BH959523 | 2.00E−65 | Brassica oleracea | odh52c03.b1 B. oleracea002 Brassica olerac |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 153 | G736 | BU868493 | 2.00E−43 | *Populus balsamifera* subsp. *trichocarpa* | M116E08 *Populus* flow |
| 153 | G736 | AW648389 | 4.00E−38 | *Lycopersicon esculentum* | EST326843 tomato germinating seedli |
| 153 | G736 | CA810654 | 4.00E−37 | *Vitis vinifera* | CA22LIO1IVF-E1 CA22LI *Vitis vinifera* cDNA cl |
| 153 | G736 | BE323614 | 4.00E−34 | *Medicago truncatula* | NF006A11PL1F1081 Phosphate starved leaf |
| 153 | G736 | BE474759 | 3.00E−29 | *Glycine max* | sp68c07.y1 Gm-c1044 *Glycine max* cDNA clone GENO |
| 153 | G736 | AP005167 | 7.00E−28 | *Oryza sativa* (*japonica* cultivar-group) | ( ) chromosome 7 clo |
| 153 | G736 | AAAA01004298 | 7.00E−28 | *Oryza sativa* (*indica* cultivar-group) | ( ) scaffold004298 |
| 153 | G736 | CA753311 | 2.00E−27 | *Oryza sativa* | 00210011068.D09_0106282 29W.scf IR62266 *Oryza s* |
| 153 | G736 | BJ471540 | 3.00E−27 | *Hordeum vulgare* subsp. *vulgare* | BJ471540 K. Sato unpublished |
| 153 | G736 | gi19071625 | 5.30E−30 | *Oryza sativa* (*japonica* cultivar-group) | putative zinc fing |
| 153 | G736 | gi15451553 | 6.50E−30 | *Oryza sativa* | Putative H-protein promoter binding factor-2 |
| 153 | G736 | gi21538791 | 1.70E−27 | *Hordeum vulgare* subsp. *vulgare* | dof zinc finger protein. |
| 153 | G736 | gi1669341 | 1.20E−26 | *Cucurbita maxima* | AOBP (ascorbate oxidase promoter-binding |
| 153 | G736 | gi3929325 | 1.00E−22 | *Dendrobium grex Madame Thong-In* | putative DNA-binding prot |
| 153 | G736 | gi3777436 | 1.30E−22 | *Hordeum vulgare* | DNA binding protein. |
| 153 | G736 | gi2393775 | 1.20E−21 | *Zea mays* | prolamin box binding factor. |
| 153 | G736 | gi1360078 | 2.40E−21 | *Nicotiana tabacum* | Zn finger protein. |
| 153 | G736 | gi3790264 | 3.90E−21 | *Triticum aestivum* | PBF protein. |
| 153 | G736 | gi7688355 | 6.40E−21 | *Solanum tuberosum* | Dof zinc finger protein. |
| 155 | G748 | D45066 | 6.00E−91 | *Cucurbita maxima* | mRNA for AOBP (ascorbate oxidase promoter- |
| 155 | G748 | BH530891 | 3.00E−69 | *Brassica oleracea* | BOHIF05TR BOHI *Brassica oleracea* genomic |
| 155 | G748 | AP001383 | 3.00E−63 | *Oryza sativa* | genomic DNA, chromosome 1, clone: P0453A06. |
| 155 | G748 | AAAA01004298 | 1.00E−62 | *Oryza sativa* (*indica* cultivar-group) | ( ) scaffold004298 |
| 155 | G748 | AP005167 | 1.00E−62 | *Oryza sativa* (*japonica* cultivar-group) | ( ) chromosome 7 clo |
| 155 | G748 | CA783807 | 2.00E−56 | *Glycine max* | sat57f01.y1 Gm-c1056 *Glycine max* cDNA clone SOY |
| 155 | G748 | AC137986 | 1.00E−48 | *Medicago truncatula* | clone mth2-7g6, WORKING DRAFT SEQUENCE, |
| 155 | G748 | AW029804 | 1.00E−46 | *Lycopersicon esculentum* | EST273059 tomato callus, TAMU Lycop |
| 155 | G748 | BQ488386 | 3.00E−46 | *Beta vulgaris* | 43-E8885-006-003-F11-T3 Sugar beet MPIZ-ADIS- |
| 155 | G748 | HVU312330 | 2.00E−41 | *Hordeum vulgare* subsp. *vulgare* | *Hordeum vulgare* partial dof |
| 155 | G748 | gi1669341 | 5.90E−89 | *Cucurbita maxima* | AOBP (ascorbate oxidase promoter-binding |
| 155 | G748 | gi7242908 | 1.80E−64 | *Oryza sativa* | ESTs C23582(S11122), AU056531 (S20663) corresp |
| 155 | G748 | gi19071625 | 5.80E−59 | *Oryza sativa* (*japonica* cultivar-group) | putative zinc fing |
| 155 | G748 | gi21538791 | 7.10E−38 | *Hordeum vulgare* subsp. *vulgare* | dof zinc finger protein. |
| 155 | G748 | gi2393775 | 8.00E−30 | *Zea mays* | prolamin box binding factor. |
| 155 | G748 | gi3929325 | 3.10E−28 | *Dendrobium grex Madame Thong-In* | putative DNA-binding prot |
| 155 | G748 | gi3777436 | 5.90E−25 | *Hordeum vulgare* | DNA binding protein. |
| 155 | G748 | gi3790264 | 2.40E−24 | *Triticum aestivum* | PBF protein. |
| 155 | G748 | gi7688355 | 3.50E−24 | *Solanum tuberosum* | Dof zinc finger protein. |
| 155 | G748 | gi6092016 | 1.00E−23 | *Pisum sativum* | elicitor-responsive Dof protein ERDP. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 157 | G779 | AAAA01003354 | 3.00E−37 | Oryza sativa (indica cultivar-group) | ( ) scaffold003354 |
| 157 | G779 | AP004462 | 3.00E−37 | Oryza sativa (japonica cultivar-group) | ( ) chromosome 8 clo |
| 157 | G779 | AT002234 | 1.00E−36 | Brassica rapa subsp. pekinensis | AT002234 Flower bud cDNA Br |
| 157 | G779 | BH775806 | 8.00E−36 | Zeamays | fzmb011f08c05f1 fzmb filtered library Zea mays ge |
| 157 | G779 | CA783614 | 3.00E−32 | Glycine max | sat50g04.y1 Gm-c1056 Glycine max cDNA clone SOY |
| 157 | G779 | BH650724 | 2.00E−30 | Brassica oleracea | BOMIW43TR BO_2_3_KB Brassica oleracea gen |
| 157 | G779 | BE451174 | 6.00E−28 | Lycopersicon esculentum | EST402062 tomato root, plants pre-a |
| 157 | G779 | AP004693 | 6.00E−28 | Oryza sativa | chromosome 8 clone P0461F06, *** SEQUENCING IN |
| 157 | G779 | BF263465 | 4.00E−23 | Hordeum vulgare | HV_CEa0006N02f Hordeum vulgare seedling gre |
| 157 | G779 | BG557011 | 3.00E−21 | Sorghum bicolor | EM1_41_E02.g1_A002 Embryo 1 (EM1) Sorghum b |
| 157 | G779 | gi19571105 | 8.40E−28 | Oryza sativa (japonica cultivar-group) | hypothetical prote |
| 157 | G779 | gi15528743 | 9.10E−26 | Oryza sativa | contains EST C74560(E31855)~unknown protein. |
| 157 | G779 | gi1086534 | 1.90E−07 | Oryza officinalis | transcriptional activator Ra homolog. |
| 157 | G779 | gi1086536 | 4.40E−07 | Oryza rufipogon | transcriptional activator Ra homolog. |
| 157 | G779 | gi527665 | 5.70E−07 | Sorghum bicolor | myc-like regulatory R gene product. |
| 157 | G779 | gi1086526 | 9.80E−07 | Oryza australiensis | transcriptional activator Ra homolog. |
| 157 | G779 | gi1086530 | 1.30E−06 | Oryza longistaminata | transcriptional activator Ra homolog |
| 157 | G779 | gi527661 | 1.70E−06 | Phyllostachys acuta | myc-like regulatory R gene product. |
| 157 | G779 | gi3127045 | 2.20E−06 | Petunia x hybrida | bHLH transcription factor JAF13. |
| 157 | G779 | gi527655 | 2.90E−06 | Pennisetum glaucum | myc-like regulatory R gene product. |
| 159 | G789 | BU866069 | 9.00E−47 | Populus tremula x Populus tremuloides | S062C11 Populus imbib |
| 159 | G789 | BG591063 | 4.00E−40 | Solanum tuberosum | EST498905 P. infestans-challenged leaf So |
| 159 | G789 | BH593748 | 7.00E−36 | Brassica oleracea | BOGES09TR BOGE Brassica oleracea genomic |
| 159 | G789 | BM411362 | 2.00E−35 | Lycopersicon esculentum | EST585689 tomato breaker fruit Lyco |
| 159 | G789 | BF518953 | 2.00E−34 | Medicago truncatula | EST456346 DSIL Medicago truncatula cDNA |
| 159 | G789 | BG041496 | 6.00E−34 | Glycine max | sv35a08.y1 Gm-c1057 Glycine max cDNA clone GENO |
| 159 | G789 | BE598711 | 6.00E−30 | Sorghum bicolor | PI1_81_D03.b1_A002 Pathogen induced 1 (PI1) |
| 159 | G789 | BU574318 | 6.00E−30 | Prunus dulcis | PA_Ea0007A10f Almond developing seed Prunus |
| 159 | G789 | CA008614 | 6.00E−30 | Hordeum vulgare subsp. vulgare | HU11I14r HU Hordeum vulgare |
| 159 | G789 | BG052163 | 3.00E−28 | Sorghum propinquum | RHIZ2_6_H10.b1_A003 Rhizome2 (RHIZ2) Sor |
| 159 | G789 | gi23495742 | 5.00E−37 | Oryza sativa (japonica cultivar-group) | putative phytochro |
| 159 | G789 | gi12957703 | 5.90E−26 | Oryza sativa | putative phytochrome interacting factor. |
| 159 | G789 | gi5923912 | 2.70E−10 | Tulipa gesneriana | bHLH transcription factor GBOF-1. |
| 159 | G789 | gi1086538 | 6.70E−09 | Oryza rufipogon | transcriptional activator Rb homolog. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 159 | G789 | gi527657 | 1.80E−08 | Pennisetum glaucum | myc-like regulatory R gene product. |
| 159 | G789 | gi527665 | 6.30E−08 | Sorghum bicolor | myc-like regulatory R gene product. |
| 159 | G789 | gi527661 | 1.00E−07 | Phyllostachys acuta | myc-like regulatory R gene product. |
| 159 | G789 | gi13346180 | 2.30E−07 | Gossypium hirsutum | GHDEL61. |
| 159 | G789 | gi4206118 | 2.70E−07 | Mesembryanthemum crystallinum | transporter homolog. |
| 159 | G789 | gi527663 | 2.80E−07 | Tripsacum australe | myc-like regulatory R gene product. |
| 161 | G801 | BH690524 | 1.00E−100 | Brassica oleracea | BOMFD23TR BO_2_3_KB Brassica oleracea gen |
| 161 | G801 | BQ401569 | 2.00E−59 | Gossypium arboreum | GA_Ed0005G12f Gossypium arboreum 7-10 d |
| 161 | G801 | AF411807 | 2.00E−59 | Lycopersicon esculentum | BAC clone Clemson_Id 127E11, comple |
| 161 | G801 | BG647366 | 2.00E−56 | Medicago truncatula | EST508985 HOGA Medicago truncatula cDNA |
| 161 | G801 | AP004776 | 6.00E−55 | Oryza sativa (japonica cultivar-group) | ( ) chromosome 2 clo |
| 161 | G801 | BQ741451 | 4.00E−48 | Glycine max | saq18fl0.y1 Gm-c1045 Glycine max cDNA clone SOY |
| 161 | G801 | BE344238 | 5.00E−48 | Solanum tuberosum | EST409400 potato stolon, Cornell Universi |
| 161 | G801 | BQ791490 | 2.00E−38 | Brassica rapa subsp. pekinensis | E4414 Chinese cabbage etiol |
| 161 | G801 | AC114983 | 2.00E−37 | Oryza sativa | chromosome 3 clone OSJNBa0032H19, *** SEQUENCI |
| 161 | G801 | BF717245 | 4.00E−37 | Prunus persica | Lf583 near-ripe peach fruit cDNA library Pru |
| 161 | G801 | gi20975251 | 2.40E−33 | Oryza sativa (japonica cultivar-group) | transcription fact |
| 161 | G801 | gi5731257 | 1.30E−30 | Gossypium hirsutum | auxin-induced basic helix-loop-helix t |
| 161 | G801 | gi2580440 | 5.80E−27 | Oryza sativa | PCF2. |
| 161 | G801 | gi13649864 | 3.00E−06 | Capillipedium parviflorum | teosinte branched1 protein. |
| 161 | G801 | gi13649873 | 3.00E−06 | Bothriochloa odorata | teosinte branched1 protein. |
| 161 | G801 | gi21624275 | 6.20E−06 | Pueraria montana var. lobata | PlCYC1. |
| 161 | G801 | gi6358622 | 3.70E−05 | Digitalis purpurea | cyc4 protein. |
| 161 | G801 | gi6358625 | 3.70E−05 | Misopates orontium | cyc4 protein. |
| 161 | G801 | gi21624285 | 6.70E−05 | Sophora flavescens | SfCYC2. |
| 161 | G801 | gi6358621 | 6.90E−05 | Antirrhinum majus subsp. cirrhigerum | cyc4 protein. |
| 163 | G849 | CRO251686 | 1.00E−126 | Catharanthus roseus | mRNA for MYB-like DNA-binding protein |
| 163 | G849 | AF543195 | 1.00E−117 | Nicotiana glutinosa | telomere binding protein TBP1 mRNA, com |
| 163 | G849 | HSBPF1 | 1.00E−111 | Petroselinum crispum | P. crispum BPF-1 mRNA. |
| 163 | G849 | ZMIBP2 | 7.00E−89 | Zea mays | Z. mays IBP2 mRNA for initiator-binding protein. |
| 163 | G849 | CA815602 | 8.00E−69 | Vitis vinifera | CA12EI204IIF_C11 Cabernet Sauvignon Leaf-C |
| 163 | G849 | BM359662 | 6.00E−68 | Gossypium arboreum | GA_Ea0022I07r Gossypium arboreum 7-10 d |
| 163 | G849 | AF242298 | 3.00E−66 | Oryza sativa | telomere binding protein-1 mRNA, complete cds. |
| 163 | G849 | BU816704 | 5.00E−65 | Populus tremula x Populus tremuloides | N070D06 Populus bark |
| 163 | G849 | BH443698 | 2.00E−57 | Brassica oleracea | BOGWU55TF BOGW Brassica oleracea genomic |
| 163 | G849 | BE432238 | 5.00E−52 | Lycopersicon esculentum | EST398767 tomato breaker fruit, TIG |
| 163 | G849 | gi12043533 | 7.30E−129 | Catharanthus roseus | MYB-like DNA-binding protein. |
| 163 | G849 | gi23664357 | 3.10E−118 | Nicotiana glutinosa | telomere binding protein TBP1. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 163 | G849 | gi2129918 | 1.60E−100 | Petroselinum crispum | BPF-1 protein-parsley. |
| 163 | G849 | gi1076813 | 2.60E−93 | Zea mays | initiator-binding protein-maize. |
| 163 | G849 | gi9716453 | 4.20E−71 | Oryza sativa | telomere binding protein-1; TBP1. |
| 163 | G849 | gi20804653 | 0.46 | Oryza sativa (japonica cultivar-group) | histone H1-like pr |
| 163 | G849 | gi15148918 | 0.85 | Phaseolus vulgaris | homeodomain leucine zipper protein HDZ |
| 163 | G849 | gi126240 | 0.93 | Sesbania rostrata | Leghemoglobin 2 (Srglb2). |
| 163 | G849 | gi15723363 | 0.97 | Musa acuminata | calmodulin-like protein. |
| 163 | G849 | gi19073328 | 1 | Sorghum bicolor | typical P-type R2R3 Myb protein. |
| 165 | G859 | AY036888 | 4.00E−55 | Brassica napus | MADS-box protein (FLC1) mRNA, complete cds. |
| 165 | G859 | BG544805 | 3.00E−37 | Brassica rapa subsp. pekinensis | E2809 Chinese cabbage etiol |
| 165 | G859 | BM436799 | 4.00E−36 | Vitis vinifera | VVA010B05_53181 An expressed sequence tag da |
| 165 | G859 | BG596731 | 7.00E−36 | Solanum tuberosum | EST495409 cSTS Solanum tuberosum cDNA clo |
| 165 | G859 | AW219962 | 2.00E−35 | Lycopersicon esculentum | EST302445 tomato root during/after |
| 165 | G859 | BQ994287 | 2.00E−31 | Lactuca sativa | QGF6N05.yg.ab1 QG_EFGHJ lettuce serriola Lac |
| 165 | G859 | BI957545 | 2.00E−30 | Hordeum vulgare | HVSMEn0010B09f Hordeum vulgare rachis EST 1 |
| 165 | G859 | BU875165 | 2.00E−30 | Populus balsamifera subsp. trichocarpa | V003A12 Populus flow |
| 165 | G859 | BJ213269 | 3.00E−30 | Triticum aestivum | BJ213269 Y. Ogihara unpublished cDNA libr |
| 165 | G859 | MDU78949 | 8.00E−30 | Malus x domestica | Malus domestica MADS-box protein 3 mRNA, |
| 165 | G859 | gi17933450 | 2.70E−54 | Brassica napus | MADS-box protein. |
| 165 | G859 | gi5777904 | 9.90E−32 | Malus x domestica | MADS-box protein 3. |
| 165 | G859 | gi3646324 | 1.60E−31 | Malus domestica | MADS-box protein. |
| 165 | G859 | gi9367313 | 2.60E−31 | Hordeum vulgare | MADS-box protein 8. |
| 165 | G859 | gi6467974 | 5.50E−31 | Dendrobium grex Madame Thong-In | MADS box protein DOMADS2. |
| 165 | G859 | gi12002141 | 2.40E−30 | Zea mays | MADS box protein 3. |
| 165 | G859 | gi13446154 | 2.40E−30 | Pisum sativum | MADS-box transcription factor. |
| 165 | G859 | gi4204234 | 2.40E−30 | Lolium temulentum | MADS-box protein 2. |
| 165 | G859 | gi6651033 | 2.40E−30 | Capsicum annuum | MADS box transcription factor MADS1. |
| 165 | G859 | gi1483232 | 4.90E−30 | Betula pendula | MADS5 protein. |
| 167 | G864 | BH472654 | 1.00E−105 | Brassica oleracea | BOHPF07TF BOHP Brassica oleracea genomic |
| 167 | G864 | AP004902 | 2.00E−44 | Lotus japonicus | genomic DNA, chromosome 2, clone: LjT04G24, |
| 167 | G864 | BM886518 | 5.00E−40 | Glycine max | sam17f08.y1 Gm-c1068 Glycine max cDNA clone SOY |
| 167 | G864 | AW685524 | 5.00E−39 | Medicago truncatula | NF031C12NR1F1000 Nodulated root Medicag |
| 167 | G864 | AP001800 | 6.00E−36 | Oryza sativa | genomic DNA, chromosome 1, PAC clone: P0443E05. |
| 167 | G864 | LEU89257 | 6.00E−32 | Lycopersicon esculentum | DNA-binding protein Pti6 mRNA, comp |
| 167 | G864 | AAAA01000263 | 7.00E−31 | Oryza sativa (indica cultivar-group) | ( ) scaffold000263 |
| 167 | G864 | BQ873772 | 8.00E−30 | Lactuca sativa | QGI2I03.yg.ab1 QG_ABCDI lettuce salinas Lact |
| 167 | G864 | AF058827 | 7.00E−29 | Nicotiana tabacum | TSI1 (Tsi1) mRNA, complete cds. |
| 167 | G864 | BZ419846 | 3.00E−25 | Zea mays | if61a07.b1 WGS-ZmaysF (DH5a methyl filtered) Zea m |
| 167 | G864 | gi8096469 | 1.60E−38 | Oryza sativa | Similar to Arabidopsis thaliana chromosome 4 |
| 167 | G864 | gi2213785 | 1.00E−34 | Lycopersicon esculentum | Pti6. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 167 | G864 | gi23617235 | 3.70E−25 | Oryza sativa (japonica cultivar-group) | contains ESTs AU16 |
| 167 | G864 | gi3065895 | 7.60E−25 | Nicotiana tabacum | TSI1. |
| 167 | G864 | gi3264767 | 1.90E−21 | Prunus armeniaca | AP2 domain containing protein. |
| 167 | G864 | gi8571476 | 4.30E−21 | Atriplex hortensis | apetala2 domain-containing protein. |
| 167 | G864 | gi17385636 | 2.80E−20 | Matricaria chamomilla | ethylene-responsive element binding |
| 167 | G864 | gi8809571 | 4.50E−20 | Nicotiana sylvestris | ethylene-responsive element binding |
| 167 | G864 | gi7528276 | 5.70E−20 | Mesembryanthemum crystallinum | AP2-related transcription f |
| 167 | G864 | gi21908036 | 9.30E−20 | Zea mays | DRE binding factor 1. |
| 169 | G867 | BQ971511 | 2.00E−94 | Helianthus annuus | QHB7E05.yg.ab1 QH_ABCDI sunflower RHA801 |
| 169 | G867 | AP003450 | 6.00E−85 | Oryza sativa | chromosome 1 clone P0034C09, *** SEQUENCING IN |
| 169 | G867 | AC135925 | 1.00E−80 | Oryza sativa (japonica cultivar-group) | ( ) chromosome 5 clo |
| 169 | G867 | AAAA01000997 | 1.00E−79 | Oryza sativa (indica cultivar-group) | ( ) scaffold000997 |
| 169 | G867 | BQ405698 | 2.00E−77 | Gossypium arboreum | GA_Ed0085H02f Gossypium arboreum 7-10 d |
| 169 | G867 | BZ015521 | 4.00E−69 | Brassica oleracea | oeg86a05.g1 B. oleracea002 Brassica olerac |
| 169 | G867 | BF520598 | 2.00E−66 | Medicago truncatula | EST458071 DSIL Medicago truncatula cDNA |
| 169 | G867 | BU994579 | 4.00E−64 | Hordeum vulgare subsp. vulgare | HM07I08r HM Hordeum vulgare |
| 169 | G867 | BF424857 | 2.00E−62 | Glycine max | su59h03.y1 Gm-c1069 Glycine max cDNA clone GENO |
| 169 | G867 | BU871082 | 1.00E−61 | Populus balsamifera subsp. trichocarpa | Q026F06 Populus flow |
| 169 | G867 | gi18565433 | 2.40E−85 | Oryza sativa (japonica cultivar-group) | DNA-binding protei |
| 169 | G867 | gi12328560 | 2.90E−73 | Oryza sativa | putative DNA binding protein RAV2. |
| 169 | G867 | gi10798644 | 7.30E−13 | Nicotiana tabacum | AP2 domain-containing transcription fac |
| 169 | G867 | gi18266198 | 2.50E−10 | Narcissus pseudonarcissus | AP-2 domain containing protein. |
| 169 | G867 | gi20340233 | 2.50E−10 | Thellungiella halophila | ethylene responsive element bindi |
| 169 | G867 | gi22074046 | 1.50E−09 | Lycopersicon esculentum | transcription factor JERF1. |
| 169 | G867 | gi3264767 | 6.90E−09 | Prunus armeniaca | AP2 domain containing protein. |
| 169 | G867 | gi18496063 | 7.10E−09 | Fagus sylvatica | ethylene responsive element binding prote |
| 169 | G867 | gi13173164 | 8.30E−09 | Pisum sativum | APETAL2-like protein. |
| 169 | G867 | gi1730475 | 8.70E−09 | Hordeum vulgare | viviparous-1. |
| 171 | G869 | BH591758 | 7.00E−65 | Brassica oleracea | BOHET60TR BOHE Brassica oleracea genomic |
| 171 | G869 | BQ791746 | 1.00E−25 | Brassica rapa subsp. pekinensis | E3454 Chinese cabbage etiol |
| 171 | G869 | BF279235 | 2.00E−24 | Gossypium arboreum | GA_Eb0037N14f Gossypium arboreum 7-10 d |
| 171 | G869 | AAAA01006972 | 2.00E−20 | Oryza sativa (indica cultivar-group) | ( ) scaffold006972 |
| 171 | G869 | AP005687 | 2.00E−20 | Oryza sativa (japonica cultivar-group) | ( ) chromosome 9 Clo |
| 171 | G869 | BQ483158 | 9.00E−20 | Triticum aestivum | WHE3505_C09_E17ZS Wheat unstressed root c |
| 171 | G869 | BQ591872 | 2.00E−19 | Beta vulgaris | E012583-024-016-N20-SP6 MPIZ-ADIS-024-storage |
| 171 | G869 | BM731589 | 6.00E−19 | Glycine max | sal81f11.y1 Gm-c1063 Glycine max cDNA clone SOY |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 171 | G869 | LEU89257 | 2.00E−18 | *Lycopersicon esculentum* | DNA-binding protein Pti6 mRNA, comp |
| 171 | G869 | AP002526 | 6.00E−18 | *Oryza sativa* | genomic DNA, chromosome 1, PAC clone: P0504H10. Pti6. |
| 171 | G869 | gi2213785 | 3.40E−22 | *Lycopersicon esculentum* | |
| 171 | G869 | gi9049421 | 3.10E−21 | *Oryza sativa* | ESTs AU093391(E60370), AU091593 (C60458), AU09 |
| 171 | G869 | gi3065895 | 3.90E−21 | *Nicotiana tabacum* | TSI1. |
| 171 | G869 | gi21908036 | 5.00E−16 | *Zea mays* | DRE binding factor 1. |
| 171 | G869 | gi8571476 | 1.00E−15 | *Atriplex hortensis* | apetala2 domain-containing protein. |
| 171 | G869 | gi18496063 | 2.60E−15 | *Fagus sylvatica* | ethylene responsive element binding prote |
| 171 | G869 | gi20340233 | 1.60E−14 | *Thellungiella halophila* | ethylene responsive element bindi |
| 171 | G869 | gi20160854 | 1.90E−14 | *Oryza sativa (japonica cultivar-group)* | hypothetical prote |
| 171 | G869 | gi4099914 | 2.00E−14 | *Stylosanthes hamata* | ethylene-responsive element binding p |
| 171 | G869 | gi8809573 | 2.00E−14 | *Nicotiana sylvestris* | ethylene-responsive element binding |
| 173 | G877 | LES303343 | 1.00E−172 | *Lycopersicon esculentum* | mRNA for hypothetical protein (ORF |
| 173 | G877 | AB063576 | 1.00E−168 | *Nicotiana tabacum* | NtWRKY-9 mRNA for WRKY DNA-binding protei |
| 173 | G877 | IPBSPF1P | 4.00E−83 | *Ipomoea batatas* | Sweet potato mRNA for SPF1 protein, complet |
| 173 | G877 | AX192164 | 1.00E−81 | *Triticum aestivum* | Sequence 11 from Patent WO0149840. |
| 173 | G877 | BZ061564 | 2.00E−79 | *Brassica oleracea* | 11f03c03.b1 *B. oleracea*002 *Brassica olerac* |
| 173 | G877 | AX192162 | 1.00E−78 | *Glycine max* | Sequence 9 from Patent WO0149840. |
| 173 | G877 | AF439274 | 2.00E−75 | *Retama raetam* | WRKY-like drought-induced protein (WRK) mRNA, |
| 173 | G877 | AF459793 | 2.00E−75 | *Oryza sativa (indica cultivar-group)* | ( ) WRKY transcription |
| 173 | G877 | OSJN00012 | 7.00E−75 | *Oryza sativa* | chromosome 4 clone OSJNBa0089K21, *** SEQUENC |
| 173 | G877 | PCU48831 | 2.00E−71 | *Petroselinum crispum* | DNA-binding protein WRKY1 mRNA, comple |
| 173 | G877 | gi13620227 | 2.80E−165 | *Lycopersicon esculentum* | hypothetical protein. |
| 173 | G877 | gi14530687 | 4.00E−122 | *Nicotiana tabacum* | WRKY DNA-binding protein. |
| 173 | G877 | gi4894965 | 3.30E−72 | *Avena sativa* | DNA-binding protein WRKY1. |
| 173 | G877 | gi7484759 | 4.10E−71 | *Cucumis sativus* | SP8 binding protein homolog-cucumber. |
| 173 | G877 | gi23305051 | 3.70E−70 | *Oryza sativa (indica cultivar-group)* | WRKY transcription f |
| 173 | G877 | gi1159877 | 1.40E−69 | *Avena fatua* | DNA-binding protein. |
| 173 | G877 | gi1076685 | 7.40E−57 | *Ipomoea batatas* | SPF1 protein-sweet potato. |
| 173 | G877 | gi13236649 | 4.10E−53 | *Oryza sativa* | putative DNA-binding protein. |
| 173 | G877 | gi16588566 | 1.20E−50 | *Solanum dulcamara* | thermal hysteresis protein STHP-64. |
| 173 | G877 | gi18158619 | 2.10E−50 | *Retama raetam* | WRKY-like drought-induced protein. |
| 175 | G881 | AB028022 | 4.00E−58 | *Nicotiana tabacum* | wizz mRNA, complete cds. |
| 175 | G881 | AF204925 | 4.00E−58 | *Petroselinum crispum* | transcription factor WRKY4 (WRKY4) mRN |
| 175 | G881 | BG582712 | 6.00E−55 | *Medicago truncatula* | EST484458 GVN *Medicago truncatula* cDNA |
| 175 | G881 | BI935985 | 8.00E−49 | *Lycopersicon esculentum* | EST555874 tomato flower, anthesis L |
| 175 | G881 | BG543269 | 4.00E−47 | *Brassica rapa* subsp. *pekinensis* | E0763 Chinese cabbage etiol |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 175 | G881 | BM520933 | 1.00E−46 | Glycine max | sal32c10.y1 Gm-c1059 Glycine max cDNA clone SOY |
| 175 | G881 | BM404915 | 4.00E−45 | Solanum tuberosum | EST579242 potato roots Solanum tuberosum |
| 175 | G881 | BU812081 | 1.00E−44 | Populus tremula x Populus tremuloides | UL92TA06 Populus leaf |
| 175 | G881 | AW561928 | 5.00E−42 | Gossypium hirsutum | IPPGHZ0017 Cotton fiber and embryo Lambd |
| 175 | G881 | BG525752 | 5.00E−42 | Stevia rebaudiana | 49-34 Stevia field grown leaf cDNA Stevia |
| 175 | G881 | gi6472585 | 1.10E−60 | Nicotiana tabacum | WIZZ. |
| 175 | G881 | gi11493822 | 3.30E−59 | Petroselinum crispum | transcription factor WRKY4. |
| 175 | G881 | gi1159879 | 7.60E−44 | Avena fatua | DNA-binding protein. |
| 175 | G881 | gi5042446 | 1.40E−31 | Oryza sativa | putative WRKY DNA binding protein. |
| 175 | G881 | gi20160973 | 3.80E−24 | Oryza sativa (japonica cultivar-group) | hypothetical prote |
| 175 | G881 | gi18158619 | 1.70E−21 | Retama raetam | WRKY-like drought-induced protein. |
| 175 | G881 | gi13620227 | 3.50E−16 | Lycopersicon esculentum | hypothetical protein. |
| 175 | G881 | gi1076685 | 4.50E−15 | Ipomoea batatas | SPF1 protein-sweet potato. |
| 175 | G881 | gi23305051 | 6.10E−15 | Oryza sativa (indica cultivar-group) | WRKY transcription f |
| 175 | G881 | gi3420906 | 6.70E−15 | Pimpinella brachycarpa | zinc finger protein; WRKY1. |
| 177 | G892 | AP004125 | 8.00E−38 | Oryza sativa | chromosome 2 clone OJ1767_D02, *** SEQUENCING |
| 177 | G892 | AAAA01003485 | 7.00E−37 | Oryza sativa (indica cultivar-group) | ( ) scaffold003485 |
| 177 | G892 | AP004687 | 7.00E−37 | Oryza sativa (japonica cultivar-group) | ( ) chromosome 6 clo |
| 177 | G892 | BH494985 | 3.00E−36 | Brassica oleracea | BOHQZ69TR BOHQ Brassica oleracea genomic |
| 177 | G892 | AC135799 | 4.00E−33 | Medicago truncatula | clone mth2-11f14, WORKING DRAFT SEQUENC |
| 177 | G892 | BE515999 | 3.00E−31 | Triticum aestivum | WHE0607_F08_L15ZA Wheat ABA-treated embry |
| 177 | G892 | BE598018 | 2.00E−30 | Sorghum bicolor | PI1_68_F02.g1_A002 Pathogen induced 1 (PI1) |
| 177 | G892 | AF411807 | 6.00E−30 | Lycopersicon esculentum | BAC clone Clemson_Id 127E11, comple |
| 177 | G892 | BQ163187 | 8.00E−30 | Zea mays | 952045H12.y2 952-BMS tissue from Walbot Lab (red |
| 177 | G892 | AV837063 | 8.00E−30 | Hordeum vulgare subsp. vulgare | AV837063 K. Sato unpublished |
| 177 | G892 | gi18087865 | 2.10E−34 | Oryza sativa | putative zinc finger protein. |
| 177 | G892 | gi19571000 | 3.10E−32 | Oryza sativa (japonica cultivar-group) | hypothetical prote |
| 177 | G892 | gi4651204 | 8.10E−17 | Cicer arietinum | ring finger protein. |
| 177 | G892 | gi23386073 | 3.00E−15 | Tulipa gesneriana | unnamed protein product. |
| 177 | G892 | gi22597166 | 2.40E−08 | Glycine max | RING-H2 finger protein. |
| 177 | G892 | gi20340241 | 9.80E−08 | Thellungiella halophila | putative RING zinc finger protein |
| 177 | G892 | gi2894379 | 4.30E−06 | Hordeum vulgare | ring finger protein. |
| 177 | G892 | gi12003386 | 6.60E−06 | Nicotiana tabacum | Avr9/Cf-9 rapidly elicited protein 132. |
| 177 | G892 | gi18092342 | 1.00E−05 | Zea mays | ring-H2 zinc finger protein. |
| 177 | G892 | gi6650528 | 1.30E−05 | Oryza sativa subsp. japonica | putative transcription facto |
| 179 | G896 | BE412616 | 1.00E−116 | Hordeum vulgare | MCG002.A02R990625 ITEC MCG Barley Leaf/Culm |
| 179 | G896 | BQ863573 | 1.00E−104 | Lactuca sativa | QGC24E01.yg.ab1 QG_ABCDI lettuce salinas Lac |
| 179 | G896 | BQ970528 | 1.00E−101 | Helianthus annuus | QHB42F12.yg.ab1 QH_ABCDI sunflower RHA801 |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 179 | G896 | AW255156 | 4.00E−93 | Mentha x piperita | ML1467 peppermint glandular trichome Ment |
| 179 | G896 | BG445951 | 2.00E−88 | Gossypium arboreum | GA_Ea0030C19f Gossypium arboreum 7-10 d |
| 179 | G896 | BQ740879 | 5.00E−86 | Glycine max | sap88e03.y1 Gm-c1045 Glycine max cDNA clone SOY |
| 179 | G896 | AW030182 | 2.00E−83 | Lycopersicon esculentum | EST273437 tomato callus, TAMU Lycop |
| 179 | G896 | BG241113 | 8.00E−82 | Sorghum bicolor | OV1_38_D04.b1_A002 Ovary 1 (OV1) Sorghum bi |
| 179 | G896 | AI727328 | 1.00E−79 | Gossypium hirsutum | BNLGHi7759 Six-day Cotton fiber Gossypiu |
| 179 | G896 | AAAA01012924 | 6.00E−77 | Oryza sativa (indica cultivar-group) | ( ) scaffold012924 |
| 179 | G896 | gi12597889 | 1.10E−128 | Oryza sativa | hypothetical protein. |
| 179 | G896 | gi4235430 | 2.80E−30 | Hevea brasiliensis | latex-abundant protein. |
| 179 | G896 | gi20804732 | 5.40E−28 | Oryza sativa (japonica cultivar-group) | putative latex-abu |
| 179 | G896 | gi23343885 | 4.20E−26 | Lycopersicon esculentum | metacaspase 1. |
| 179 | G896 | gi17981380 | 2.30E−06 | Brassica oleracea | zinc finger protein LSD2. |
| 179 | G896 | gi13509837 | 5.20E−06 | Zea mays | unnamed protein product. |
| 179 | G896 | gi21992 | 0.0076 | Volvox carteri | extensin. |
| 179 | G896 | gi2108256 | 0.011 | Bromheadia finlaysoniana | extensin. |
| 179 | G896 | gi1076211 | 0.074 | Chlamydomonas reinhardtii | hypothetical protein VSP-3-Ch |
| 179 | G896 | gi1903264 | 0.11 | Pisum sativum | hypothetical protein. |
| 181 | G910 | BZ003194 | 2.00E−57 | Brassica oleracea | oef80b08.g1 B. oleracea002 Brassica olerac |
| 181 | G910 | BQ865099 | 1.00E−32 | Lactuca sativa | QGC28L18.yg.ab1 QG_ABCDI lettuce salinas Lac |
| 181 | G910 | AB001888 | 2.00E−29 | Oryza sativa | mRNA for zinc finger protein, complete cds, |
| 181 | G910 | BU578283 | 1.00E−27 | Glycine max | sar50h06.y1 Gm-c1074 Glycine max cDNA clone SOY |
| 181 | G910 | AP005113 | 2.00E−25 | Oryza sativa (japonica cultivar-group) | ( ) chromosome 2 clo |
| 181 | G910 | BE558327 | 4.00E−25 | Hordeum vulgare | HV_CEb0017D19f Hordeum vulgare seedling gre |
| 181 | G910 | BJ209915 | 4.00E−25 | Triticum aestivum | BJ209915 Y. Ogihara unpublished cDNA libr |
| 181 | G910 | BU044949 | 5.00E−25 | Prunus persica | PP_LEa0021A05f Peach developing fruit mesoca |
| 181 | G910 | AAAA01003074 | 5.00E−25 | Oryza sativa (indica cultivar-group) | ( ) scaffold003074 |
| 181 | G910 | BQ121038 | 3.00E−24 | Solanum tuberosum | EST606614 mixed potato tissues Solanum tu |
| 181 | G910 | gi3618320 | 1.30E−39 | Oryza sativa | zinc finger protein. |
| 181 | G910 | gi22854986 | 2.30E−14 | Brassica nigra | COL1 protein. |
| 181 | G910 | gi23495871 | 5.60E−14 | Oryza sativa (japonica cultivar-group) | putative zinc-fing |
| 181 | G910 | gi10946337 | 1.20E−12 | Ipomoea nil | CONSTANS-like protein. |
| 181 | G910 | gi3341723 | 2.20E−12 | Raphanus sativus | CONSTANS-like 1 protein. |
| 181 | G910 | gi21667475 | 1.10E−11 | Hordeum vulgare | CONSTANS-like protein. |
| 181 | G910 | gi4091804 | 1.20E−11 | Malus x domestica | CONSTANS-like protein 1. |
| 181 | G910 | gi4557093 | 4.50E−11 | Pinus radiata | zinc finger protein. |
| 181 | G910 | gi2303681 | 6.30E−11 | Brassica napus | unnamed protein product. |
| 181 | G910 | gi21655160 | 2.80E−06 | Hordeum vulgare subsp. vulgare | CONSTANS-like protein CO6. |
| 183 | G911 | AI352907 | 1.00E−50 | Brassica napus | MB73-1H PZ204.BNlib Brassica napus cDNA clon |
| 183 | G911 | BG543052 | 7.00E−28 | Brassica rapa subsp. pekinensis | E0523 Chinese cabbage etiol |
| 183 | G911 | BQ849490 | 4.00E−24 | Lactuca sativa | QGB10A17.yg.ab1 QG_ABCDI lettuce salinas Lac |
| 183 | G911 | BU891914 | 1.00E−23 | Populus tremula | P057A07 Populus petioles cDNA library Popul |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 183 | G911 | BU885427 | 1.00E−23 | Populus tremula x Populus tremuloides | R031B05 Populus root |
| 183 | G911 | AW034559 | 3.00E−23 | Lycopersicon esculentum | EST278175 tomato callus, TAMU Lycop |
| 183 | G911 | BZ013045 | 1.00E−22 | Brassica oleracea | oek67d06.b1 B. oleracea002 Brassica olerac |
| 183 | G911 | BG269593 | 3.00E−22 | Mesembryanthemum crystallinum | L0-3678T3 Ice plant Lambda Un |
| 183 | G911 | AI729600 | 7.00E−22 | Gossypium hirsutum | BNLGHi13753 Six-day Cotton fiber Gossypi |
| 183 | G911 | BG726313 | 2.00E−21 | Glycine max | sae08f02.y1 Gm-c1055 Glycine max cDNA clone GEN |
| 183 | G911 | gi20805085 | 7.20E−13 | Oryza sativa (japonica cultivar-group) | hypothetical prote |
| 183 | G911 | gi14164467 | 1.20E−12 | Oryza sativa | hypothetical protein. |
| 183 | G911 | gi20340241 | 5.10E−12 | Thellungiella halophila | putative RING zinc finger protein |
| 183 | G911 | gi20152976 | 1.70E−11 | Hordeum vulgare subsp. vulgare | similar to A. thaliana C3H |
| 183 | G911 | gi17016985 | 5.80E−11 | Cucumis melo | RING-H2 zinc finger protein. |
| 183 | G911 | gi23451086 | 7.60E−11 | Medicago sativa | RING-H2 protein. |
| 183 | G911 | gi18092342 | 1.40E−09 | Zea mays | ring-H2 zinc finger protein. |
| 183 | G911 | gi12003386 | 6.80E−09 | Nicotiana tabacum | Avr9/Cf-9 rapidly elicited porotein 132. |
| 183 | G911 | gi1086225 | 7.00E−09 | Lotus japonicus | RING-finger protein-Lotus japonicus. |
| 183 | G911 | gi2894379 | 2.20E−08 | Hordeum vulgare | ring finger protein. |
| 185 | G912 | BH498662 | 2.00E−93 | Brassica oleracea | BOGTO66TR BOGT Brassica oleracea genomic |
| 185 | G912 | AF084185 | 2.00E−75 | Brassica napus | dehydration responsive element binding prote |
| 185 | G912 | AF211531 | 1.00E−59 | Nicotiana tabacum | Avr9/Cf-9 rapidly elicited protein 111B |
| 185 | G912 | AY034473 | 1.00E−55 | Lycopersicon esculentum | putative transcriptional activator |
| 185 | G912 | BG321601 | 4.00E−53 | Descurainia sophia | Ds01_01h03_R Ds01_AAFC_ECORC_cold_stress |
| 185 | G912 | AB080965 | 9.00E−53 | Prunus avium | DREB1-like gene for dehydratiion responsive el |
| 185 | G912 | BG590659 | 4.00E−51 | Solanum tuberosum | EST498501 P. infestans-challenged leaf So |
| 185 | G912 | BG644969 | 1.00E−50 | Medicago truncatula | EST506588 KV3 Medicago truncatula cDNA |
| 185 | G912 | BU016783 | 2.00E−49 | Helianthus annuus | QHE14A02.yg.ab1 QH_EFGHJ sunflower RHA280 |
| 185 | G912 | BU871514 | 1.00E−47 | Populus balsamifera subsp. trichocarpa | Q031D09 Populus flow |
| 185 | G912 | gi5616086 | 5.90E−73 | Brassica napus | dehydration responsive element binding pro |
| 185 | G912 | gi12003384 | 5.20E−58 | Nicotiana tabacum | Avr9/Cf-9 rapidly elicited protein 111B |
| 185 | G912 | gi23495458 | 3.90E−53 | Prunus avium | dehydratiion responsive element binding prot |
| 185 | G912 | gi18535580 | 2.00E−49 | Lycopersicon esculentum | putative transcriptional activato |
| 185 | G912 | gi19071243 | 1.30E−45 | Hordeum vulgare | CRT/DRE binding factor 1. |
| 185 | G912 | gi24474328 | 8.20E−44 | Oryza sativa (japonica cultivar-group) | apetala2 domain-co |
| 185 | G912 | gi6983877 | 9.00E−38 | Oryza sativa | Similar to mRNA for DREB1A (AB007787). |
| 185 | G912 | gi17148651 | 3.90E−35 | Secale cereale | CBF-like protein. |
| 185 | G912 | gi20152903 | 1.40E−32 | Hordeum vulgare subsp. vulgare | CRT/DRE binding factor 2. |
| 185 | G912 | gi17226801 | 2.10E−31 | Triticum aestivum | putative CRT/DRE-binding factor. |
| 187 | G913 | AI352878 | 4.00E−87 | Brassica napus | MB72-11D PZ204.BNlib Brassica napus cDNA clo |
| 187 | G913 | BH536782 | 1.00E−59 | Brassica oleracea | BOGCX29TR BOGC Brassica oleracea genomic |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 187 | G913 | AW033835 | 2.00E−46 | *Lycopersicon esculentum* | EST277406 tomato callus, TAMU Lycop |
| 187 | G913 | BQ411166 | 1.00E−43 | *Gossypium arboreum* | GA_Ed0037B05f *Gossypium arboreum* 7-10 d |
| 187 | G913 | BQ165313 | 5.00E−43 | *Medicago truncatula* | EST611182 KVKC *Medicago truncatula* cDNA |
| 187 | G913 | AP006060 | 5.00E−43 | *Oryza sativa (japonica* cultivar-group) | ( ) chromosome 2 clo |
| 187 | G913 | AAAA01000810 | 2.00E−42 | *Oryza sativa (indica* cultivar-group) | ( ) scaffold000810 |
| 187 | G913 | OSJN00128 | 2.00E−38 | *Oryza sativa* | chromosome 4 clone OoSJNBA0088I22, *** SEQUENC |
| 187 | G913 | BQ976989 | 3.00E−31 | *Helianthus annuus* | QHI23I22.yg.ab1 QH_ABCDI sunflower RHA801 |
| 187 | G913 | BQ592028 | 6.00E−30 | *Beta vulgaris* | E012695-024-021-K17-SP6 MPIZ-ADIS-024-develop |
| 187 | G913 | gi14140155 | 1.60E−32 | *Oryza sativa* | putative AP2 domain transcription factor. |
| 187 | G913 | gi12003382 | 1.40E−30 | *Nicotiana tabacum* | Avr9/Cf-9 rapidly elicited protein 111A |
| 187 | G913 | gi20303570 | 1.40E−30 | *Oryza sativa (japonica* cultivar-group) | putative transcrip |
| 187 | G913 | gi18535580 | 3.80E−30 | *Lycopersicon esculentum* | putative transcriptional activato |
| 187 | G913 | gi23495460 | 4.40E−29 | *Prunus avium* | dehydration responsive element binding prote |
| 187 | G913 | gi5616086 | 6.50E−28 | *Brassica napus* | dehydration responsive element binding pro |
| 187 | G913 | gi21908034 | 1.40E−25 | *Zea mays* | DRE binding factor 2. |
| 187 | G913 | gi19071243 | 1.20E−21 | *Hordeum vulgare* | CRT/DRE binding factor 1. |
| 187 | G913 | gi17148649 | 2.30E−17 | *Secale cereale* | CBF-like protein. |
| 187 | G913 | gi8571476 | 2.30E−17 | *Atriplex hortensis* | apetala2 domain-containing protein. |
| 189 | G922 | AP004485 | 1.0e−999 | *Lotus japonicus* | genomic DNA, chromosome 2, clone: LjT08D14, |
| 189 | G922 | AP003259 | 1.00E−130 | *Oryza sativa* | chromosome 1 clone P0466H10, *** SEQUENCING IN |
| 189 | G922 | AAAA01000374 | 1.00E−130 | *Oryza sativa (indica* cultivar-group) | ( ) scaffold000374 |
| 189 | G922 | BH493536 | 1.00E−121 | *Brassica oleracea* | BOGXB10TR BOGX *Brassica oleracea* genomic |
| 189 | G922 | CNS08CCP | 1.00E−92 | *Oryza sativa (japonica* cultivar-group) | ( ) chromosome 12 cl |
| 189 | G922 | BG643567 | 6.00E−82 | *Lycopersicon esculentum* | EST511761 tomato shoot/meristem Lyc |
| 189 | G922 | BQ124898 | 2.00E−81 | *Medicago truncatula* | EST610474 GLSD *Medicago truncatula* cDNA |
| 189 | G922 | BU764181 | 2.00E−71 | *Glycine max* | sas53f07.y1 Gm-c1023 *Glycine max* cDNA clone SOY |
| 189 | G922 | BG595716 | 3.00E−62 | *Solanum tuberosum* | EST494394 cSTS *Solanum tuberosum* cDNA clo |
| 189 | G922 | AF378125 | 6.00E−55 | *Vitis vinifera* | GAI-like protein 1 (GAI1) gene, complete cds |
| 189 | G922 | gi22830925 | 6.30E−127 | *Oryza sativa (japonica* cultivar-group) | putative gibberell |
| 189 | G922 | gi13365610 | 3.00E−57 | *Pisum sativum* | SCARECROW. |
| 189 | G922 | gi13170126 | 5.20E−55 | *Brassica napus* | unnamed protein product. |
| 189 | G922 | gi10178637 | 6.30E−51 | *Zea mays* | SCARECROW. |
| 189 | G922 | gi13937306 | 2.30E−50 | *Oryza sativa* | gibberellin-insensitive protein OsGAI. |
| 189 | G922 | gi18254373 | 9.20E−50 | *Hordeum vulgare* | nuclear transcription factor SLN1. |
| 189 | G922 | gi5640157 | 2.60E−49 | *Triticum aestivum* | gibberellin response modulator. |
| 189 | G922 | gi20257451 | 3.10E−49 | *Calycadenia multiglandulosa* | GIA/RGA-like gibberellin resp |
| 189 | G922 | gi13620224 | 1.30E−46 | *Lycopersicon esculentum* | lateral suppressor. |
| 189 | G922 | gi13620166 | 2.20E−41 | *Capsella rubella* | hypothetical protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 191 | G926 | BU573158 | 1.00E−56 | *Prunus dulcis* | PA_Ea0003A12f Almond developing seed *Prunus* |
| 191 | G926 | BI310587 | 2.00E−55 | *Medicago truncatula* | EST5312337 GESD *Medicago truncatula* cDN |
| 191 | G926 | BQ624240 | 1.00E−47 | *Citrus sinensis* | USDA-FP_01331 Ridge pineapple sweet orange |
| 191 | G926 | BH443554 | 3.00E−44 | *Brassica oleracea* | BOHGN12TR BOHG *Brassica oleracea* genomic |
| 191 | G926 | BNU33884 | 2.00E−39 | *Brassica napus* | clone bncbf-b1 CCAAT-binding factor B subuni |
| 191 | G926 | BF113081 | 8.00E−38 | *Lycopersicon esculentum* | EST440591 tomato breaker fruit Lyco |
| 191 | G926 | BG886494 | 2.00E−36 | *Solanum tuberosum* | EST512345 cSTD *Solanum tuberosum* cDNA clo |
| 191 | G926 | AW472517 | 3.00E−36 | *Glycine max* | si26c12.y1 Gm-r1030 *Glycine max* cDNA clone GENO |
| 191 | G926 | BQ407583 | 6.00E−36 | *Gossypium arboreum* | GA_Ed0108F07f *Gossypium arboreum* 7-10 d |
| 191 | G926 | BG343051 | 7.00E−34 | *Hordeum vulgare* | HVSMEg0001N16f *Hordeum vulgare* pre-anthesis |
| 191 | G926 | gi1173616 | 9.70E−41 | *Brassica napus* | CCAAT-binding factor B subunit homolog. |
| 191 | G926 | gi2826786 | 1.10E−27 | *Oryza sativa* | RAPB protein. |
| 191 | G926 | gi7141243 | 5.80E−27 | *Vitis riparia* | transcription factor. |
| 191 | G926 | gi4731314 | 4.00E−19 | *Nicotiana tabacum* | CCAAT-binding transcription factor subu |
| 191 | G926 | gi2104675 | 0.0061 | *Vicia faba* | transcription factor. |
| 191 | G926 | gi21667471 | 0.64 | *Hordeum vulgare* | CONSTANS-like protein. |
| 191 | G926 | gi13775107 | 0.67 | *Phaseolus vulgaris* | bZIP transcription factor 2. |
| 191 | G926 | gi1096930 | 0.69 | *Solanum tuberosum* | H ATPase inhibitor. |
| 191 | G926 | gi24413952 | 0.72 | *Oryza sativa (japonica cultivar-group)* | putative iron supe |
| 191 | G926 | gi1839593 | 0.78 | *Zea mays* | heat shock protein 70 homolog {clone CHEM 3} [Ze |
| 193 | G961 | BU879250 | 2.00E−81 | *Populus balsamifera* subsp. *trichocarpa* | V057G12 *Populus* flow |
| 193 | G961 | BE060921 | 3.00E−72 | *Hordeum vulgare* | HVSMEg0013N15f *Hordeum vulgare* pre-anthesis |
| 193 | G961 | BF098091 | 3.00E−70 | *Lycopersicon esculentum* | EST428612 tomato nutrient deficient |
| 193 | G961 | BU547985 | 4.00E−69 | *Glycine max* | GM880014A10H12 Gm-r1088 *Glycine max* cDNA clone |
| 193 | G961 | BF645892 | 3.00E−67 | *Medicago truncatula* | NF042G10EC1F1083 Elicited cell culture |
| 193 | G961 | AP002542 | 2.00E−66 | *Oryza sativa* | genomic DNA, chromosome 6, PAC clone: P0679C08. |
| 193 | G961 | AAAA01001925 | 2.00E−66 | *Oryza sativa (indica cultivar-group)* | ( ) scaffold001925 |
| 193 | G961 | AP004562 | 2.00E−64 | *Oryza sativa (japonica cultivar-group)* | ( ) chromosome 8 clo |
| 193 | G961 | BE357920 | 6.00E−62 | *Sorghum bicolor* | DG1_23_F03.b1_A002 Dark Grown 1 (DG1) Sorgh |
| 193 | G961 | BQ483881 | 6.00E−61 | *Triticum aestivum* | WHE3513_F08_K15ZS Wheat unstressed root c |
| 193 | G961 | gi11875152 | 4.00E−83 | *Oryza sativa* | putative NAM (no apical meristem) protein. |
| 193 | G961 | gi24413978 | 2.90E−64 | *Oryza sativa (japonica cultivar-group)* | NAM-like protein. |
| 193 | G961 | gi22597158 | 8.60E−47 | *Glycine max* | no apical meristem-like protein. |
| 193 | G961 | gi15148914 | 1.00E−45 | *Phaseolus vulgaris* | NAC domain protein NAC2. |
| 193 | G961 | gi1279640 | 1.70E−45 | *Petunia* x *hybrida* | NAM. |
| 193 | G961 | gi4218537 | 2.40E−44 | *Triticum* sp. | GRAB2 protein. |
| 193 | G961 | gi6732160 | 2.40E−44 | *Triticum monococcum* | unnamed protein product. |
| 193 | G961 | gi6175246 | 2.30E−41 | *Lycopersicon esculentum* | jasmonic acid 2. |
| 193 | G961 | gi14485513 | 1.00E−36 | *Solanum tuberosum* | putative NAC domain protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 193 | G961 | gi7716952 | 8.40E−35 | Medicago truncatula | NAC1. |
| 195 | G971 | AF132002 | 8.00E−54 | Petunia x hybrida | PHAP2B protein (Ap2B) mRNA, complete cds. |
| 195 | G971 | AF253970 | 6.00E−52 | Picea abies | APETALA2-related transcription factor 1 (AP2L1) |
| 195 | G971 | AF332215 | 6.00E−52 | Malus x domestica | transcription factor AHAP2 (AHAP2) mRNA, |
| 195 | G971 | AY069953 | 7.00E−52 | Hordeum vulgare | APETALA2-like protein (AP2L1) mRNA, complet |
| 195 | G971 | AF325506 | 3.00E−51 | Pisum sativum | APETAL2-like protein mRNA, complete cds. |
| 195 | G971 | BI933811 | 4.00E−51 | Lycopersicon esculentum | EST553700 tomato flower, anthesis L |
| 195 | G971 | BG447926 | 6.00E−51 | Medicago truncatula | NF103H07EC1F1062 Elicited cell culture |
| 195 | G971 | BQ120583 | 1.00E−50 | Solanum tuberosum | EST606159 mixed potato tissues Solanum tu |
| 195 | G971 | BM892891 | 2.00E−50 | Glycine max | sam49e02.y1 Gm-c1069 Glycine max cDNA clone SOY |
| 195 | G971 | AF134116 | 3.00E−50 | Hyacinthus orientalis | APETALA2 protein homolog HAP2 (HAP2) |
| 195 | G971 | gi21717332 | 6.90E−55 | Malus x domestica | transcription factor AHAP2. |
| 195 | G971 | gi1732031 | 1.60E−54 | Zea mays | AP2 DNA-binding domain protein. |
| 195 | G971 | gi24059986 | 1.80E−53 | Oryza sativa (japonica cultivar-group) | putative indetermi |
| 195 | G971 | gi5360996 | 4.20E−53 | Hyacinthus orientalis | APETALA2 protein homolog HAP2. |
| 195 | G971 | gi13173164 | 1.30E−51 | Pisum sativum | APETAL2-like protein. |
| 195 | G971 | gi18476518 | 6.80E−51 | Hordeum vulgare | APETALA2-like protein. |
| 195 | G971 | gi5081555 | 7.50E−50 | Petunia x hybrida | PHAP2A protein. |
| 195 | G971 | gi11181612 | 2.00E−49 | Picea abies | APETALA2-related transcription factor 2. |
| 195 | G971 | gi21069053 | 4.20E−22 | Brassica napus | AP2/EREBP transcription factor BABY BOOM2. |
| 195 | G971 | gi21304227 | 6.40E−18 | Oryza sativa | ovule development aintegumenta-like protein |
| 197 | G974 | BH517407 | 3.00E−57 | Brassica oleracea | BOGRR69TR BOGR Brassica oleracea genomic |
| 197 | G974 | BI421315 | 2.00E−56 | Lycopersicon esculentum | EST531981 tomato callus, TAMU Lycop |
| 197 | G974 | AF274033 | 5.00E−56 | Atriplex hortensis | apetala2 domain-containing protein mRNA, |
| 197 | G974 | BQ115095 | 3.00E−55 | Solanum tuberosum | EST600671 mixed potato tissues Solanum tu |
| 197 | G974 | BU046010 | 9.00E−55 | Prunus persica | PP_LEa0024O08f Peach developing fruit mesoca |
| 197 | G974 | BQ742233 | 4.00E−51 | Glycine max | saq24d12.y1 Gm-c1045 Glycine max cDNA clone SOY |
| 197 | G974 | BU870880 | 5.00E−49 | Populus balsamifera subsp. trichocarpa | Q019E02 Populus flow |
| 197 | G974 | AAAA01000605 | 1.00E−47 | Oryza sativa (indica cultivar-group) | ( ) scaffold000605 |
| 197 | G974 | AP005525 | 2.00E−47 | Oryza sativa (japonica cultivar-group) | ( ) chromosome 9 clo |
| 197 | G974 | BU894329 | 2.00E−47 | Populus tremula x Populus tremuloides | X007E05 Populus wood |
| 197 | G974 | gi8571476 | 1.70E−45 | Atriplex hortensis | apetala2 domain-containing protein. |
| 197 | G974 | gi21908036 | 3.60E−43 | Zea mays | DRE binding factor 1. |
| 197 | G974 | gi19920190 | 5.50E−31 | Oryza sativa (japonica cultivar-group) | Putative AP2 domai |
| 197 | G974 | gi14140155 | 1.00E−20 | Oryza sativa | putative AP2 domain transcription factor. |
| 197 | G974 | gi3264767 | 1.10E−20 | Prunus armeniaca | AP2 domain containing protein. |
| 197 | G974 | gi3342211 | 2.20E−20 | Lycopersicon esculentum | Pti4. |
| 197 | G974 | gi10798644 | 3.50E−20 | Nicotiana tabacum | AP2 domain-containing transcription fac |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 197 | G974 | gi21304712 | 9.30E−20 | Glycine max | ethylene-responsive element binding protein 1 |
| 197 | G974 | gi7528276 | 9.30E−20 | Mesembryanthemum crystallinum | AP2-related transcription f |
| 197 | G974 | gi8809571 | 9.30E−20 | Nicotiana sylvestris | ethylene-responsive element binding |
| 199 | G975 | BH477624 | 1.00E−69 | Brassica oleracea | BOGNB10TF BOGN Brassica oleracea genomic |
| 199 | G975 | CA486875 | 3.00E−64 | Triticum aestivum | WHE4337_A02_A03ZS Wheat meiotic anther cD |
| 199 | G975 | BI978981 | 2.00E−60 | Rosa chinensis | zD09 Old Blush petal SMART library Rosa chin |
| 199 | G975 | AP004869 | 9.00E−60 | Oryza sativa (japonica cultivar-group) | ( ) chromosome 2 clo |
| 199 | G975 | BU978490 | 1.00E−58 | Hordeum vulgare subsp. vulgare | HA13G05r HA Hordeum vulgare |
| 199 | G975 | BG642554 | 8.00E−57 | Lycopersicon esculentum | EST356031 tomato flower buds, anthe |
| 199 | G975 | BI958226 | 2.00E−54 | Hordeum vulgare | HVSMEn0013P17f Hordeum vulgare rachis EST 1 |
| 199 | G975 | BQ104740 | 1.00E−52 | Rosa hybrid cultivar | fc0212.e Rose Petals (Fragrant Cloud) |
| 199 | G975 | AW705973 | 3.00E−51 | Glycine max | sk64c02.y1 Gm-c1016 Glycine max cDNA clone GENO |
| 199 | G975 | AP003615 | 1.00E−47 | Oryza sativa | chromosome 6 clone P0486H12, *** SEQUENCING IN |
| 199 | G975 | gi18650662 | 1.80E−25 | Lycopersicon esculentum | ethylene response factor 1. |
| 199 | G975 | gi131754 | 2.10E−22 | Lupinus polyphyllus | PPLZ02 PROTEIN. |
| 199 | G975 | gi3065895 | 9.20E−20 | Nicotiana tabacum | TSI1. |
| 199 | G975 | gi8571476 | 9.30E−20 | Atriplex hortensis | apetala2 domain-containing protein. |
| 199 | G975 | gi19920190 | 1.90E−19 | Oryza sativa (japonica cultivar-group) | Putative AP2 domai |
| 199 | G975 | gi21908036 | 8.40E−19 | Zea mays | DRE binding factor 1. |
| 199 | G975 | gi4099914 | 1.10E−18 | Stylosanthes hamata | ethylene-responsive element binding p |
| 199 | G975 | gi10567106 | 1.60E−18 | Oryza sativa | osERF3. |
| 199 | G975 | gi8809573 | 9.60E−18 | Nicotiana sylvestris | ethylene-responsive element binding |
| 199 | G975 | gi7528276 | 1.20E−17 | Mesembryanthemum crystallinum | AP2-related transcription f |
| 201 | G979 | AY103852 | 1.00E−84 | Zea mays | PCO068306 mRNA sequence. |
| 201 | G979 | BQ625052 | 1.00E−79 | Citrus sinensis | USDA-FP_02143 Ridge pineapple sweet orange |
| 201 | G979 | BZ068932 | 2.00E−71 | Brassica oleracea | lki37e06.b1 B. oleracea002 Brassica olerac |
| 201 | G979 | AX555218 | 8.00E−70 | Glycine max | Sequence 3 from Patent WO02059332. |
| 201 | G979 | BG595910 | 4.00E−67 | Solanum tuberosum | EST494588 cSTS Solanum tuberosum cDNA clo |
| 201 | G979 | BJ178045 | 3.00E−66 | Physcomitrella patens subsp. patens | BJ178045 normalized ful |
| 201 | G979 | AX555220 | 1.00E−65 | Oryza sativa | Sequence 5 from Patent WO02059332. |
| 201 | G979 | AX058689 | 4.00E−65 | Brassica napus | Sequence 3 from Patent WO0075330. |
| 201 | G979 | AW030921 | 2.00E−63 | Lycopersicon esculentum | EST274228 tomato callus, TAMU Lycop |
| 201 | G979 | BF646396 | 2.00E−57 | Medicago truncatula | NF071F08EC1F1074 Elicited cell culture |
| 201 | G979 | gi18844783 | 7.80E−71 | Oryza sativa (japonica cultivar-group) | hypothetical prote |
| 201 | G979 | gi21069051 | 9.80E−64 | Brassica napus | AP2/EREBP transcription factor BABY BOOM1. |
| 201 | G979 | gi21304225 | 2.60E−63 | Oryza sativa | aintegumenta-like protein. |
| 201 | G979 | gi2652938 | 3.00E−62 | Zea mays | orf. |
| 201 | G979 | gi11181612 | 4.40E−45 | Picea abies | APETALA2-related transcription factor 2. |
| 201 | G979 | gi13173164 | 6.70E−45 | Pisum sativum | APETAL2-like protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 201 | G979 | gi18476518 | 1.00E−43 | Hordeum vulgare | APETALA2-like protein. |
| 201 | G979 | gi21717332 | 2.50E−42 | Malus x domestica | transcription factor AHAP2. |
| 201 | G979 | gi5081555 | 1.40E−41 | Petunia x hybrida | PHAP2A protein. |
| 201 | G979 | gi5360996 | 8.60E−33 | Hyacinthus orientalis | APETALA2 protein homolog HAP2. |
| 203 | G987 | AC097277 | 1.00E−144 | Oryza sativa | chromosome 3 clone OSJNBa0022C08, *** SEQUENCI |
| 203 | G987 | AAAA01003633 | 1.00E−144 | Oryza sativa (indica cultivar-group) | ( ) scaffold003633 |
| 203 | G987 | AC137064 | 1.00E−115 | Oryza sativa (japonica cultivar-group) | ( ) chromosome 11 cl |
| 203 | G987 | BZ035237 | 1.00E−107 | Brassica oleracea | oeh62d03.b1 B. oleracea002 Brassica olerac |
| 203 | G987 | AY107709 | 1.00E−102 | Zea mays | PCO094187 mRNA sequence. |
| 203 | G987 | BQ406287 | 6.00E−79 | Gossypium arboreum | GA_Ed0092G04f Gossypium arboreum 7-10 d |
| 203 | G987 | BQ806671 | 4.00E−74 | Triticum aestivum | WHE3581_G12_N23ZS Wheat developing grains |
| 203 | G987 | BQ148263 | 3.00E−73 | Medicago truncatula | NF065C10FL1F1082 Developing flower Medi |
| 203 | G987 | BQ971271 | 3.00E−73 | Helianthus annuus | QHB6G17.yg.ab1 QH_ABCDI sunflower RHA801 |
| 203 | G987 | CA813062 | 1.00E−72 | Vitis vinifera | CA48LU08IIF-F7 CA48LU Vitis vinifera cDNA cl |
| 203 | G987 | gi19571020 | 5.70E−135 | Oryza sativa (japonica cultivar-group) | contains ESTs AU16 |
| 203 | G987 | gi14719332 | 1.70E−120 | Oryza sativa | putative SCARECROW gene regulator. |
| 203 | G987 | gi20334379 | 6.10E−42 | Vitis vinifera | GAI-like protein 1. |
| 203 | G987 | gi13170126 | 7.70E−41 | Brassica napus | unnamed protein product. |
| 203 | G987 | gi20257473 | 1.20E−40 | Dubautia raillardioides | GIA/RGA-like gibberellin response |
| 203 | G987 | gi20257438 | 1.50E−40 | Argyroxiphium sandwicense subsp. macrocephalum | GIA/RGA-li |
| 203 | G987 | gi20257428 | 1.50E−40 | Dubautia menziesii | GIA/RGA-like gibberellin response modu |
| 203 | G987 | gi20257467 | 1.50E−40 | Dubautia arborea | GIA/RGA-like gibberellin response modula |
| 203 | G987 | gi20257475 | 1.90E−40 | Dubautia microcephala | GIA/RGA-like gibberellin response m |
| 203 | G987 | gi20257445 | 1.90E−40 | Carlquistia muirii | GIA/RGA-like gibberellin response modu |
| 205 | G988 | CRU303349 | 1.0e−999 | Capsella rubella | ORF1, ORF2, ORF3, ORF4, ORF5 and ORF6 (pa |
| 205 | G988 | BH594527 | 1.00E−114 | Brassica oleracea | BOGWK18TF BOGW Brassica oleracea genomic |
| 205 | G988 | LES303345 | 1.00E−112 | Lycopersicon esculentum | lateral suppressor gene, ORF1 and |
| 205 | G988 | A84080 | 1.00E−111 | Solanum tuberosum | Sequence 9 from Patent WO9846759. |
| 205 | G988 | AP004191 | 2.00E−63 | Oryza sativa (japonica cultivar-group) | ( ) chromosome 2 clo |
| 205 | G988 | AAAA01001835 | 4.00E−62 | Oryza sativa (indica cultivar-group) | ( ) scaffold001835 |
| 205 | G988 | AP003944 | 6.00E−62 | Oryza sativa | chromosome 6 clone OJ1126_F05, *** SEQUENCING |
| 205 | G988 | AC137079 | 2.00E−48 | Medicago truncatula | clone mth2-27d17, WORKING DRAFT SEQUENC |
| 205 | G988 | AF378125 | 4.00E−48 | Vitis vinifera | GAI-like protein 1 (GAI1) gene, complete cds |
| 205 | G988 | AF460219 | 3.00E−47 | Hordeum vulgare | nuclear transcription factor SLN1 gene, com |
| 205 | G988 | gi13620166 | 1.90E−211 | Capsella rubella | hypothetical protein. |
| 205 | G988 | gi13620224 | 3.30E−88 | Lycopersicon esculentum | lateral suppressor. |
| 205 | G988 | gi20334379 | 2.60E−53 | Vitis vinifera | GAI-like protein 1. |
| 205 | G988 | gi13170126 | 4.20E−51 | Brassica napus | unnamed protein product. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 205 | G988 | gi18254373 | 3.70E−48 | Hordeum vulgare | nuclear transcription factor SLN1. |
| 205 | G988 | gi13603445 | 3.30E−47 | Oryza sativa | putative OsGAI. |
| 205 | G988 | gi21901982 | 3.30E−47 | Oryza sativa (japonica cultivar-group) | putative OsGAI. |
| 205 | G988 | gi20257451 | 2.90E−46 | Calycadenia multiglandulosa | GIA/RGA-like gibberellin resp |
| 205 | G988 | gi20257422 | 3.70E−46 | Dubautia arborea | GIA/RGA-like gibberellin response modula |
| 205 | G988 | gi5640157 | 6.60E−46 | Triticum aestivum | gibberellin response modulator. |
| 207 | G1040 | BH494598 | 2.00E−52 | Brassica oleracea | BOGHF24TF BOGH Brassica oleracea genomic |
| 207 | G1040 | BQ115343 | 2.00E−47 | Solanum tuberosum | EST600919 mixed potato tissues Solanum tu |
| 207 | G1040 | BM526051 | 5.00E−29 | Glycine max | sa136d09.y1 Gm-c1059 Glycine max cDNA clone SOY |
| 207 | G1040 | CA498340 | 1.00E−28 | Triticum aestivum | WHE3242_B12_C24ZT Wheat meiotic anther cD |
| 207 | G1040 | BQ280209 | 2.00E−28 | Zea mays | 1091036A08.x1 1091- Immature ear with common ESTs |
| 207 | G1040 | BQ996658 | 4.00E−28 | Lactuca sativa | QGG13H02.yg.ab1 QG_EFGHJ lettuce serriola La |
| 207 | G1040 | BI309203 | 1.00E−27 | Medicago truncatula | EST530613 GPOD Medicago truncatula cDNA |
| 207 | G1040 | AI163121 | 1.00E−26 | Populus tremula x Populus tremuloides | A033P70U Hybrid aspen |
| 207 | G1040 | AI487405 | 1.00E−23 | Lycopersicon esculentum | EST245727 tomato ovary, TAMU Lycope |
| 207 | G1040 | AP005904 | 3.00E−19 | Oryza sativa (japonica cultivar-group) | ( ) chromosome 9 clo |
| 207 | G1040 | gi4519671 | 3.10E−18 | Nicotiana tabacum | transfactor. |
| 207 | G1040 | gi6942190 | 5.10E−16 | Mesembryanthemum crystallinum | CDPK substrate protein 1; C |
| 207 | G1040 | gi23306130 | 5.20E−16 | Oryza sativa (japonica cultivar-group) | Unknown protein. |
| 207 | G1040 | gi5916207 | 5.70E−11 | Chlamydomonas reinhardtii | regulatory protein of P-starvat |
| 207 | G1040 | gi11034542 | 8.50E−08 | Oryza sativa | hypothetical protein~similar to Arabidopsis |
| 207 | G1040 | gi14189890 | 9.80E−07 | Zea mays | response regulator 9. |
| 207 | G1040 | gi2346972 | 0.99 | Petunia x hybrida | ZPT2-11. |
| 207 | G1040 | gi2058313 | 0.99 | Eucalyptus gunnii | cinnamoyl-CoA reductase. |
| 207 | G1040 | gi10304406 | 0.99 | Eucalyptus saligna | cinnamoyl-CoA reductase. |
| 207 | G1040 | gi22597156 | 1 | Glycine max | nucleolar histone deacetylase HD2-P39. |
| 209 | G1047 | BH950967 | 9.00E−56 | Brassica oleracea | odh95h11.b1 B. oleracea002 Brassica olerac |
| 209 | G1047 | BU870843 | 4.00E−29 | Populus balsamifera subsp. trichocarpa | Q019A11 Populus flow |
| 209 | G1047 | BF051268 | 1.00E−28 | Lycopersicon esculentum | EST436443 tomato developing/immatur |
| 209 | G1047 | BM269595 | 1.00E−21 | Glycine max | sak01g11.y1 Gm-c1074 Glycine max cDNA clone SOY |
| 209 | G1047 | BI977302 | 1.00E−11 | Rosa chinensis | eG09 Old Blush petal SMART library Rosa chin |
| 209 | G1047 | BQ519273 | 2.00E−11 | Solanum tuberosum | EST626688 Generation of a set of potato c |
| 209 | G1047 | BM437317 | 8.00E−11 | Vitis vinifera | VVA017G01_54129 An expressed sequence tag da |
| 209 | G1047 | CA524885 | 3.00E−10 | Capsicum annuum | KS12044G09 KS12 Capsicum annuum cDNA, mRNA |
| 209 | G1047 | AU294545 | 5.00E−10 | Zinnia elegans | AU294545 zinnia cultured mesophyll cell equa |
| 209 | G1047 | AY045570 | 7.00E−10 | Nicotiana tabacum | bZIP transcription factor BZI-2 mRNA, com |
| 209 | G1047 | gi13430400 | 9.20E−13 | Phaseolus vulgaris | bZip transcription factor. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 209 | G1047 | gi16580130 | 1.20E−12 | Nicotiana tabacum | bZIP transcription factor BZI-2. |
| 209 | G1047 | gi12829956 | 1.90E−12 | Phaseolus acutifolius | bZIP. |
| 209 | G1047 | gi24460973 | 1.10E−11 | Capsicum chinense | bZIP transcription factor. |
| 209 | G1047 | gi9650828 | 1.10E−11 | Petroselinum crispum | common plant regulatory factor 7. |
| 209 | G1047 | gi12039274 | 3.60E−11 | Oryza sativa | hypothetical protein. |
| 209 | G1047 | gi22597162 | 4.60E−11 | Glycine max | bZIP transcription factor ATB2. |
| 209 | G1047 | gi3986151 | 4.80E−10 | Raphanus sativus | rdLIP. |
| 209 | G1047 | gi5901747 | 4.80E−10 | Lycopersicon esculentum | bZIP DNA-binding protein. |
| 209 | G1047 | gi2244742 | 4.30E−09 | Antirrhinum majus | bZIP DNA-binding protein. |
| 211 | G1051 | BG044358 | 3.00E−61 | Glycine max | saa27d10.y1 Gm-c1059 Glycine max cDNA clone GEN |
| 211 | G1051 | BF269752 | 1.00E−57 | Gossypium arboreum | GA_Eb0005I16f Gossypium arboreum 7-10 d |
| 211 | G1051 | AI729411 | 1.00E−49 | Gossypium hirsutum | BNLGHi13312 Six-day Cotton fiber Gossypi |
| 211 | G1051 | AL372333 | 7.00E−49 | Medicago truncatula | MtBA50C02R1 MtBA Medicago truncatula cD |
| 211 | G1051 | BF051625 | 2.00E−47 | Lycopersicon esculentum | EST436861 tomato developing/immatur |
| 211 | G1051 | BQ869540 | 2.00E−44 | Lactuca sativa | QGD6H14.yg.ab1 QG_ABCDI lettuce salinas Lact |
| 211 | G1051 | AV426757 | 3.00E−44 | Lotus japonicus | AV426757 Lotus japonicus young plants (two- |
| 211 | G1051 | BJ279680 | 7.00E−41 | Triticum aestivum | BJ279680 Y. Ogihara unpublished cDNA libr |
| 211 | G1051 | AY107108 | 2.00E−40 | Zea mays | PCO062113 mRNA sequence. |
| 211 | G1051 | BE420598 | 8.00E−39 | Hordeum vulgare | HWM000.E11 ITEC HWM Barley Leaf Library Hor |
| 211 | G1051 | gi8096589 | 3.80E−46 | Oryza sativa | Similar to oryza sativa bZIP transcriptional |
| 211 | G1051 | gi20160758 | 1.40E−24 | Oryza sativa (japonica cultivar-group) | hypothetical prote |
| 211 | G1051 | gi2921823 | 1.10E−18 | Paulownia kawakamii | shoot-forming PKSF1. |
| 211 | G1051 | gi8777512 | 7.30E−18 | Nicotiana tabacum | bZIP transcriptional activator RSG. |
| 211 | G1051 | gi3425907 | 3.40E−16 | Lycopersicon esculentum | transcription factor VSF-1. |
| 211 | G1051 | gi4586586 | 4.70E−16 | Cicer arietinum | bZIP DNA binding protein. |
| 211 | G1051 | gi1060935 | 5.80E−09 | Zea mays | mLIP15. |
| 211 | G1051 | gi463212 | 9.70E−08 | Coix lacryma-jobi | opaque 2. |
| 211 | G1051 | gi1905785 | 1.40E−07 | Glycine max | G/HBF-1. |
| 211 | G1051 | gi100163 | 4.30E−07 | Petroselinum crispum | light-induced protein CPRF-2-parsl |
| 213 | G1052 | BG044358 | 8.00E−66 | Glycine max | saa27d10.y1 Gm-c1059 Glycine max cDNA clone GEN |
| 213 | G1052 | AP002092 | 3.00E−65 | Oryza sativa | genomic DNA, chromosome 1, PAC clone: P0031E09. |
| 213 | G1052 | AAAA01012061 | 2.00E−64 | Oryza sativa (indica cultivar-group) | ( ) scaffold012061 |
| 213 | G1052 | BF269752 | 2.00E−56 | Gossypium arboreum | GA_Eb0005I16f Gossypium arboreum 7-10 d |
| 213 | G1052 | AI729411 | 4.00E−52 | Gossypium hirsutum | BNLGHi13312 Six-day Cotton fiber Gossypi |
| 213 | G1052 | BF051625 | 3.00E−50 | Lycopersicon esculentum | EST436861 tomato developing/immatur |
| 213 | G1052 | AL372333 | 2.00E−48 | Medicago truncatula | MtBA50C02R1 MtBA Medicago truncatula cD |
| 213 | G1052 | BH529222 | 8.00E−48 | Brassica oleracea | BOHBA78TF BOHB Brassica oleracea genomic |
| 213 | G1052 | AV426757 | 1.00E−46 | Lotus japonicus | AV426757 Lotus japonicus young plants (two- |
| 213 | G1052 | BQ866454 | 3.00E−45 | Lactuca sativa | QGC8A11.yg.ab1 QG_ABCDI lettuce salinas Lact |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 213 | G1052 | gi8096589 | 8.60E−75 | Oryza sativa | Similar to Oryza sativa bZIP transcriptional |
| 213 | G1052 | gi20160758 | 6.90E−43 | Oryza sativa (japonica cultivar-group) | hypothetical prote |
| 213 | G1052 | gi2921823 | 1.00E−18 | Paulownia kawakamii | shoot-forming PKSF1. |
| 213 | G1052 | gi1076603 | 1.10E−17 | Lycopersicon esculentum | vsf-1 protein-tomato. |
| 213 | G1052 | gi8777512 | 3.80E−17 | Nicotiana tabacum | bZIP transcriptional activator RSG. |
| 213 | G1052 | gi4586586 | 3.70E−14 | Cicer arietinum | bZIP DNA binding protein. |
| 213 | G1052 | gi1060935 | 4.80E−09 | Zea mays | mLIP15. |
| 213 | G1052 | gi1905785 | 2.50E−07 | Glycine max | G/HBF-1. |
| 213 | G1052 | gi1076760 | 9.40E−07 | Sorghum bicolor | Opaque-2-related protein-sorghum. |
| 213 | G1052 | gi9650826 | 9.60E−07 | Petroselinum crispum | common plant regulatory factor 6. |
| 215 | G1062 | BQ990836 | 3.00E−88 | Lactuca sativa | QGF21D20.yg.ab1 QG_EFGHJ lettuce serriola La |
| 215 | G1062 | BH470947 | 8.00E−84 | Brassica oleracea | BOGSV06TR BOGS Brassica oleracea genomic |
| 215 | G1062 | BE040141 | 2.00E−83 | Oryza sativa | OD102H09 OD Oryza sativa cDNA 5' similar to bh |
| 215 | G1062 | CA501920 | 6.00E−80 | Triticum aestivum | WHE4040_D03_H06ZT Wheat meiotic anther cD |
| 215 | G1062 | AW648468 | 1.00E−79 | Lycopersicon esculentum | EST326922 tomato germinating seedli |
| 215 | G1062 | BU763190 | 1.00E−78 | Glycine max | sas38f03.y1 Gm-c1080 Glycine max cDNA clone SOY |
| 215 | G1062 | BE602161 | 5.00E−70 | Hordeum vulgare | HVSMEh0102M15f Hordeum vulgare 5-45 DAP spi |
| 215 | G1062 | BM111984 | 5.00E−69 | Solanum tuberosum | EST559520 potato roots Solanum tuberosum |
| 215 | G1062 | AU291385 | 2.00E−68 | Zinnia elegans | AU291385 zinnia cultured mesophyll cell equa |
| 215 | G1062 | BU983081 | 1.00E−57 | Hordeum vulgare subsp. vulgare | HA28H22r HA Hordeum vulgare |
| 215 | G1062 | gi20161831 | 1.60E−81 | Oryza sativa (japonica cultivar-group) | hypothetical prote |
| 215 | G1062 | gi10140754 | 1.40E−27 | Oryza sativa | hypothetical protein. |
| 215 | G1062 | gi1142619 | 3.50E−13 | Phaseolus vulgaris | phaseolin G-box binding protein PG1. |
| 215 | G1062 | gi527661 | 7.50E−12 | Phyllostachys acuta | myc-like regulatory R gene product. |
| 215 | G1062 | gi10998404 | 7.50E−12 | Petunia x hybrida | anthocyanin 1. |
| 215 | G1062 | gi1420924 | 1.90E−11 | Zea mays | IN1. |
| 215 | G1062 | gi527665 | 3.30E−11 | Sorghum bicolor | myc-like regulatory R gene product. |
| 215 | G1062 | gi1086526 | 9.10E−11 | Oryza australiensis | transcriptional activator Ra homolog. |
| 215 | G1062 | gi1086534 | 1.20E−10 | Oryza officinalis | transcriptional activator Ra homolog. |
| 215 | G1062 | gi1086538 | 1.20E−10 | Oryza rufipogon | transcriptional activator Rb homolog. |
| 217 | G1063 | BH700922 | 1.00E−87 | Brassica oleracea | BOMMZ07TR BO_2_3_KB Brassica oleracea gen |
| 217 | G1063 | BE451174 | 1.00E−43 | Lycopersicon esculentum | EST402062 tomato root, plants pre-a |
| 217 | G1063 | AW832545 | 2.00E−43 | Glycine max | sm12e10.y1 Gm-c1027 Glycine max cDNA clone GENO |
| 217 | G1063 | AP004693 | 5.00E−42 | Oryza sativa | chromosome 8 clone P0461F06, *** SEQUENCING IN |
| 217 | G1063 | AAAA01006870 | 1.00E−39 | Oryza sativa (indica cultivar-group) | ( ) scaffold006870 |
| 217 | G1063 | AP005655 | 1.00E−39 | Oryza sativa (japonica cultivar-group) | ( ) chromosome 9 clo |
| 217 | G1063 | BH775806 | 2.00E−36 | Zea mays | fzmb011f018c05f1 fzmb filtered library Zea mays ge |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 217 | G1063 | AT002234 | 4.00E−34 | Brassica rapa subsp. pekinensis | AT002234 Flower bud cDNA Br |
| 217 | G1063 | BF263465 | 3.00E−26 | Hordeum vulgare | HV_CEa0006N02f Hordeum vulgare seedling gre |
| 217 | G1063 | CA015528 | 2.00E−25 | Hordeum vulgare subsp. vulgare | HT14J12r HT Hordeum vulgare |
| 217 | G1063 | gi19571105 | 7.20E−29 | Oryza sativa (japonica cultivar-group) | hypothetical prote |
| 217 | G1063 | gi15528743 | 8.90E−27 | Oryza sativa | contains EST C74560(E31855)~unknown protein. |
| 217 | G1063 | gi6166283 | 1.70E−10 | Pinus taeda | helix-loop-helix protein 1A. |
| 217 | G1063 | gi11045087 | 1.80E−09 | Brassica napus | putative protein. |
| 217 | G1063 | gi10998404 | 1.50E−08 | Petunia x hybrida | anthocyanin 1. |
| 217 | G1063 | gi1142621 | 1.10E−07 | Phaseolus vulgaris | phaseolin G-box binding protein PG2. |
| 217 | G1063 | gi166428 | 1.70E−07 | Antirrhinum majus | DEL. |
| 217 | G1063 | gi527665 | 8.00E−07 | Sorghum bicolor | myc-like regulatory R gene product. |
| 217 | G1063 | gi3399777 | 9.40E−07 | Glycine max | symbiotic ammonium transporter; nodulin. |
| 217 | G1063 | gi5923912 | 1.40E−06 | Tulipa gesneriana | bHLH transcription factor GBOF-1. |
| 219 | G1064 | AP005733 | 6.00E−68 | Oryza sativa (japonica cultivar-group) | ( ) chromosome 2 clo |
| 219 | G1064 | AF165924 | 4.00E−65 | Gossypium hirsutum | auxin-induced basic helix-loop-helix |
| 219 | G1064 | AP003569 | 9.00E−59 | Oryza sativa | chromosome 6 clone P0425F05, *** SEQUENCING IN |
| 219 | G1064 | AAAA01000293 | 9.00E−59 | Oryza sativa (indica cultivar-group) | ( ) scaffold000293 |
| 219 | G1064 | BG447197 | 1.00E−56 | Gossypium arboreum | GA_Eb0041A19f Gossypium arboreum 7-10 d |
| 219 | G1064 | AW649873 | 7.00E−54 | Lycopersicon esculentum | EST328327 tomato germinating seedli |
| 219 | G1064 | BH652584 | 2.00E−48 | Brassica oleracea | BOMKX03TR BO_2_3_KB Brassica oleracea gen |
| 219 | G1064 | AW695783 | 3.00E−45 | Medicago truncatula | NF098G07ST1F1055 Developing stem Medica |
| 219 | G1064 | AV422714 | 4.00E−45 | Lotus japonicus | AV422714 Lotus japonicus young plants (two- |
| 219 | G1064 | BQ294210 | 5.00E−42 | Zea mays | 1091026H05.y2 1091-Immature ear with common ESTs |
| 219 | G1064 | gi5731257 | 9.90E−64 | Gossypium hirsutum | auxin-induced basic helix-loop-helix t |
| 219 | G1064 | gi20975251 | 8.60E−45 | Oryza sativa (japonica cultivar-group) | transcription fact |
| 219 | G1064 | gi2580440 | 3.00E−32 | Oryza sativa | PCF2. |
| 219 | G1064 | gi20269127 | 1.70E−07 | Lupinus albus | TCP1 protein. |
| 219 | G1064 | gi12002867 | 1.10E−06 | Lycopersicon esculentum | cycloidea. |
| 219 | G1064 | gi7248461 | 0.00029 | Zea mays | root cap-specific protein. |
| 219 | G1064 | gi21624279 | 0.00082 | Pueraria montana var. lobata | PlCYC3. |
| 219 | G1064 | gi13649864 | 0.00085 | Capillipedium parviflorum | teosinte branched1 protein. |
| 219 | G1064 | gi13649873 | 0.0013 | Bothriochloa odorata | teosinte branched1 protein. |
| 219 | G1064 | gi7008009 | 0.0016 | Pisum sativum | PsAD1. |
| 221 | G1069 | BZ025139 | 1.00E−111 | Brassica oleracea | oeh63d12.g1 B. oleracea002 Brassica olerac |
| 221 | G1069 | AP004971 | 1.00E−93 | Lotus japonicus | genomic DNA, chromosome 5, clone: LjT45G21, |
| 221 | G1069 | AP004020 | 2.00E−79 | Oryza sativa | chromosome 2 clone OJ1119_A01, *** SEQUENCING |
| 221 | G1069 | AAAA01017331 | 2.00E−70 | Oryza sativa (indica cultivar-group) | ( ) scaffold017331 |
| 221 | G1069 | BQ165495 | 2.00E−62 | Medicago truncatula | EST611364 KVKC Medicago truncatula cDNA |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 221 | G1069 | AC135209 | 2.00E−61 | Oryza sativa (japonica cultivar-group) | ( ) chromosome 3 clo |
| 221 | G1069 | AW621455 | 4.00E−59 | Lycopersicon esculentum | EST312253 tomato root during/after |
| 221 | G1069 | BM110212 | 4.00E−58 | Solanum tuberosum | EST557748 potato roots Solanum tuberosum |
| 221 | G1069 | BQ785950 | 7.00E−58 | Glycine max | saq61f09.y1 Gm-c1076 Glycine max cDNA clone SOY |
| 221 | G1069 | BQ863249 | 1.00E−57 | Lactuca sativa | QGC23G02.yg.ab1 QG_ABCDI lettuce salinas Lac |
| 221 | G1069 | gi24059979 | 2.10E−38 | Oryza sativa (japonica cultivar-group) | similar to DNA-bin |
| 221 | G1069 | gi15528814 | 4.50E−36 | Oryza sativa | hypothetical protein~similar to Arabidopsis |
| 221 | G1069 | gi4165183 | 7.60E−25 | Antirrhinum majus | SAP1 protein. |
| 221 | G1069 | gi2213534 | 1.20E−19 | Pisum sativum | DNA-binding PD1-like protein. |
| 221 | G1069 | gi2459999 | 1 | Chlamydomonas reinhardtii | tubulin Uni3. |
| 221 | G1069 | gi100872 | 1 | Zea mays | MFS18 protein-maize. |
| 221 | G1069 | gi1362165 | 1 | Hordeum vulgare | hypothetical protein 2 (clone ES1A)-bar |
| 223 | G1073 | AAAA01000486 | 4.00E−74 | Oryza sativa (indica cultivar-group) | ( ) scaffold000486 |
| 223 | G1073 | AP004165 | 4.00E−74 | Oryza sativa | chromosome 2 clone OJ1479_B12, *** SEQUENCING |
| 223 | G1073 | AP005477 | 2.00E−67 | Oryza sativa (japonica cultivar-group) | ( ) chromosome 6 clo |
| 223 | G1073 | BZ412041 | 3.00E−65 | Zea mays | OGACG56TC ZM_0.7_1.5_KB Zea mays genomic clone ZMM |
| 223 | G1073 | AJ502190 | 3.00E−64 | Medicago truncatula | AJ502190 MTAMP Medicago truncatula cDNA |
| 223 | G1073 | BQ865858 | 4.00E−63 | Lactuca sativa | QGC6B08.yg.ab1 QG_ABCDI lettuce salinas Lact |
| 223 | G1073 | BH975957 | 5.00E−63 | Brassica oleracea | odh67e11.g1 B. oleracea002 Brassica olerac |
| 223 | G1073 | BG134451 | 8.00E−62 | Lycopersicon esculentum | EST467343 tomato crown gall Lycoper |
| 223 | G1073 | AP004971 | 3.00E−60 | Lotus japonicus | genomic DNA, chromosome 5, clone: LjT45G21, |
| 223 | G1073 | BM110212 | 7.00E−58 | Solanum tuberosum | EST557748 potato roots Solanum tuberosum |
| 223 | G1073 | gi15528814 | 5.50E−38 | Oryza sativa | hypothetical protein~similar to Arabidopsis |
| 223 | G1073 | gi24059979 | 1.30E−29 | Oryza sativa (japonica cultivar-group) | similar to DNA-bin |
| 223 | G1073 | gi2213536 | 1.20E−21 | Pisum sativum | DNA-binding protein PD1. |
| 223 | G1073 | gi4165183 | 5.70E−20 | Antirrhinum majus | SAP1 protein. |
| 223 | G1073 | gi1166450 | 0.00059 | Lycopersicon esculentum | Tfm5. |
| 223 | G1073 | gi11545668 | 0.0051 | Chlamydomonas reinhardtii | CIA5. |
| 223 | G1073 | gi4755087 | 0.0054 | Zea mays | aluminum-induced protein; Al-induced protein. |
| 223 | G1073 | gi395147 | 0.0068 | Nicotiana tabacum | glycine-rich protein. |
| 223 | G1073 | gi21068672 | 0.017 | Cicer arietinum | putative glycine-rich protein. |
| 223 | G1073 | gi1346181 | 0.017 | Sinapis alba | GLYCINE-RICH RNA-BINDING PROTEIN GRP2A. |
| 225 | G1075 | BH596283 | 1.00E−108 | Brassica oleracea | BOGBL42TR BOGB Brassica oleracea genomic |
| 225 | G1075 | BQ165495 | 5.00E−88 | Medicago truncatula | EST611364 KVKC Medicago truncatula cDNA |
| 225 | G1075 | AAAA01003389 | 3.00E−84 | Oryza sativa (indica cultivar-group) | ( ) scaffold003389 |
| 225 | G1075 | OSJN00182 | 3.00E−84 | Oryza sativa | chromosome 4 clone OSJNBa0086O06, *** SEQUENC |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 225 | G1075 | BZ412041 | 1.00E−76 | *Zea mays* | OGACG56TC ZM_0.7_1.5_KB *Zea mays* genomic clone ZMM |
| 225 | G1075 | AP005653 | 1.00E−68 | *Oryza sativa (japonica cultivar-group)* | ( ) chromosome 2 clo |
| 225 | G1075 | BQ863249 | 3.00E−65 | *Lactuca sativa* | QGC23G02.yg.ab1 QG_ABCDI lettuce salinas Lac |
| 225 | G1075 | BM110212 | 2.00E−63 | *Solanum tuberosum* | EST557748 potato roots *Solanum tuberosum* |
| 225 | G1075 | BQ838600 | 8.00E−63 | *Triticum aestivum* | WHE2912_D12_H24ZS Wheat aluminum-stressed genomic DNA, chromosome 5, clone: LjT45G21, |
| 225 | G1075 | AP004971 | 4.00E−62 | *Lotus japonicus* | |
| 225 | G1075 | gi15528814 | 3.80E−39 | *Oryza sativa* | hypothetical protein~similar to *Arabidopsis* |
| 225 | G1075 | gi24059979 | 6.60E−35 | *Oryza sativa (japonica cultivar-group)* | similar to DNA-bin |
| 225 | G1075 | gi4165183 | 7.30E−20 | *Antirrhinum majus* | SAP1 protein. |
| 225 | G1075 | gi2213534 | 2.50E−19 | *Pisum sativum* | DNA-binding PD1-like protein. |
| 225 | G1075 | gi3810890 | 3.70E−05 | *Cucumis sativus* | glycine-rich protein-2. |
| 225 | G1075 | gi7489009 | 0.0001 | *Lycopersicon esculentum* | glycine-rich protein (clone w10-1 |
| 225 | G1075 | gi4115615 | 0.0018 | *Zea mays* | root cap-specific glycine-rich protein. |
| 225 | G1075 | gi1628463 | 0.004 | *Silene latifolia* | Men-4. |
| 225 | G1075 | gi395147 | 0.005 | *Nicotiana tabacum* | glycine-rich protein. |
| 225 | G1075 | gi121631 | 0.0056 | *Nicotiana sylvestris* | GLYCINE-RICH CELL WALL STRUCTURAL PR |
| 227 | G1084 | BH733462 | 5.00E−98 | *Brassica oleracea* | BOMEF84TF BO_2_3_KB *Brassica oleracea* gen |
| 227 | G1084 | AAAA01002671 | 5.00E−79 | *Oryza sativa (indica cultivar-group)* | ( ) scaffold002671 |
| 227 | G1084 | AP004622 | 5.00E−79 | *Oryza sativa (japonica cultivar-group)* | ( ) chromosome 8 clo |
| 227 | G1084 | AC135313 | 9.00E−78 | *Medicago truncatula* | clone mth2-7n18, WORKING DRAFT SEQUENCE |
| 227 | G1084 | AF268596 | 7.00E−41 | *Oryza sativa* | bZIP (bZIP) mRNA, complete cds. |
| 227 | G1084 | BG135778 | 2.00E−40 | *Lycopersicon esculentum* | EST468670 tomato crown gall Lycoper |
| 227 | G1084 | BQ875336 | 3.00E−39 | *Lactuca sativa* | QGI7N06.yg.ab1 QG_ABCDI lettuce salinas Lact |
| 227 | G1084 | BQ470403 | 2.00E−35 | *Hordeum vulgare* | HX02O04r HX *Hordeum vulgare* cDNA clone HX02 |
| 227 | G1084 | BG651461 | 3.00E−33 | *Glycine max* | sad47a06.y1 Gm-c1075 *Glycine max* cDNA clone GEN |
| 227 | G1084 | BI141172 | 4.00E−32 | *Sorghum bicolor* | IP1_44_A10.b1_A002 Immature pannicle 1 (IP1 |
| 227 | G1084 | gi20146230 | 1.60E−34 | *Oryza sativa (japonica cultivar-group)* | bzip-like transcri |
| 227 | G1084 | gi15408647 | 1.80E−31 | *Oryza sativa* | putative bZIP (leucine zipper) protein. |
| 227 | G1084 | gi22858664 | 9.00E−28 | *Gossypium hirsutum* | unknown. |
| 227 | G1084 | gi13620168 | 0.00064 | *Capsella rubella* | hypothetical protein. |
| 227 | G1084 | gi22550110 | 0.0017 | *Marsilea quadrifolia* | bZIP-like protein. |
| 227 | G1084 | gi14329812 | 0.0074 | *Atropa belladonna* | putative nucleosome assembly protein 1. |
| 227 | G1084 | gi2257756 | 0.012 | *Zea mays* | nucleolar histone deacetylase HD2-p39. |
| 227 | G1084 | gi4106378 | 0.031 | *Brassica napus* | calcium-binding protein. |
| 227 | G1084 | gi14335 | 0.17 | Chloroplast *Oenothera odorata* | ORF2280. |
| 227 | G1084 | gi401496 | 0.17 | Chloroplast *Oenothera picensis* | HYPOTHETICAL PROTEIN (ORF |
| 229 | G1089 | BH602457 | 1.00E−103 | *Brassica oleracea* | BOGCB25TR BOGC *Brassica oleracea* genomic |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 229 | G1089 | BQ979739 | 1.00E−90 | Helianthus annuus | QHI9B09.yg.ab1 QH_ABCDI sunflower RHA801 |
| 229 | G1089 | AAAA01000525 | 1.00E−79 | Oryza sativa (indica cultivar-group) | ( ) scaffold000525 |
| 229 | G1089 | AP005779 | 1.00E−79 | Oryza sativa (japonica cultivar-group) | ( ) chromosome 7 clo |
| 229 | G1089 | AP003931 | 1.00E−79 | Oryza sativa | chromosome 7 clone OJ1664_D08, *** SEQUENCING |
| 229 | G1089 | AC135413 | 2.00E−78 | Medicago truncatula | clone mth2-16n19, WORKING DRAFT SEQUENC |
| 229 | G1089 | BE659923 | 2.00E−76 | Glycine max | 1098 GmaxSC Glycine max cDNA, mRNA sequence. |
| 229 | G1089 | BJ224103 | 8.00E−76 | Triticum aestivum | BJ224103 Y. Ogihara unpublished cDNA libr |
| 229 | G1089 | BQ991309 | 2.00E−75 | Lactuca sativa | QGF22I10.yg.ab1 QG_EFGHJ lettuce serriola La |
| 229 | G1089 | BU992003 | 1.00E−70 | Hordeum vulgare | HD08I18r HD Hordeum vulgare cDNA clone HD08 |
| 229 | G1089 | gi23237834 | 5.20E−149 | Oryza sativa (japonica cultivar-group) | bZIP protein-like. |
| 229 | G1089 | gi15408647 | 3.40E−109 | Oryza sativa | putative bZIP (leucine zipper) protein. |
| 229 | G1089 | gi22858664 | 5.80E−58 | Gossypium hirsutum | unknown. |
| 229 | G1089 | gi22550110 | 4.70E−18 | Marsilea quadrifolia | bZIP-like protein. |
| 229 | G1089 | gi12018147 | 1.80E−07 | Chlamydomonas reinhardtii | vegetative cell wall protein gp |
| 229 | G1089 | gi1184100 | 1.00E−06 | Nicotiana alata | pistil extensin-like protein. |
| 229 | G1089 | gi100216 | 1.50E−06 | Lycopersicon esculentum | extensin class II (clone uJ-2)- |
| 229 | G1089 | gi6523547 | 4.10E−06 | Volvox carteri f. nagariensis | hydroxyproline-rich glycopr |
| 229 | G1089 | gi18873729 | 4.40E−06 | Saccharum hybrid cultivar CP65-357 | proline-rich protein. |
| 229 | G1089 | gi4106378 | 7.30E−06 | Brassica napus | calcium-binding protein. |
| 231 | G1134 | BF096555 | 6.00E−46 | Lycopersicon esculentum | EST360582 tomato nutrient deficient |
| 231 | G1134 | BH509718 | 2.00E−34 | Brassica oleracea | BOHGV18TF BOHG Brassica oleracea genomic |
| 231 | G1134 | BU091550 | 4.00E−33 | Glycine max | st74e07.y1 Gm-c1054 Glycine max cDNA clone GENO |
| 231 | G1134 | BF005956 | 1.00E−32 | Medicago truncatula | EST434454 DSLC Medicago truncatula cDNA |
| 231 | G1134 | BU866761 | 3.00E−32 | Populus tremula x Populus tremuloides | S070E02 Populus imbib |
| 231 | G1134 | BM109038 | 1.00E−30 | Solanum tuberosum | EST556574 potato roots Solanum tuberosum |
| 231 | G1134 | BM436251 | 1.00E−29 | Vitis vinifera | VVA001A07_52085 An expressed sequence tag da |
| 231 | G1134 | BQ281404 | 3.00E−29 | Triticum aestivum | WHE3020_H08_P16ZS Wheat unstressed seedli |
| 231 | G1134 | BU029490 | 5.00E−29 | Helianthus annuus | QHJ10N22.yg.ab1 QH_EFGHJ sunflower RHA280 |
| 231 | G1134 | BQ803551 | 8.00E−29 | Triticum monococcum | WHE2838_H09_O18ZS Triticum monococcum v |
| 231 | G1134 | gi6166283 | 5.10E−35 | Pinus taeda | helix-loop-helix protein 1A. |
| 231 | G1134 | gi20161021 | 6.20E−33 | Oryza sativa (japonica cultivar-group) | contains ESTs AU05 |
| 231 | G1134 | gi19401700 | 1.00E−29 | Oryza sativa | transcription factor RAU1. |
| 231 | G1134 | gi5923912 | 1.80E−11 | Tulipa gesneriana | bHLH transcription factor GBOF-1. |
| 231 | G1134 | gi1086538 | 2.80E−06 | Oryza rufipogon | transcriptional activator Rb homolog. |
| 231 | G1134 | gi527657 | 1.30E−05 | Pennisetum glaucum | myc-like regulatory R gene product. |
| 231 | G1134 | gi3399777 | 0.00011 | Glycine max | symbiotic ammonium transporter; nodulin. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 231 | G1134 | gi527665 | 0.00046 | Sorghum bicolor | myc-like regulatory R gene product. |
| 231 | G1134 | gi13346182 | 0.0013 | Gossypium hirsutum | GHDEL65. |
| 231 | G1134 | gi100921 | 0.0025 | Zea mays | regulatory protein B-Peru-maize. |
| 233 | G1140 | AF346303 | 1.00E−68 | Ipomoea batatas | MADS box transcription factor (MADS4) mRNA, |
| 233 | G1140 | AF335237 | 2.00E−62 | Petunia x hybrida | MADS-box transcription factor FBP13 (FBP1 |
| 233 | G1140 | BU837680 | 4.00E−62 | Populus tremula x Populus tremuloides | T104E08 Populus apica |
| 233 | G1140 | AF008651 | 6.00E−61 | Solanum tuberosum | MADS transcriptional factor (Stmads16) mR |
| 233 | G1140 | AB050643 | 2.00E−60 | Magnolia praecocissima | mRNA for putative MADS-domain transc |
| 233 | G1140 | AF060880 | 5.00E−58 | Paulownia kawakamii | MADS box protein mRNA, complete cds. |
| 233 | G1140 | AF144623 | 5.00E−58 | Canavalia lineata | MADS-box transcription factor (MADS) mRNA |
| 233 | G1140 | AX403042 | 1.00E−57 | Lycopersicon esculentum | Sequence 3 from Patent WO0204651. |
| 233 | G1140 | BU824503 | 2.00E−50 | Populus tremula | UB65DPB03 Populus tremula cambium cDNA libr |
| 233 | G1140 | AY104901 | 7.00E−49 | Zea mays | PCO106306 mRNA sequence. |
| 233 | G1140 | gi13448660 | 2.20E−66 | Ipomoea batatas | MADS box transcription factor. |
| 233 | G1140 | gi13384052 | 1.40E−64 | Petunia x hybrida | MADS-box transcription factor FBP13. |
| 233 | G1140 | gi2735764 | 5.00E−60 | Solanum tuberosum | MADS transcriptional factor; STMADS16. |
| 233 | G1140 | gi17433048 | 2.10E−59 | Lycopersicon esculentum | MADS-box JOINTLESS protein (LeMAD |
| 233 | G1140 | gi16549058 | 9.40E−59 | Magnolia praecocissima | putative MADS-domain transcription |
| 233 | G1140 | gi6652756 | 8.50E−58 | Paulownia kawakamii | MADS box protein. |
| 233 | G1140 | gi7672991 | 2.90E−57 | Canavalia lineata | MADS-box transcription factor. |
| 233 | G1140 | gi5295978 | 1.40E−48 | Oryza sativa | MADS box-like protein. |
| 233 | G1140 | gi9367234 | 1.10E−46 | Hordeum vulgare | MADS-box protein 1-2. |
| 233 | G1140 | gi3986689 | 2.10E−45 | Cichorium intybus | MADS box protein. |
| 235 | G1143 | BH962188 | 6.00E−31 | Brassica oleracea | odd86h08.b1 B. oleracea002 Brassica olerac |
| 235 | G1143 | BI932387 | 2.00E−19 | Lycopersicon esculentum | EST552276 tomato flower, 8 mm to pr |
| 235 | G1143 | AU288464 | 3.00E−14 | Zinnia elegans | AU288464 zinnia cultured mesophyll cell equa |
| 235 | G1143 | BF004604 | 7.00E−11 | Medicago truncatula | EST433102 KV1 Medicago truncatula cDNA |
| 235 | G1143 | PVU18348 | 2.00E−09 | Phaseolus vulgaris | phaseolin G-box binding protein PG1 (PG1 |
| 235 | G1143 | BQ505669 | 3.00E−09 | Solanum tuberosum | EST613084 Generation of a set of potato c |
| 235 | G1143 | CA502087 | 1.00E−08 | Triticum aestivum | WHE4042_E12_I24ZT Wheat meiotic anther cD |
| 235 | G1143 | BQ854856 | 2.00E−08 | Lactuca sativa | QGB24G11.yg.ab1 QG_ABCDI lettuce salinas Lac |
| 235 | G1143 | BU763190 | 3.00E−08 | Glycine max | sas38f03.y1 Gm-c1080 Glycine max cDNA clone SOY |
| 235 | G1143 | AF260919 | 3.00E−08 | Petunia x hybrida | anthocyanin 1 (an1) mRNA, an1-V26 allele, |
| 235 | G1143 | gi1142619 | 1.20E−11 | Phaseolus vulgaris | phaseolin G-box binding protein PG1. |
| 235 | G1143 | gi6175252 | 1.20E−09 | Lycopersicon esculentum | jasmonic acid 3. |
| 235 | G1143 | gi7339702 | 1.40E−09 | Oryza sativa | EST AU065085(F11092) corresponds to a region |
| 235 | G1143 | gi10998404 | 3.30E−09 | Petunia x hybrida | anthocyanin 1. |
| 235 | G1143 | gi527655 | 3.80E−09 | Pennisetum glaucum | myc-like regulatory R gene product. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 235 | G1143 | gi22758263 | 1.50E−08 | Oryza sativa (japonica cultivar-group) | Putative bHLH tran |
| 235 | G1143 | gi3399777 | 1.90E−08 | Glycine max | symbiotic ammonium transporter; nodulin. |
| 235 | G1143 | gi4321762 | 8.90E−08 | Zea mays | transcription factor MYC7E. |
| 235 | G1143 | gi13346180 | 1.70E−07 | Gossypium hirsutum | GHDEL61. |
| 235 | G1143 | gi527665 | 6.50E−07 | Sorghum bicolor | myc-like regulatory R gene product. |
| 237 | G1146 | AB081950 | 1.0e−999 | Oryza sativa (japonica cultivar-group) | ( ) OsPNH1 mRNA for |
| 237 | G1146 | AY109385 | 1.0e−999 | Zea mays | CL857_2 mRNA sequence. |
| 237 | G1146 | BF269617 | 1.00E−149 | Gossypium arboreum | GA_Eb0005C21f Gossypium arboreum 7-10 d |
| 237 | G1146 | BI118817 | 1.00E−146 | Oryza sativa | EST205 Differentially expressed cDNA libraries |
| 237 | G1146 | AAAA01000124 | 1.00E−145 | Oryza sativa (indica cultivar-group) | ( ) scaffold000124 |
| 237 | G1146 | BG648445 | 1.00E−138 | Medicago truncatula | EST510064 HOGA Medicago truncatula cDNA |
| 237 | G1146 | BG351593 | 1.00E−135 | Solanum tuberosum | 129B03 Mature tuber lambda ZAP Solanum tu |
| 237 | G1146 | BU894661 | 1.00E−131 | Populus tremula x Populus tremuloides | X012H09 Populus wood |
| 237 | G1146 | BG125123 | 1.00E−126 | Lycopersicon esculentum | EST470769 tomato shoot/meristem Lyc |
| 237 | G1146 | BF265852 | 1.00E−120 | Hordeum vulgare | HV_CEa0013I03f Hordeum vulgare seedling gre |
| 237 | G1146 | gi21280321 | 1.0e−999 | Oryza sativa (japonica cultivar-group) | ZLL/PNH homologous |
| 237 | G1146 | gi6539559 | 1.70E−103 | Oryza sativa | ESTs AU068544(C30430), C98487 (E0325), D23445(C |
| 237 | G1146 | gi18542175 | 1.20E−54 | Zea mays | putative pinhead protein. |
| 237 | G1146 | gi559557 | 0.02 | Pyrus communis | arabinogalactan-protein. |
| 237 | G1146 | gi4103618 | 0.59 | Fragaria x ananassa | HyPRP. |
| 237 | G1146 | gi6651027 | 0.66 | Brassica napus | high mobility group protein I/Y. |
| 237 | G1146 | gi322757 | 0.86 | Nicotiana tabacum | pistil extensin-like protein (clone pMG |
| 237 | G1146 | gi806720 | 0.86 | Nicotiana alata | arabinogalactan-protein precursor. |
| 237 | G1146 | gi1076211 | 0.93 | Chlamydomonas reinhardtii | hypothetical protein VSP-3-Ch |
| 237 | G1146 | gi6523547 | 0.94 | Volvox carteri f. nagariensis | hydroxyproline-rich glycopr |
| 239 | G1196 | AX041006 | 1.00E−112 | Zea mays | Sequence 1 from Patent WO0065037. |
| 239 | G1196 | AX351139 | 1.00E−106 | Oryza sativa | Sequence 13 from Patent WO0166755. |
| 239 | G1196 | AX049431 | 1.00E−105 | Triticum aestivum | Sequence 6 from Patent WO0070069. |
| 239 | G1196 | BH483537 | 7.00E−90 | Brassica oleracea | BOGXP26TF BOGX Brassica oleracea genomic |
| 239 | G1196 | AF480488 | 5.00E−78 | Nicotiana tabacum | NPR1 mRNA, complete cds. |
| 239 | G1196 | AAAA01000043 | 1.00E−68 | Oryza sativa (indica cultivar-group) | ( ) scaffold000043 |
| 239 | G1196 | BM111027 | 6.00E−68 | Solanum tuberosum | EST558563 potato roots Solanum tuberosum |
| 239 | G1196 | BQ849921 | 1.00E−67 | Lactuca sativa | QGB11C22.yg.ab1 QG_ABCDI lettuce salinas Lac |
| 239 | G1196 | AF527176 | 9.00E−67 | Brassica napus | putative NPR1 (NPR1) mRNA, complete cds. |
| 239 | G1196 | BQ148533 | 2.00E−65 | Medicago truncatula | NF069A11FL1F1085 Developing flower Medi |
| 239 | G1196 | gi11340603 | 3.10E−118 | Zea mays | unnamed protein product. |
| 239 | G1196 | gi22535593 | 3.50E−111 | Oryza sativa (japonica cultivar-group) | putative Regulator |
| 239 | G1196 | gi18616497 | 3.50E−109 | Triticum aestivum | unnamed protein product. |
| 239 | G1196 | gi18616493 | 1.10E−105 | Oryza sativa | unnamed protein product. |
| 239 | G1196 | gi21552981 | 3.40E−77 | Nicotiana tabacum | NPR1. |
| 239 | G1196 | gi22003730 | 3.30E−71 | Brassica napus | putative NPR1. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 239 | G1196 | gi4433618 | 0.1 | Dendrobium grex Madame Thong-In | putative myosin heavy cha |
| 239 | G1196 | gi17645766 | 0.71 | Glycine max | unnamed protein product. |
| 239 | G1196 | gi421970 | 0.76 | Helianthus annuus | hypothetical protein 708-common sunfl |
| 239 | G1196 | gi223934 | 0.9 | Hordeum vulgare var. distichum | protein, acyl carrier. |
| 241 | G1198 | AF036949 | 1.00E−119 | Zea mays | basic leucine zipper protein (liguleless2) mRNA, c |
| 241 | G1198 | BD016868 | 1.00E−100 | Oryza sativa | Rice-origin information transmission-related g |
| 241 | G1198 | NTU90214 | 1.00E−100 | Nicotiana tabacum | leucine zipper transcription factor TGA2. |
| 241 | G1198 | AF402608 | 1.00E−99 | Phaseolus vulgaris | TGA-type basic leucine zipper protein TG |
| 241 | G1198 | AX180962 | 9.00E−99 | Physcomitrella patens | Sequence 13 from Patent WO0145493. |
| 241 | G1198 | WHTHBP1BC1 | 5.00E−96 | Triticum aestivum | mRNA for transcription factor HBP-1b(c1 |
| 241 | G1198 | VFACREBL | 1.00E−90 | Vicia faba | CREB-like protein mRNA, complete cds. |
| 241 | G1198 | SOYSTGA | 2.00E−84 | Glycine max | TGACG-motif binding protein (STGA1) mRNA, compl |
| 241 | G1198 | BG645576 | 3.00E−82 | Medicago truncatula | EST507195 KV3 Medicago truncatula cDNA |
| 241 | G1198 | NICTGA1A | 3.00E−76 | Nicotiana sp. | Tobacco mRNA for TGA1a DNA-binding protein. |
| 241 | G1198 | gi2865394 | 4.20E−115 | Zea mays | basic leucine zipper protein. |
| 241 | G1198 | gi20161642 | 5.40E−96 | Oryza sativa (japonica cultivar-group) | putative basic leu |
| 241 | G1198 | gi17025918 | 9.80E−96 | Oryza sativa | bZIP transcription factor. |
| 241 | G1198 | gi12230709 | 3.30E−95 | Nicotiana tabacum | TGACG-SEQUENCE SPECIFIC DNA-BINDING PRO |
| 241 | G1198 | gi15148924 | 4.20E−95 | Phaseolus vulgaris | TGA-type basic leucine zipper protein |
| 241 | G1198 | gi1076782 | 1.00E−91 | Triticum aestivum | transcription factor HBP-1b(c1)-wheat |
| 241 | G1198 | gi7488719 | 1.60E−81 | Glycine max | transcription factor STGA1-soybean. |
| 241 | G1198 | gi19680 | 6.60E−74 | Nicotiana sp. | TGA1a protein (AA 1-359). |
| 241 | G1198 | gi100099 | 1.10E−73 | Vicia faba | DNA-binding protein VBP1-fava bean. |
| 241 | G1198 | gi13195751 | 3.30E−72 | Solanum tuberosum | mas-binding factor MBF3. |
| 243 | G1225 | BQ995023 | 4.00E−63 | Lactuca sativa | QGF8N12.yg.ab1 QG_EFGHJ lettuce serriola Lac |
| 243 | G1225 | BH683493 | 7.00E−49 | Brassica oleracea | BOMIX45TF BO_2_3_KB Brassica oleracea gen |
| 243 | G1225 | BI677665 | 3.00E−40 | Robinia pseudoacacia | CLS342 CLS (Cambium and bark region of |
| 243 | G1225 | CA803022 | 2.00E−39 | Glycine max | sau46b03.y1 Gm-c1071 Glycine max cDNA clone SOY |
| 243 | G1225 | BG590086 | 1.00E−34 | Solanum tuberosum | EST497928 P. infestans-challenged leaf So |
| 243 | G1225 | AP004213 | 7.00E−31 | Oryza sativa (japonica cultivar-group) | ( ) chromosome 8 clo |
| 243 | G1225 | BI310616 | 9.00E−31 | Medicago truncatula | EST5312366 GESD Medicago truncatula cDN |
| 243 | G1225 | CAR011013 | 1.00E−30 | Cicer arietinum | epicotyl EST, clone Can133. |
| 243 | G1225 | AAAA01002332 | 2.00E−29 | Oryza sativa (indica cultivar-group) | ( ) scaffold002332 |
| 243 | G1225 | AC098836 | 9.00E−29 | Oryza sativa | chromosome 5 clone OJ2097B11, *** SEQUENCING I |
| 243 | G1225 | gi24756878 | 4.50E−43 | Oryza sativa (japonica cultivar-group) | Unknown protein. |
| 243 | G1225 | gi3641870 | 3.50E−20 | Cicer arietinum | hypothetical protein. |
| 243 | G1225 | gi4321762 | 2.60E−10 | Zea mays | transcription factor MYC7E. |
| 243 | G1225 | gi12643064 | 1.10E−09 | Oryza sativa | putative MYC transcription factor. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 243 | G1225 | gi1142621 | 2.20E−09 | *Phaseolus vulgaris* | phaseolin G-box binding protein PG2. |
| 243 | G1225 | gi527663 | 3.60E−08 | *Tripsacum australe* | myc-like regulatory R gene product. |
| 243 | G1225 | gi527653 | 2.70E−07 | *Pennisetum glaucum* | myc-like regulatory R gene product. |
| 243 | G1225 | gi1086526 | 3.40E−07 | *Oryza australiensis* | transcriptional activator Ra homolog. |
| 243 | G1225 | gi1086528 | 4.80E−07 | *Oryza eichingeri* | transcriptional activator Ra homolog. |
| 243 | G1225 | gi10998404 | 6.40E−07 | *Petunia* x *hybrida* | anthocyanin 1. |
| 245 | G1226 | BH589494 | 1.00E−56 | *Brassica oleracea* | BOGIA17TR BOGI *Brassica oleracea* genomic |
| 245 | G1226 | BQ995023 | 1.00E−43 | *Lactuca sativa* | QGF8N12.yg.ab1 QG_EFGHJ lettuce serriola Lac |
| 245 | G1226 | BI677665 | 5.00E−42 | *Robinia pseudoacacia* | CLS342 CLS (Cambium and bark region of |
| 245 | G1226 | BE021887 | 5.00E−36 | *Glycine max* | sm63g05.y1 Gm-c1028 *Glycine max* cDNA clone GENO |
| 245 | G1226 | AP004213 | 1.00E−33 | *Oryza sativa (japonica cultivar-group)* | ( ) chromosome 8 clo |
| 245 | G1226 | AAAA01002332 | 9.00E−33 | *Oryza sativa (indica cultivar-group)* | ( ) scaffold002332 |
| 245 | G1226 | CAR011013 | 6.00E−32 | *Cicer arietinum* | epicotyl EST, clone Can133. |
| 245 | G1226 | BI480474 | 5.00E−31 | *Triticum aestivum* | WHE2903_F02_L03ZS Wheat aluminum-stressed |
| 245 | G1226 | BG452053 | 6.00E−28 | *Medicago truncatula* | NF077E11LF1F1087 Developing leaf Medica |
| 245 | G1226 | BG590086 | 2.00E−27 | *Solanum tuberosum* | EST497928 P. infestans-challenged leaf So |
| 245 | G1226 | gi19920107 | 2.20E−50 | *Oryza sativa (japonica cultivar-group)* | Putative helix-loo |
| 245 | G1226 | gi3641870 | 5.30E−33 | *Cicer arietinum* | hypothetical protein. |
| 245 | G1226 | gi1142621 | 4.90E−14 | *Phaseolus vulgaris* | phaseolin G-box binding protein PG2. |
| 245 | G1226 | gi4321762 | 1.10E−11 | *Zea mays* | transcription factor MYC7E. |
| 245 | G1226 | gi10998404 | 1.10E−10 | *Petunia* x *hybrida* | anthocyanin 1. |
| 245 | G1226 | gi3399777 | 4.20E−10 | *Glycine max* | symbiotic ammonium transporter; nodulin. |
| 245 | G1226 | gi12643064 | 2.00E−09 | *Oryza sativa* | putative MYC transcription factor. |
| 245 | G1226 | gi6175252 | 5.10E−09 | *Lycopersicon esculentum* | jasmonic acid 3. |
| 245 | G1226 | gi4206118 | 3.50E−08 | *Mesembryanthemum crystallinum* | transporter homolog. |
| 245 | G1226 | gi527657 | 5.50E−08 | *Pennisetum glaucum* | myc-like regulatory R gene product. |
| 247 | G1229 | BH473443 | 1.00E−96 | *Brassica oleracea* | BOHNJ20TR BOHN *Brassica oleracea* genomic |
| 247 | G1229 | AAAA01009795 | 4.00E−38 | *Oryza sativa (indica cultivar-group)* | ( ) scaffold009795 |
| 247 | G1229 | AP005470 | 6.00E−38 | *Oryza sativa (japonica cultivar-group)* | ( ) chromosome 6 clo |
| 247 | G1229 | AP003978 | 7.00E−37 | *Oryza sativa* | chromosome 2 clone OJ1014_E11, *** SEQUENCING |
| 247 | G1229 | BG590086 | 2.00E−20 | *Solanum tuberosum* | EST497928 P. infestans-challenged leaf So |
| 247 | G1229 | BI310616 | 3.00E−20 | *Medicago truncatula* | EST5312366 GESD *Medicago truncatula* cDN |
| 247 | G1229 | BG316255 | 6.00E−20 | *Glycine max* | sab78e02.y1 Gm-c1032 *Glycine max* cDNA clone GEN |
| 247 | G1229 | BQ995023 | 4.00E−19 | *Lactuca sativa* | QGF8N12.yg.ab1 QG_EFGHJ lettuce serriola Lac |
| 247 | G1229 | BE033916 | 2.00E−18 | *Mesembryanthemum crystallinum* | MG02A08 MG *Mesembryanthemum* c |
| 247 | G1229 | BU820988 | 8.00E−17 | *Populus tremula* | UB17CPF03 *Populus tremula* cambium cDNA libr |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 247 | G1229 | gi24756878 | 3.30E−31 | Oryza sativa (japonica cultivar-group) | Unknown protein. |
| 247 | G1229 | gi3641870 | 2.30E−21 | Cicer arietinum | hypothetical protein. |
| 247 | G1229 | gi1142621 | 1.80E−12 | Phaseolus vulgaris | phaseolin G-box binding protein PG2. |
| 247 | G1229 | gi1420924 | 3.90E−11 | Zea mays | IN1. |
| 247 | G1229 | gi12643064 | 4.50E−10 | Oryza sativa | putative MYC transcription factor. |
| 247 | G1229 | gi3399777 | 4.30E−09 | Glycine max | symbiotic ammonium transporter; nodulin. |
| 247 | G1229 | gi10998404 | 1.90E−08 | Petunia x hybrida | anthocyanin 1. |
| 247 | G1229 | gi527663 | 2.70E−08 | Tripsacum australe | myc-like regulatory R gene product. |
| 247 | G1229 | gi1086526 | 7.20E−08 | Oryza australiensis | transcriptional activator Ra homolog. |
| 247 | G1229 | gi527665 | 7.30E−08 | Sorghum bicolor | myc-like regulatory R gene product. |
| 249 | G1255 | BZ003641 | 3.00E−71 | Brassica oleracea | oeh85a08.g1 B. oleracea002 Brassica olerac |
| 249 | G1255 | AP004993 | 2.00E−67 | Oryza sativa (japonica cultivar-group) | ( ) chromosome 6 clo |
| 249 | G1255 | AAAA01023497 | 5.00E−45 | Oryza sativa (indica cultivar-group) | ( ) scaffold023497 |
| 249 | G1255 | BU007090 | 2.00E−37 | Lactuca sativa | QGH13F16.yg.ab1 QG_EFGHJ lettuce serriola La |
| 249 | G1255 | AC087181 | 1.00E−36 | Oryza sativa | chromosome 3 clone OSJNBa0018H01, *** SEQUENCI |
| 249 | G1255 | BG321336 | 7.00E−36 | Descurainia sophia | Ds01_06h10_A Ds01_AAFC_ECORC_cold_stress |
| 249 | G1255 | BG239774 | 1.00E−34 | Glycine max | sab74c03.y1 Gm-c1032 Glycine max cDNA clone GEN |
| 249 | G1255 | BQ139046 | 7.00E−33 | Medicago truncatula | NF010E05PH1F1036 Phoma-infected Medicag |
| 249 | G1255 | BQ489587 | 1.00E−31 | Beta vulgaris | 50-E9232-006-008-C14-T3 Sugar beet MPIZ-ADIS- |
| 249 | G1255 | AI772841 | 7.00E−31 | Lycopersicon esculentum | EST253941 tomato resistant, Cornell |
| 249 | G1255 | gi13702811 | 7.80E−32 | Oryza sativa | putative zinc finger protein. |
| 249 | G1255 | gi22854920 | 4.10E−22 | Brassica nigra | COL1 protein. |
| 249 | G1255 | gi2895188 | 6.20E−21 | Brassica napus | CONSTANS homolog. |
| 249 | G1255 | gi21667479 | 2.30E−19 | Hordeum vulgare | CONSTANS-like protein. |
| 249 | G1255 | gi23589949 | 3.60E−19 | Oryza sativa (japonica cultivar-group) | Hd1. |
| 249 | G1255 | gi4091804 | 4.00E−19 | Malus x domestica | CONSTANS-like protein 1. |
| 249 | G1255 | gi21655168 | 4.40E−19 | Hordeum vulgare subsp. vulgare | CONSTANS-like protein CO8. |
| 249 | G1255 | gi3341723 | 7.80E−19 | Raphanus sativus | CONSTANS-like 1 protein. |
| 249 | G1255 | gi10946337 | 9.40E−18 | Ipomoea nil | CONSTANS-like protein. |
| 249 | G1255 | gi4557093 | 6.00E−16 | Pinus radiata | zinc finger protein. |
| 251 | G1266 | BH460596 | 2.00E−91 | Brassica oleracea | BOGWG80TR BOGW Brassica oleracea genomic |
| 251 | G1266 | AF494201 | 1.00E−54 | Lycopersicon esculentum | transcription factor TSRF1 (TSRF1) |
| 251 | G1266 | NTU81157 | 2.00E−53 | Nicotiana tabacum | S25-XP1 DNA binding protein mRNA, complet |
| 251 | G1266 | BQ081329 | 8.00E−48 | Glycine max | san23a04.y1 Gm-c1084 Glycine max cDNA clone SOY |
| 251 | G1266 | BG449954 | 8.00E−45 | Medicago truncatula | NF013A10DT1F1081 Drought Medicago trunc |
| 251 | G1266 | BU896285 | 3.00E−43 | Populus tremula x Populus tremuloides | X038D06 Populus wood |
| 251 | G1266 | AI967551 | 9.00E−39 | Lotus japonicus | Ljirnpest05-400-d11 Ljirnp Lambda HybriZap |
| 251 | G1266 | AI055252 | 6.00E−36 | Gossypium hirsutum | coau0003H16 Cotton Boll Abscission Zone |
| 251 | G1266 | AAAA01000537 | 9.00E−36 | Oryza sativa (indica cultivar-group) | ( ) scaffold000537 |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 251 | G1266 | AC092263 | 9.00E−36 | Oryza sativa | chromosome 3 clone OSJNBa0033P04, *** SEQUENCI |
| 251 | G1266 | gi23452024 | 2.10E−54 | Lycopersicon esculentum | transcription factor TSRF1. |
| 251 | G1266 | gi1732406 | 1.00E−52 | Nicotiana tabacum | S25-XP1 DNA binding protein. |
| 251 | G1266 | gi19034045 | 8.10E−37 | Oryza sativa (japonica cultivar-group) | putative DNA bindi |
| 251 | G1266 | gi7528276 | 4.70E−29 | Mesembryanthemum crystallinum | AP2-related transcription f |
| 251 | G1266 | gi8809571 | 1.20E−26 | Nicotiana sylvestris | ethylene-responsive element binding |
| 251 | G1266 | gi17385636 | 1.80E−25 | Matricaria chamomilla | ethylene-responsive element binding |
| 251 | G1266 | gi8346775 | 1.00E−23 | Catharanthus roseus | AP2-domain DNA-binding protein. |
| 251 | G1266 | gi14140141 | 2.30E−23 | Oryza sativa | putative AP2-related transcription factor. |
| 251 | G1266 | gi21304712 | 1.30E−20 | Glycine max | ethylene-responsive element binding protein 1 |
| 251 | G1266 | gi24817250 | 4.30E−18 | Cicer arietinum | transcription factor EREBP-like protein. |
| 253 | G1275 | AF056948 | 9.00E−33 | Gossypium hirsutum | AF056948 Cotton drought tolerant genotyp |
| 253 | G1275 | BQ984602 | 2.00E−32 | Lactuca sativa | QGE3d01.yg.ab1 QG_EFGHJ lettuce serriola Lac |
| 253 | G1275 | BE216050 | 7.00E−32 | Hordeum vulgare | HV_CEb0009E04f Hordeum vulgare seedling gre |
| 253 | G1275 | AW565483 | 3.00E−31 | Sorghum bicolor | LG1_344_C03.g1_A002 Light Grown 1 (LG1) Sor |
| 253 | G1275 | BM064330 | 4.00E−31 | Capsicum annuum | KS01065H01 KS01 Capsicum annuum cDNA, mRNA |
| 253 | G1275 | BM334368 | 6.00E−31 | Zea mays | MEST136-B12.T3 ISUM5-RN Zea mays cDNA clone MEST13 |
| 253 | G1275 | BG525040 | 6.00E−31 | Stevia rebaudiana | 46-57 Stevia field grown leaf cDNA Stevia |
| 253 | G1275 | BE230596 | 1.00E−30 | Oryza sativa | 99AS81 Rice Seedling Lambda ZAPII cDNA Library |
| 253 | G1275 | BF009428 | 2.00E−30 | Glycine max | ss78f04.y1 Gm-c1064 Glycine max cDNA clone GENO |
| 253 | G1275 | BJ449458 | 2.00E−30 | Hordeum vulgare subsp. vulgare | BJ449458 K. Sato unpublished |
| 253 | G1275 | gi14588677 | 4.80E−31 | Oryza sativa | hypothetical protein. |
| 253 | G1275 | gi21644680 | 4.80E−31 | Oryza sativa (japonica cultivar-group) | hypothetical prote |
| 253 | G1275 | gi4894965 | 6.10E−24 | Avena sativa | DNA-binding protein WRKY1. |
| 253 | G1275 | gi14530683 | 2.30E−23 | Nicotiana tabacum | WRKY DNA-binding protein. |
| 253 | G1275 | gi1432056 | 3.80E−23 | Petroselinum crispum | WRKY3. |
| 253 | G1275 | gi18158619 | 5.40E−23 | Retama raetam | WRKY-like drought-induced protein. |
| 253 | G1275 | gi24745606 | 7.90E−23 | Solanum tuberosum | WRKY-type DNA binding protein. |
| 253 | G1275 | gi1076685 | 3.60E−22 | Ipomoea batatas | SPF1 protein-sweet potato. |
| 253 | G1275 | gi23305051 | 4.00E−22 | Oryza sativa (indica cultivar-group) | WRKY transcription f |
| 253 | G1275 | gi1159877 | 6.00E−22 | Avena fatua | DNA-binding protein. |
| 255 | G1305 | AW685439 | 9.00E−51 | Medicago truncatula | NF029D11NR1F1000 Nodulated root Medicag |
| 255 | G1305 | AB028649 | 6.00E−50 | Nicotiana tabacum | gene for myb-related transcription factor |
| 255 | G1305 | PHMYBPH22 | 1.00E−48 | Petunia x hybrida | P. Hybrida myb.Ph2 gene encoding protein |
| 255 | G1305 | AB073016 | 1.00E−48 | Vitis labrusca x Vitis vinifera | VlmybB1-1 gene for myb-rela |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 255 | G1305 | AB029160 | 4.00E−48 | *Glycine max* | gene for GmMYB291, complete cds. |
| 255 | G1305 | BQ514539 | 6.00E−47 | *Solanum tuberosum* | EST621954 Generation of a set of potato c |
| 255 | G1305 | AW032652 | 8.00E−47 | *Lycopersicon esculentum* | EST276211 tomato callus, TAMU Lycop |
| 255 | G1305 | OSMYB1202 | 1.00E−46 | *Oryza sativa* | *O. sativa* mRNA for myb factor, 1202 bp. |
| 255 | G1305 | BF201950 | 2.00E−45 | *Triticum aestivum* | WHE1759-1762_N04_N04ZS Wheat pre-anthesis |
| 255 | G1305 | AP004786 | 2.00E−44 | *Oryza sativa* (japonica cultivar-group) | ( ) chromosome 2 clo |
| 255 | G1305 | gi10140742 | 5.70E−51 | *Oryza sativa* | myb factor. |
| 255 | G1305 | gi20561 | 2.30E−50 | *Petunia* x *hybrida* | protein 2. |
| 255 | G1305 | gi5139814 | 3.70E−50 | *Glycine max* | GmMYB29B2. |
| 255 | G1305 | gi6552359 | 2.50E−49 | *Nicotiana tabacum* | myb-related transcription factor LBM1. |
| 255 | G1305 | gi22266673 | 3.70E−48 | *Vitis labrusca* x *Vitis vinifera* | myb-related transcription |
| 255 | G1305 | gi127580 | 8.90E−47 | *Zea mays* | MYB-RELATED PROTEIN ZM1. |
| 255 | G1305 | gi1370140 | 1.80E−46 | *Lycopersicon esculentum* | myb-related transcription factor. |
| 255 | G1305 | gi19548405 | 1.20E−44 | *Sorghum bicolor* | P-type R2R3 Myb protein. |
| 255 | G1305 | gi82308 | 8.20E−44 | *Antirrhinum majus* | myb protein 308-garden snapdragon. |
| 255 | G1305 | gi13346194 | 1.70E−43 | *Gossypium hirsutum* | GHMYB9. |
| 257 | G1322 | AI486576 | 4.00E−59 | *Lycopersicon esculentum* | EST244897 tomato ovary, TAMU Lycope |
| 257 | G1322 | PSMYB26 | 2.00E−58 | *Pisum sativum* | *P. sativum* mRNA for Myb-like protein (Myb26). |
| 257 | G1322 | BG457971 | 1.00E−55 | *Medicago truncatula* | NF037A10PL1F1070 Phosphate starved leaf |
| 257 | G1322 | BM528383 | 9.00E−54 | *Glycine max* | sa157f09.y1 Gm-c1061 *Glycine max* cDNA clone SOY |
| 257 | G1322 | BI978095 | 1.00E−53 | *Rosa chinensis* | pE09 Old Blush petal SMART library *Rosa chin* |
| 257 | G1322 | BQ106505 | 6.00E−53 | *Rosa* hybrid cultivar | fc0568.e Rose Petals (Fragrant Cloud) |
| 257 | G1322 | BQ584246 | 1.00E−51 | *Beta vulgaris* | E011860-024-003-F21-SP6 MPIZ-ADIS-024-inflore |
| 257 | G1322 | BU867210 | 5.00E−48 | *Populus tremula* x *Populus tremuloides* | S075F04 *Populus* imbib |
| 257 | G1322 | AB058642 | 6.00E−48 | *Lilium hybrid division I* | LhMyb mRNA, complete cds. |
| 257 | G1322 | CPU33917 | 7.00E−47 | *Craterostigma plantagineum* | myb-related transcription factor |
| 257 | G1322 | gi82306 | 2.90E−57 | *Antirrhinum majus* | myb protein 305-garden snapdragon. |
| 257 | G1322 | gi1841475 | 2.10E−52 | *Pisum sativum* | Myb26. |
| 257 | G1322 | gi1002796 | 5.40E−51 | *Craterostigma plantagineum* | Cpm10. |
| 257 | G1322 | gi13537530 | 4.70E−48 | *Lilium hybrid division I* | LhMyb. |
| 257 | G1322 | gi13177578 | 2.00E−47 | *Oryza sativa* | Myb transcription factor JAMyb. |
| 257 | G1322 | gi23476307 | 2.90E−46 | *Gossypioides kirkii* | myb-like transcription factor 5. |
| 257 | G1322 | gi14249015 | 4.70E−46 | *Gossypium hirsutum* | myb-like transcription factor Myb 5. |
| 257 | G1322 | gi23476303 | 4.70E−46 | *Gossypium raimondii* | myb-like transcription factor 2. |
| 257 | G1322 | gi24059885 | 6.20E−46 | *Oryza sativa* (japonica cultivar-group) | putative typical P |
| 257 | G1322 | gi19073328 | 8.00E−46 | *Sorghum bicolor* | typical P-type R2R3 Myb protein. |
| 259 | G1323 | BF644773 | 8.00E−54 | *Medicago truncatula* | NF020H12EC1F1103 Elicited cell culture |
| 259 | G1323 | OSMYB1202 | 2.00E−53 | *Oryza sativa* | *O. sativa* mRNA for myb factor, 1202 bp. |
| 259 | G1323 | AP004786 | 3.00E−53 | *Oryza sativa* (japonica cultivar-group) | ( ) chromosome 2 clo |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 259 | G1323 | AB028650 | 5.00E−53 | *Nicotiana tabacum* | mRNA for myb-related transcription factor |
| 259 | G1323 | AAAA01006126 | 4.00E−52 | *Oryza sativa* (*indica* cultivar-group) | ( ) scaffold006126 |
| 259 | G1323 | BF201950 | 7.00E−52 | *Triticum aestivum* | WHE1759-1762_N04_N04ZS Wheat pre-anthesis |
| 259 | G1323 | BG343209 | 100E−51 | *Hordeum vulgare* | HVSMEg0005B14f *Hordeum vulgare* pre-anthesis |
| 259 | G1323 | CA032540 | 100E−51 | *Hordeum vulgare* subsp. *vulgare* | HX13G05r HX *Hordeum vulgare* |
| 259 | G1323 | PHMYBPH22 | 100E−51 | *Petunia* x *hybrida* | *P. Hybrida* myb.Ph2 gene encoding protein |
| 259 | G1323 | AB029160 | 2.00E−51 | *Glycine max* | gene for GmMYB291, complete cds. |
| 259 | G1323 | gi6552361 | 1.30E−52 | *Nicotiana tabacum* | myb-related transcription factor LBM2. |
| 259 | G1323 | gi1946265 | 3.50E−52 | *Oryza sativa* | myb. |
| 259 | G1323 | gi5139802 | 4.00E−51 | *Glycine max* | GmMYB29A1. |
| 259 | G1323 | gi22266673 | 1.10E−50 | *Vitis labrusca* x *Vitis vinifera* | myb-related transcription |
| 259 | G1323 | gi1370140 | 1.40E−50 | *Lycopersicon esculentum* | myb-related transcription factor. |
| 259 | G1323 | gi20561 | 2.80E−50 | *Petunia* x *hybrida* | protein 2. |
| 259 | G1323 | gi127580 | 9.60E−50 | *Zea mays* | MYB-RELATED PROTEIN ZM1. |
| 259 | G1323 | gi19548405 | 1.20E−49 | *Sorghum bicolor* | P-type R2R3 Myb protein. |
| 259 | G1323 | gi22795039 | 7.70E−48 | *Populus* x *canescens* | putative MYB transcription factor. |
| 259 | G1323 | gi4886264 | 2.30E−46 | *Antirrhinum majus* | Myb-related transcription factor mixta- |
| 261 | G1330 | BU867210 | 5.00E−76 | *Populus tremula* x *Populus tremuloides* | S075F04 *Populus* imbib |
| 261 | G1330 | BQ583496 | 3.00E−75 | *Beta vulgaris* | E011979-024-005-N01-SP6 MPIZ-ADIS-024-inflore |
| 261 | G1330 | AF510112 | 1.00E−74 | *Craterostigma plantagineum* | MYB transcription factor (MYB10) |
| 261 | G1330 | AW032656 | 1.00E−73 | *Lycopersicon esculentum* | EST276215 tomato callus, TAMU Lycop |
| 261 | G1330 | AY026332 | 8.00E−71 | *Oryza sativa* | Myb transcription factor JAMyb mRNA, complete |
| 261 | G1330 | AF034133 | 2.00E−68 | *Gossypium hirsutum* | MYB-like DNA-binding domain protein (Cmy |
| 261 | G1330 | BJ233398 | 7.00E−67 | *Triticum aestivum* | BJ233398 Y. Ogihara unpublished cDNA libr |
| 261 | G1330 | BG607379 | 5.00E−66 | *Triticum monococcum* | WHE2471_H10_O19ZS *Triticum monococcum* e |
| 261 | G1330 | AAAA01002218 | 5.00E−65 | *Oryza sativa* (*indica* cultivar-group) | ( ) scaffold002218 |
| 261 | G1330 | BF325282 | 1.00E−64 | *Glycine max* | su20e03.y1 Gm-c1066 *Glycine max* cDNA clone GENO |
| 261 | G1330 | gi1002798 | 1.60E−70 | *Craterostigma plantagineum* | Cpm5. |
| 261 | G1330 | gi14249015 | 1.50E−69 | *Gossypium hirsutum* | myb-like transcription factor Myb 5. |
| 261 | G1330 | gi13177578 | 6.30E−69 | *Oryza sativa* | Myb transcription factor JAMyb. |
| 261 | G1330 | gi23476303 | 1.30E−68 | *Gossypium raimondii* | myb-like transcription factor 2. |
| 261 | G1330 | gi23476307 | 1.70E−68 | *Gossypioides kirkii* | myb-like transcription factor 5. |
| 261 | G1330 | gi23476305 | 5.70E−68 | *Gossypium herbaceum* | myb-like transcription factor 5. |
| 261 | G1330 | gi19073328 | 1.50E−67 | *Sorghum bicolor* | typical P-type R2R3 Myb protein. |
| 261 | G1330 | gi24059885 | 4.60E−66 | *Oryza sativa* (*japonica* cultivar-group) | putative typical P |
| 261 | G1330 | gi14970950 | 2.60E−63 | *Arabis gemmifera* | MYB transcription factor Atmyb2. |
| 261 | G1330 | gi14970952 | 9.90E−54 | *Crucihimalaya himalaica* | MYB transcription factor Atmyb2. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 263 | G1331 | BF644787 | 1.00E−65 | Medicago truncatula | NF016A03EC1F1020 Elicited cell culture |
| 263 | G1331 | BH663145 | 1.00E−48 | Brassica oleracea | BOMIM96TR BO_2_3_KB Brassica oleracea gen |
| 263 | G1331 | BE489186 | 4.00E−47 | Triticum aestivum | WHE1075_G04_M07ZS Wheat unstressed seedli |
| 263 | G1331 | PSMYB26 | 1.00E−44 | Pisum sativum | P. sativum mRNA for Myb-like protein (Myb26). |
| 263 | G1331 | BM527606 | 5.00E−43 | Glycine max | sa163g06.y1 Gm-c1061 Glycine max cDNA clone SOY |
| 263 | G1331 | BU013207 | 6.00E−43 | Lactuca sativa | QGJ4A09.yg.ab1 QG_EFGHJ lettuce serriola Lac |
| 263 | G1331 | BU991693 | 2.00E−42 | Hordeum vulgare | HD07K18r HD Hordeum vulgare cDNA clone HD07 |
| 263 | G1331 | BQ460434 | 2.00E−42 | Hordeum vulgare subsp. vulgare | HA09K10r HA Hordeum vulgare |
| 263 | G1331 | BQ106505 | 5.00E−42 | Rosa hybrid cultivar | fc0568.e Rose Petals (Fragrant Cloud) |
| 263 | G1331 | AI486576 | 5.00E−42 | Lycopersicon esculentum | EST244897 tomato ovary, TAMU Lycope |
| 263 | G1331 | gi1841475 | 2.80E−43 | Pisum sativum | Myb26. |
| 263 | G1331 | gi19073328 | 3.60E−43 | Sorghum bicolor | typical P-type R2R3 Myb protein. |
| 263 | G1331 | gi11275531 | 6.60E−42 | Oryza sativa | putative myb-related transcription factor. |
| 263 | G1331 | gi82306 | 1.10E−41 | Antirrhinum majus | myb protein 305-garden snapdragon. |
| 263 | G1331 | gi24059885 | 1.80E−41 | Oryza sativa (japonica cultivar-group) | putative typical P |
| 263 | G1331 | gi2921338 | 1.80E−41 | Gossypium hirsutum | MYB-like DNA-binding domain protein. |
| 263 | G1331 | gi1167486 | 2.50E−41 | Lycopersicon esculentum | transcription factor. |
| 263 | G1331 | gi23476303 | 3.70E−41 | Gossypium raimondii | myb-like transcription factor 2. |
| 263 | G1331 | gi13537530 | 7.60E−41 | Lilium hybrid division I | LhMyb. |
| 263 | G1331 | gi1002796 | 9.70E−41 | Craterostigma plantagineum | Cpm10. |
| 265 | G1332 | AF122054 | 5.00E−49 | Solanum tuberosum | clone 9 tuber-specific and sucrose-respon |
| 265 | G1332 | AW186273 | 2.00E−41 | Glycine max | se65f12.y1 Gm-c1019 Glycine max cDNA clone GENO |
| 265 | G1332 | AF336282 | 2.00E−41 | Gossypium hirsutum | GHMYB10 (ghmyb10) mRNA, complete cds. |
| 265 | G1332 | AF502295 | 4.00E−41 | Cucumis sativus | werewolf (WER) mRNA, partial cds. |
| 265 | G1332 | BG441912 | 7.00E−41 | Gossypium arboreum | GA_Ea0015B19f Gossypium arboreum 7-10 d |
| 265 | G1332 | BU891795 | 2.00E−40 | Populus tremula | P055C08 Populus petioles cDNA library Popul |
| 265 | G1332 | OSC1ACTIV | 3.00E−40 | Oryza sativa subsp. indica | Oryza sativa mRNA for transcrip |
| 265 | G1332 | AY135019 | 1.00E−39 | Zea mays | PL transcription factor (pl) mRNA, pl-W22 allele, |
| 265 | G1332 | BU827658 | 1.00E−39 | Populus tremula x Populus tremuloides | K006P59P Populus apic |
| 265 | G1332 | AW065119 | 2.00E−39 | Pinus taeda | ST39H05 Pine TriplEx shoot tip library Pinus ta |
| 265 | G1332 | gi9954118 | 6.70E−49 | Solanum tuberosum | tuber-specific and sucrose-responsive e |
| 265 | G1332 | gi13346186 | 1.40E−41 | Gossypium hirsutum | GHMYB10. |
| 265 | G1332 | gi20514371 | 3.70E−41 | Cucumis sativus | werewolf. |
| 265 | G1332 | gi309572 | 9.70E−41 | Zea mays | transcriptional activator. |
| 265 | G1332 | gi4138299 | 1.60E−40 | Oryza sativa subsp. indica | transcriptional activator. |
| 265 | G1332 | gi23476297 | 3.30E−40 | Gossypioides kirkii | myb-like transcription factor 3. |
| 265 | G1332 | gi14269333 | 5.40E−40 | Gossypium raimondii | myb-like transcription factor Myb 3. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 265 | G1332 | gi1101770 | 1.00E−38 | *Picea mariana* | MYB-like transcriptional factor MBF1. |
| 265 | G1332 | gi23476293 | 1.60E−38 | *Gossypium herbaceum* | myb-like transcription factor 2. |
| 265 | G1332 | gi15042120 | 2.10E−38 | *Zea luxurians* | CI protein. |
| 267 | G1363 | BH963585 | 1.00E−47 | *Brassica oleracea* | odd44e06.g1 *B. oleracea*002 *Brassica* olerac |
| 267 | G1363 | AY109469 | 3.00E−36 | *Zea mays* | CL724_1 mRNA sequence. |
| 267 | G1363 | OSRAPB | 2.00E−34 | *Oryza sativa* | mRNA RAPB protein. |
| 267 | G1363 | BU083572 | 1.00E−32 | *Glycine max* | sar22h11.y1 Gm-c1049 *Glycine max* cDNA clone SOY |
| 267 | G1363 | CA794711 | 2.00E−32 | *Theobroma cacao* | Cac_BL_1066 Cac_BL (Bean and Leaf from Amel |
| 267 | G1363 | BU987613 | 5.00E−30 | *Hordeum vulgare* subsp. *vulgare* | HF15E04r HF *Hordeum vulgare* |
| 267 | G1363 | BU672328 | 8.00E−29 | *Triticum aestivum* | WHE3303_C07_F13ZS Chinese Spring wheat dr |
| 267 | G1363 | BQ507104 | 1.00E−28 | *Solanum tuberosum* | EST614519 Generation of a set of potato c |
| 267 | G1363 | BG457624 | 4.00E−28 | *Medicago truncatula* | NF104F12PL1F1101 Phosphate starved leaf |
| 267 | G1363 | BJ479271 | 5.00E−28 | *Hordeum vulgare* subsp. *spontaneum* | BJ479271 K. Sato unpublis |
| 267 | G1363 | gi2826786 | 8.10E−37 | *Oryza sativa* | RAPB protein. |
| 267 | G1363 | gi7141243 | 8.50E−26 | *Vitis riparia* | transcription factor. |
| 267 | G1363 | gi4731314 | 7.10E−22 | *Nicotiana tabacum* | CCAAT-binding transcription factor subu |
| 267 | G1363 | gi1173616 | 9.00E−22 | *Brassica napus* | CCAAT-binding factor B subunit homolog. |
| 267 | G1363 | gi24414083 | 0.43 | *Oryza sativa* (*japonica* cultivar-group) | gag-pol-like prote |
| 267 | G1363 | gi4902535 | 0.57 | *Gossypium sturtianum* | microsomal omega6 desaturase enzyme. |
| 267 | G1363 | gi15187138 | 0.75 | *Gossypium anomalum* | microsomal omega6 desaturase FAD2-1. |
| 267 | G1363 | gi4902504 | 0.75 | *Gossypium cunninghamii* | microsomal omega6 desaturase enzym |
| 267 | G1363 | gi4902502 | 0.83 | *Gossypium costulatum* | microsomal omega6 desaturase enzyme. |
| 267 | G1363 | gi4902506 | 0.83 | *Gossypium enthyle* | microsomal omega6 desaturase enzyme. |
| 269 | G1411 | BZ017225 | 3.00E−51 | *Brassica oleracea* | oei67e03.b1 *B. oleracea*002 *Brassica* olerac |
| 269 | G1411 | BQ138607 | 8.00E−44 | *Medicago truncatula* | NF005C01PH1F1004 Phoma-infected Medicag |
| 269 | G1411 | BQ786702 | 5.00E−36 | *Glycine max* | saq72b07.y1 Gm-c1076 *Glycine max* cDNA clone SOY |
| 269 | G1411 | BM062508 | 7.00E−32 | *Capsicum annuum* | KS01043F09 KS01 *Capsicum annuum* cDNA, mRNA |
| 269 | G1411 | AAAA01000832 | 2.00E−30 | *Oryza sativa* (*indica* cultivar-group) | ( ) scaffold000832 |
| 269 | G1411 | OSJN00240 | 2.00E−30 | *Oryza sativa* | genomic DNA, chromosome 4, BAC clone: OSJNBa0 |
| 269 | G1411 | BE419451 | 2.00E−29 | *Triticum aestivum* | WWS012.C2R000101 ITEC WWS Wheat Scutellum |
| 269 | G1411 | CA014817 | 6.00E−29 | *Hordeum vulgare* subsp. *vulgare* | HT12H01r HT *Hordeum vulgare* |
| 269 | G1411 | BE642320 | 1.00E−28 | *Ceratopteris richardii* | Cri2_5_L17_SP6 *Ceratopteris* Spore Li |
| 269 | G1411 | BE494041 | 2.00E−27 | *Secale cereale* | WHE1277_B09_D17ZS *Secale cereale* anther cDNA |
| 269 | G1411 | gi20160854 | 1.40E−29 | *Oryza sativa* (*japonica* cultivar-group) | hypothetical prote |
| 269 | G1411 | gi14140141 | 1.50E−24 | *Oryza sativa* | putative AP2-related transcription factor. |
| 269 | G1411 | gi3342211 | 1.40E−23 | *Lycopersicon esculentum* | Pti4. |
| 269 | G1411 | gi10798644 | 2.30E−23 | *Nicotiana tabacum* | AP2 domain-containing transcription fac |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 269 | G1411 | gi8809571 | 2.30E−23 | Nicotiana sylvestris | ethylene-responsive element binding |
| 269 | G1411 | gi24817250 | 3.00E−23 | Cicer arietinum | transcription factor EREBP-like protein. |
| 269 | G1411 | gi3264767 | 3.00E−23 | Prunus armeniaca | AP2 domain containing protein. |
| 269 | G1411 | gi1688233 | 3.80E−23 | Solanum tuberosum | DNA binding protein homolog. |
| 269 | G1411 | gi7528276 | 3.80E−23 | Mesembryanthemum crystallinum | AP2-related transcription f |
| 269 | G1411 | gi21304712 | 6.20E−23 | Glycine max | ethylene-responsive element binding protein 1 |
| 271 | G1417 | CA782643 | 8.00E−58 | Glycine max | sat31e05.y1 Gm-c1056 Glycine max cDNA clone SOY |
| 271 | G1417 | AI895084 | 9.00E−57 | Lycopersicon esculentum | EST264527 tomato callus, TAMU Lycop |
| 271 | G1417 | BQ625082 | 3.00E−56 | Citrus sinensis | USDA-FP_02173 Ridge pineapple sweet orange |
| 271 | G1417 | AC120986 | 2.00E−54 | Oryza sativa (japonica cultivar-group) | ( ) chromosome 5 clo |
| 271 | G1417 | AAAA01004053 | 3.00E−54 | Oryza sativa (indica cultivar-group) | ( ) scaffold004053 |
| 271 | G1417 | BF636342 | 2.00E−53 | Medicago truncatula | NF088G12DT1F1099 Drought Medicago trunc |
| 271 | G1417 | BG838724 | 3.00E−50 | Glycine clandestina | Gc02_02f10_R Gc02_AAFC_ECORC_cold_stres |
| 271 | G1417 | AU083645 | 2.00E−47 | Cryptomeria japonica | AU083645 Cryptomeria japonica inner ba |
| 271 | G1417 | AP004967 | 6.00E−47 | Lotus japonicus | genomic DNA, chromosome 1, clone: LjT27L02, |
| 271 | G1417 | BU047549 | 1.00E−46 | Prunus persica | PP_LEa0030E11f Peach developing fruit mesoca |
| 271 | G1417 | gi8467950 | 4.80E−68 | Oryza sativa | Similar to Arabidopsis thaliana chromosome 4 |
| 271 | G1417 | gi20160973 | 2.40E−37 | Oryza sativa (japonica cultivar-group) | hypothetical prote |
| 271 | G1417 | gi6472585 | 7.70E−36 | Nicotiana tabacum | WIZZ. |
| 271 | G1417 | gi1159879 | 5.00E−35 | Avena fatua | DNA-binding protein. |
| 271 | G1417 | gi1193822 | 2.50E−30 | Petroselinum crispum | transcription factor WRKY4. |
| 271 | G1417 | gi3420906 | 1.80E−21 | Pimpinella brachycarpa | zinc finger protein; WRKY1. |
| 271 | G1417 | gi4894965 | 4.90E−20 | Avena sativa | DNA-binding protein WRKY1. |
| 271 | G1417 | gi18158619 | 2.80E−19 | Retama raetam | WRKY-like drought-induced protein. |
| 271 | G1417 | gi1076685 | 3.60E−19 | Ipomoea batatas | SPF1 protein-sweet potato. |
| 271 | G1417 | gi13620227 | 1.50E−18 | Lycopersicon esculentum | hypothetical protein. |
| 273 | G1419 | TOBBY4C | 6.00E−44 | Nicotiana tabacum | Tobacco mRNA for EREBP-4, complete cds. |
| 273 | G1419 | BU823955 | 5.00E−43 | Populus tremula | UB58DPE07 Populus tremula cambium cDNA libr |
| 273 | G1419 | AB016266 | 2.00E−42 | Nicotiana sylvestris | nserf4 gene for ethylene-responsive el |
| 273 | G1419 | BM062245 | 5.00E−42 | Capsicum annuum | KS01040C11 KS01 Capsicum annuum cDNA, mRNA |
| 273 | G1419 | AW507860 | 5.00E−40 | Glycine max | si45h05.y1 Gm-r1030 Glycine max cDNA clone GENO |
| 273 | G1419 | BG646774 | 5.00E−39 | Medicago truncatula | EST508393 HOGA Medicago truncatula cDNA |
| 273 | G1419 | AF204784 | 2.00E−38 | Lycopersicon esculentum | ripening regulated protein DDTFR10/ |
| 273 | G1419 | BQ514195 | 3.00E−38 | Solanum tuberosum | EST621610 Generation of a set of potato c |
| 273 | G1419 | CA812903 | 8.00E−35 | Vitis vinifera | CA48LU07IVF-D6 CA48LU Vitis vinifera cDNA cl |
| 273 | G1419 | BH683728 | 8.00E−35 | Brassica oleracea | BOHTE23TR BO_2_3_KB Brassica oleracea gen |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 273 | G1419 | gi1208497 | 1.40E−48 | Nicotiana tabacum | EREBP-4. |
| 273 | G1419 | gi8809575 | 9.80E−48 | Nicotiana sylvestris | ethylene-responsive element binding |
| 273 | G1419 | gi12231294 | 3.00E−39 | Lycopersicon esculentum | ripening regulated protein DDTFR1 |
| 273 | G1419 | gi7528276 | 1.60E−30 | Mesembryanthemum crystallinum | AP2-related transcription f |
| 273 | G1419 | gi12597874 | 6.80E−30 | Oryza sativa | putative ethylene-responsive element binding |
| 273 | G1419 | gi17385636 | 3.30E−24 | Matricaria chamomilla | ethylene-responsive element binding |
| 273 | G1419 | gi8980313 | 2.10E−23 | Catharanthus roseus | AP2-domain DNA-binding protein. |
| 273 | G1419 | gi15623863 | 3.00E−23 | Oryza sativa (japonica cultivar-group) | contains EST~hypot |
| 273 | G1419 | gi21304712 | 7.90E−23 | Glycine max | ethylene-responsive element binding protein 1 |
| 273 | G1419 | gi4099914 | 1.50E−21 | Stylosanthes hamata | ethylene-responsive element binding p |
| 275 | G1449 | BH939388 | 8.00E−43 | Brassica oleracea | odd83a03.g1 B. oleracea002 Brassica olerac |
| 275 | G1449 | BU927008 | 3.00E−34 | Glycine max | sas94e06.y1 Gm-c1036 Glycine max cDNA clone SOY |
| 275 | G1449 | PTR306827 | 5.00E−30 | Populus tremula x Populus tremuloides | mRNA for aux/IAA pro |
| 275 | G1449 | BF727992 | 3.00E−26 | Zea mays | 1000057B09.x4 1000-Unigene I from Maize Genome P |
| 275 | G1449 | BF649039 | 3.00E−22 | Medicago truncatula | NF051G11EC1F1086 Elicited cell culture |
| 275 | G1449 | BJ228821 | 3.00E−20 | Triticum aestivum | BJ228821 Y. Ogihara unpublished cDNA libr |
| 275 | G1449 | AB026823 | 6.00E−20 | Cucumis sativus | CS-IAA3 mRNA, partial cds. |
| 275 | G1449 | AB004933 | 2.00E−19 | Vigna radiata | mRNA for Aux22e, complete cds. |
| 275 | G1449 | BU992079 | 2.00E−19 | Hordeum vulgare | HD08M04r HD Hordeum vulgare cDNA clone HD08 |
| 275 | G1449 | BU889599 | 3.00E−19 | Populus tremula | P023B06 Populus petioles cDNA library Popul |
| 275 | G1449 | gi20269055 | 2.60E−31 | Populus tremula x Populus tremuloides | aux/IAA protein. |
| 275 | G1449 | gi8096369 | 4.50E−27 | Oryza sativa | ESTs D22686(C0916), C98167(C0916) correspond |
| 275 | G1449 | gi6136834 | 1.30E−22 | Cucumis sativus | CS-IAA3. |
| 275 | G1449 | gi4887022 | 7.60E−22 | Nicotiana tabacum | Nt-iaa4.1 deduced protein. |
| 275 | G1449 | gi11131105 | 3.90E−21 | Vigna radiata | AUXIN-INDUCED PROTEIN 22E (INDOLE-3-ACETIC |
| 275 | G1449 | gi1352057 | 1.00E−20 | Pisum sativum | AUXIN-INDUCED PROTEIN IAA4. |
| 275 | G1449 | gi18071490 | 1.30E−20 | Antirrhinum majus | auxin-induced AUX/IAA1. |
| 275 | G1449 | gi17976835 | 1.20E−19 | Pinus pinaster | putative auxin induced transcription facto |
| 275 | G1449 | gi2388689 | 1.50E−19 | Glycine max | GH1 protein. |
| 275 | G1449 | gi20257219 | 2.50E−19 | Zinnia elegans | auxin-regulated protein. |
| 277 | G1451 | AB071298 | 1.0e−999 | Oryza sativa | OsARF8 mRNA for auxin response factor 8, parti |
| 277 | G1451 | AY105215 | 1.00E−157 | Zea mays | PCO121637 mRNA sequence. |
| 277 | G1451 | AW690130 | 1.00E−109 | Medicago truncatula | NF028B12ST1F1000 Developing stem Medica |
| 277 | G1451 | BQ862285 | 1.00E−108 | Lactuca sativa | QGC20K23.yg.ab1 QG_ABCDI lettuce salinas Lac |
| 277 | G1451 | BG597435 | 1.00E−107 | Solanum tuberosum | EST496113 cSTS Solanum tuberosum cDNA clo |
| 277 | G1451 | BJ303602 | 1.00E−104 | Triticum aestivum | BJ303602 Y. Ogihara unpublished cDNA libr |
| 277 | G1451 | OSA306306 | 1.00E−103 | Oryza sativa (japonica cultivar-group) | Oryza sativa subsp. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 277 | G1451 | BQ595269 | 1.00E−89 | *Beta vulgaris* | E012710-024-023-D13-SP6 MPIZ-ADIS-024-develop |
| 277 | G1451 | CA801218 | 1.00E−86 | *Glycine max* | sau02f06.y2 Gm-c1062 *Glycine max* cDNA clone SOY |
| 277 | G1451 | BG159611 | 8.00E−79 | *Sorghum bicolor* | OV2_6_G07.b1_A002 Ovary 2 (OV2) *Sorghum* bic |
| 277 | G1451 | gi19352049 | 3.70E−247 | *Oryza sativa* | auxin response factor 8. |
| 277 | G1451 | gi20805236 | 3.10E−126 | *Oryza sativa* (japonica cultivar-group) | auxin response fac |
| 277 | G1451 | gi24785191 | 4.10E−55 | *Nicotiana tabacum* | hypothetical protein. |
| 277 | G1451 | gi23343944 | 2.40E−28 | *Mirabilis jalapa* | auxin-responsive factor protein. |
| 277 | G1451 | gi20269053 | 7.00E−10 | *Populus tremula* x *Populus tremuloides* | aux/IAA protein. |
| 277 | G1451 | gi287566 | 3.10E−06 | *Vigna radiata* | ORF. |
| 277 | G1451 | gi114733 | 1.10E−05 | *Glycine max* | AUXIN-INDUCED PROTEIN AUX22. |
| 277 | G1451 | gi871511 | 2.40E−05 | *Pisum sativum* | auxin-induced protein |
| 277 | G1451 | gi18697008 | 0.00027 | *Zea mays* | unnamed protein product. |
| 277 | G1451 | gi17976835 | 0.00068 | *Pinus pinaster* | putative auxin induced transcription facto |
| 279 | G1452 | BF645605 | 4.00E−65 | *Medicago truncatula* | NF017A10EC1F1072 Elicited cell culture |
| 279 | G1452 | BI140703 | 5.00E−43 | *Sorghum bicolor* | IP1_52_F12.b1_A002 Immature pannicle 1 (IP1 |
| 279 | G1452 | BQ469035 | 9.00E−43 | *Hordeum vulgare* | HM03C20r HM *Hordeum vulgare* cDNA clone HM03 |
| 279 | G1452 | BU967516 | 9.00E−43 | *Hordeum vulgare* subsp. *vulgare* | HB04I23r BC *Hordeum vulgare* |
| 279 | G1452 | BJ481205 | 9.00E−43 | *Hordeum vulgare* subsp. *spontaneum* | BJ481205 K. Sato unpublis |
| 279 | G1452 | BQ620568 | 2.00E−42 | *Triticum aestivum* | TaLr1142G07R TaLr1 *Triticum aestivum* cDNA |
| 279 | G1452 | AB028187 | 8.00E−42 | *Oryza sativa* | mRNA for OsNAC8 protein, complete cds. |
| 279 | G1452 | BQ997138 | 3.00E−41 | *Lactuca sativa* | QGG14N12.yg.ab1 QG_EFGHJ lettuce serriola La |
| 279 | G1452 | BG543974 | 4.00E−40 | *Brassica rapa* subsp. *pekinensis* | E1725 Chinese cabbage etiol |
| 279 | G1452 | AF509874 | 4.00E−40 | *Petunia* x *hybrida* | nam-like protein 11 (NH11) mRNA, complete |
| 279 | G1452 | gi6730946 | 1.10E−44 | *Oryza sativa* | OsNAC8 protein. |
| 279 | G1452 | gi21105746 | 9.50E−42 | *Petunia* x *hybrida* | nam-like protein 9. |
| 279 | G1452 | gi7716952 | 4.70E−41 | *Medicago truncatula* | NAC1. |
| 279 | G1452 | gi19225018 | 6.00E−41 | *Oryza sativa* (japonica cultivar-group) | putative NAM (no a |
| 279 | G1452 | gi22597158 | 4.30E−38 | *Glycine max* | no apical meristem-like protein. |
| 279 | G1452 | gi15148914 | 5.70E−36 | *Phaseolus vulgaris* | NAC domain protein NAC2. |
| 279 | G1452 | gi4218537 | 3.20E−35 | *Triticum* sp. | GRAB2 protein. |
| 279 | G1452 | gi6732160 | 3.20E−35 | *Triticum monococcum* | unnamed protein product. |
| 279 | G1452 | gi6175246 | 5.90E−34 | *Lycopersicon esculentum* | jasmonic acid 2. |
| 279 | G1452 | gi14485513 | 2.00E−33 | *Solanum tuberosum* | putative NAC domain protein. |
| 281 | G1463 | BH478066 | 2.00E−72 | *Brassica oleracea* | BOHQV38TR BOHQ *Brassica oleracea* genomic |
| 281 | G1463 | BE461560 | 1.00E−05 | *Lycopersicon esculentum* | EST412979 tomato breaker fruit, TIG |
| 281 | G1463 | AAAA01002994 | 1.00E−05 | *Oryza sativa* (indica cultivar-group) | ( ) scaffold002994 |
| 281 | G1463 | AP005621 | 1.00E−05 | *Oryza sativa* (japonica cultivar-group) | ( ) chromosome 6 clo |
| 281 | G1463 | OSJN01006 | 1.00E−05 | *Oryza sativa* | chromosome x clone OSJNBa0082A03, *** SEQUENC |
| 281 | G1463 | BQ852361 | 7.00E−05 | *Lactuca sativa* | QGB17N02.yg.ab1 QG_ABCDI lettuce salinas Lac |
| 281 | G1463 | BG440924 | 3.00E−04 | *Gossypium arboreum* | GA_Ea0010P20f *Gossypium arboreum* 7-10 d |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 281 | G1463 | BU763436 | 4.00E−04 | *Glycine max* | sas42e12.y1 Gm-c1080 *Glycine max* cDNA clone SOY |
| 281 | G1463 | BM406262 | 5.00E−04 | *Solanum tuberosum* | EST580589 potato roots *Solanum tuberosum* |
| 281 | G1463 | AI729055 | 0.002 | *Gossypium hirsutum* | BNLGHi12472 Six-day Cotton fiber Gossypi |
| 281 | G1463 | gi13129497 | 1.40E−07 | *Oryza sativa* | putative NAM (no apical meristem) protein. |
| 281 | G1463 | gi21389176 | 1.30E−06 | *Petunia* x *hybrida* | nam-like protein 19. |
| 281 | G1463 | gi22002150 | 7.70E−05 | *Oryza sativa* (*japonica* cultivar-group) | putative NAM (no a |
| 281 | G1463 | gi6175246 | 0.00012 | *Lycopersicon esculentum* | jasmonic acid 2. |
| 281 | G1463 | gi22597158 | 0.00056 | *Glycine max* | no apical meristem-like protein. |
| 281 | G1463 | gi6732156 | 0.013 | *Triticum monococcum* | unnamed protein product. |
| 281 | G1463 | gi15148912 | 0.02 | *Phaseolus vulgaris* | NAC domain protein NAC1. |
| 281 | G1463 | gi14485513 | 0.055 | *Solanum tuberosum* | putative NAC domain protein. |
| 281 | G1463 | gi2982275 | 0.063 | *Picea mariana* | ATAF1-like protein. |
| 281 | G1463 | gi4218537 | 0.09 | *Triticum* sp. | GRAB2 protein. |
| 283 | G1471 | BH512970 | 9.00E−14 | *Brassica oleracea* | BOHIV20TF BOHI *Brassica oleracea* genomic |
| 283 | G1471 | BZ374146 | 0.015 | *Zea mays* | ie21f07.g2 WGS-ZmaysF (DH5a methyl filtered) *Zea* m |
| 283 | G1471 | AI898615 | 0.02 | *Lycopersicon esculentum* | EST268058 tomato ovary, TAMU Lycope |
| 283 | G1471 | BG646742 | 0.02 | *Medicago truncatula* | EST508361 HOGA *Medicago truncatula* cDNA |
| 283 | G1471 | BI968516 | 0.026 | *Glycine max* | GM830005B12C03 Gm-r1083 *Glycine max* cDNA clone |
| 283 | G1471 | AP004754 | 0.026 | *Oryza sativa* (*japonica* cultivar-group) | ( ) chromosome 6 clo |
| 283 | G1471 | AAAA01022633 | 0.026 | *Oryza sativa* (*indica* cultivar-group) | ( ) scaffold022633 |
| 283 | G1471 | AB006606 | 0.034 | *Petunia* x *hybrida* | mRNA for ZPT4-4, complete cds. |
| 283 | G1471 | BU879483 | 0.058 | *Populus balsamifera* subsp. *trichocarpa* | V060G08 *Populus* flow |
| 283 | G1471 | BM359777 | 0.058 | *Gossypium arboreum* | GA_Ea0023K21r *Gossypium arboreum* 7-10 d |
| 283 | G1471 | gi439491 | 0.00043 | *Petunia* x *hybrida* | zinc-finger DNA binding protein. |
| 283 | G1471 | gi1763063 | 0.0094 | *Glycine max* | SCOF-1. |
| 283 | G1471 | gi15623820 | 0.012 | *Oryza sativa* | hypothetical protein. |
| 283 | G1471 | gi18390109 | 0.049 | *Sorghum bicolor* | putative zinc finger protein. |
| 283 | G1471 | gi2058504 | 0.074 | *Brassica rapa* | zinc-finger protein-1. |
| 283 | G1471 | gi7228329 | 0.095 | *Medicago sativa* | putative TFIIIA (or kruppel)-like zinc fi |
| 283 | G1471 | gi4666360 | 0.13 | *Datisca glomerata* | zinc-finger protein 1. |
| 283 | G1471 | gi18674684 | 0.14 | *Zea ramosa* | unnamed protein product. |
| 283 | G1471 | gi20804883 | 0.24 | *Oryza sativa* (*japonica* cultivar-group) | putative zinc fing |
| 283 | G1471 | gi2981169 | 0.39 | *Nicotiana tabacum* | osmotic stress-induced zinc-finger prot |
| 285 | G1478 | BH541785 | 8.00E−38 | *Brassica oleracea* | BOHPJ56TF BOHP *Brassica oleracea* genomic |
| 285 | G1478 | BI122215 | 4.00E−23 | *Populus tremula* x *Populus tremuloides* | I003P84P *Populus* leaf |
| 285 | G1478 | BF275913 | 5.00E−22 | *Gossypium arboreum* | GA_Eb0025C07f *Gossypium arboreum* 7-10 d |
| 285 | G1478 | CA814858 | 1.00E−21 | *Vitis vinifera* | CA12EI201IIbF_F05 Cabernet Sauvignon Leaf- |
| 285 | G1478 | BG157399 | 8.00E−20 | *Glycine max* | sab36g12.y1 Gm-c1026 *Glycine max* cDNA clone GEN |
| 285 | G1478 | CA798224 | 3.00E−15 | *Theobroma cacao* | Cac_BL_5512 Cac_BL (Bean and Leaf from Amel |
| 285 | G1478 | BU873581 | 6.00E−12 | *Populus balsamifera* subsp. *trichocarpa* | Q057B04 *Populus* flow |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 285 | G1478 | BU046688 | 2.00E−11 | *Prunus persica* | PP_LEa0027D08f Peach developing fruit mesoca |
| 285 | G1478 | C95300 | 8.00E−11 | *Citrus unshiu* | C95300 *Citrus unshiu* Miyagawa-wase maturation |
| 285 | G1478 | BQ594583 | 1.00E−10 | *Beta vulgaris* | E012444-024-024-P06-SP6 MPIZ-ADIS-024-develop |
| 285 | G1478 | gi2895188 | 1.10E−11 | *Brassica napus* | CONSTANS homolog. |
| 285 | G1478 | gi3618308 | 3.50E−10 | *Oryza sativa* | zinc finger protein. |
| 285 | G1478 | gi23495871 | 1.10E−09 | *Oryza sativa* (*japonica* cultivar-group) | putative zinc-fing |
| 285 | G1478 | gi11037308 | 1.10E−09 | *Brassica nigra* | constans-like protein. |
| 285 | G1478 | gi3341723 | 3.10E−09 | *Raphanus sativus* | CONSTANS-like 1 protein. |
| 285 | G1478 | gi4091806 | 3.60E−08 | *Malus x domestica* | CONSTANS-like protein 2. |
| 285 | G1478 | gi21655168 | 3.70E−08 | *Hordeum vulgare* subsp. *vulgare* | CONSTANS-like protein CO8. |
| 285 | G1478 | gi21667475 | 4.50E−08 | *Hordeum vulgare* | CONSTANS-like protein. |
| 285 | G1478 | gi10946337 | 7.20E−08 | *Ipomoea nil* | CONSTANS-like protein. |
| 285 | G1478 | gi4557093 | 3.30E−06 | *Pinus radiata* | zinc finger protein. |
| 287 | G1482 | BM406201 | 9.00E−61 | *Solanum tuberosum* | EST580528 potato roots *Solanum tuberosum* |
| 287 | G1482 | BF644868 | 1.00E−53 | *Medicago truncatula* | NF023D11EC1F1093 Elicited cell culture |
| 287 | G1482 | BI678186 | 9.00E−53 | *Robinia pseudoacacia* | CLS1114 CLS (Cambium and bark region o |
| 287 | G1482 | BM954087 | 4.00E−52 | *Glycine max* | sam70a09.y1 Gm-c1069 *Glycine max* cDNA clone SOY |
| 287 | G1482 | BI420251 | 1.00E−48 | *Lotus japonicus* | LjNEST54g9r *Lotus japonicus* nodule library |
| 287 | G1482 | AU288043 | 1.00E−45 | *Zinnia elegans* | AU288043 zinnia cultured mesophyll cell equa |
| 287 | G1482 | BU892726 | 2.00E−45 | *Populus tremula* | P068F06 *Populus* petioles cDNA library Popul |
| 287 | G1482 | BE432467 | 1.00E−44 | *Lycopersicon esculentum* | EST398996 tomato breaker fruit, TIG |
| 287 | G1482 | AB001884 | 4.00E−43 | *Oryza sativa* | mRNA for zinc finger protein, complete cds, |
| 287 | G1482 | BZ088073 | 6.00E−43 | *Brassica oleracea* | lla97a06.b1 *B. oleracea*002 *Brassica olerac* |
| 287 | G1482 | gi3618312 | 1.60E−45 | *Oryza sativa* | zinc finger protein. |
| 287 | G1482 | gi11037311 | 4.00E−18 | *Brassica nigra* | constans-like protein. |
| 287 | G1482 | gi3341723 | 6.50E−17 | *Raphanus sativus* | CONSTANS-like 1 protein. |
| 287 | G1482 | gi23589949 | 5.50E−16 | *Oryza sativa* (*japonica* cultivar-group) | Hd1. |
| 287 | G1482 | gi4091806 | 6.00E−15 | *Malus x domestica* | CONSTANS-like protein 2. |
| 287 | G1482 | gi10946337 | 1.60E−14 | *Ipomoea nil* | CONSTANS-like protein. |
| 287 | G1482 | gi2303681 | 2.10E−14 | *Brassica napus* | unnamed protein product. |
| 287 | G1482 | gi21667485 | 2.30E−13 | *Hordeum vulgare* | CONSTANS-like protein. |
| 287 | G1482 | gi21655154 | 1.20E−11 | *Hordeum vulgare* subsp. *vulgare* | CONSTANS-like protein CO5. |
| 287 | G1482 | gi4557093 | 2.50E−10 | *Pinus radiata* | zinc finger protein. |
| 289 | G1488 | BH447680 | 5.00E−83 | *Brassica oleracea* | BOHQJ20TR BOHQ *Brassica oleracea* genomic |
| 289 | G1488 | AP003376 | 7.00E−55 | *Oryza sativa* | chromosome 1 clone OSJNBa0014K08, *** SEQUENCI |
| 289 | G1488 | AAAA01003594 | 3.00E−54 | *Oryza sativa* (*indica* cultivar-group) | ( ) scaffold003594 |
| 289 | G1488 | AC132491 | 3.00E−54 | *Oryza sativa* (*japonica* cultivar-group) | ( ) chromosome 5 clo |
| 289 | G1488 | BQ851743 | 3.00E−49 | *Lactuca sativa* | QGB16C22.yg.ab1 QG_ABCDI lettuce salinas Lac |
| 289 | G1488 | BM113228 | 3.00E−49 | *Solanum tuberosum* | EST560764 potato roots *Solanum tuberosum* |
| 289 | G1488 | BU547281 | 2.00E−45 | *Glycine max* | GM880012B20D06 Gm-r1088 *Glycine max* cDNA clone |
| 289 | G1488 | BQ410000 | 3.00E−43 | *Gossypium arboreum* | GA_Ed0026H09r *Gossypium arboreum* 7-10 d |
| 289 | G1488 | CA600585 | 6.00E−38 | *Triticum aestivum* | waw1c.pk005.k20 waw1c *Triticum aestivum* c |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 289 | G1488 | AC136451 | 2.00E−36 | *Medicago truncatula* | clone mth2-17d19, WORKING DRAFT SEQUENC |
| 289 | G1488 | gi21902044 | 1.80E−48 | *Oryza sativa (japonica* cultivar-group) | hypothetical prote |
| 289 | G1488 | gi14165317 | 4.10E−42 | *Oryza sativa* | putative transcription factor. |
| 289 | G1488 | gi12711287 | 3.80E−30 | *Nicotiana tabacum* | GATA-1 zinc finger protein. |
| 289 | G1488 | gi1076609 | 5.60E−22 | *Nicotiana plumbaginifolia* | NTL1 protein-curled-leaved to |
| 289 | G1488 | gi14550106 | 0.85 | *Zea mays* | HD2 type histone deacetylase HDA106. |
| 289 | G1488 | gi21953514 | 0.98 | *Zea mays* subsp. *parviglumis* | ZAGL1. |
| 289 | G1488 | gi21953536 | 1 | *Zea mays* subsp. mays | ZAGL1. |
| 291 | G1494 | BH695524 | 1.00E−66 | *Brassica oleracea* | BOMMP13TF BO_2_3_KB *Brassica oleracea* gen |
| 291 | G1494 | BU866069 | 2.00E−47 | *Populus tremula* x *Populus tremuloides* | S062C11 *Populus* imbib |
| 291 | G1494 | BG591063 | 1.00E−37 | *Solanum tuberosum* | EST498905 P. infestans-challenged leaf So |
| 291 | G1494 | BF518953 | 2.00E−36 | *Medicago truncatula* | EST456346 DSIL *Medicago truncatula* cDNA |
| 291 | G1494 | BM411362 | 1.00E−35 | *Lycopersicon esculentum* | EST585689 tomato breaker fruit Lyco |
| 291 | G1494 | BE598711 | 5.00E−30 | *Sorghum bicolor* | PI1_81_D03.b1_A002 Pathogen induced 1 (PI1) |
| 291 | G1494 | BU574318 | 6.00E−30 | *Prunus dulcis* | PA_Ea0007A10f Almond developing seed *Prunus* |
| 291 | G1494 | CA008614 | 1.00E−29 | *Hordeum vulgare* subsp. *vulgare* | HU11I14r HU *Hordeum vulgare* |
| 291 | G1494 | BG041496 | 3.00E−29 | *Glycine max* | sv35a08.y1 Gm-c1057 *Glycine max* cDNA clone GENO |
| 291 | G1494 | BG052163 | 3.00E−27 | *Sorghum propinquum* | RHIZ2_6_H10.b1_A003 Rhizome2 (RHIZ2) Sor |
| 291 | G1494 | gi23495742 | 1.90E−39 | *Oryza sativa (japonica* cultivar-group) | putative phytochro |
| 291 | G1494 | gi13486760 | 4.50E−25 | *Oryza sativa* | hypothetical protein. |
| 291 | G1494 | gi5923912 | 2.00E−10 | *Tulipa gesneriana* | bHLH transcription factor GBOF-1. |
| 291 | G1494 | gi1086538 | 2.30E−09 | *Oryza rufipogon* | transcriptional activator Rb homolog. |
| 291 | G1494 | gi527657 | 1.00E−08 | *Pennisetum glaucum* | myc-like regulatory R gene product. |
| 291 | G1494 | gi527665 | 3.60E−08 | *Sorghum bicolor* | myc-like regulatory R gene product. |
| 291 | G1494 | gi527661 | 7.60E−08 | *Phyllostachys acuta* | myc-like regulatory R gene product. |
| 291 | G1494 | gi1086534 | 4.40E−07 | *Oryza officinalis* | transcriptional activator Ra homolog. |
| 291 | G1494 | gi527663 | 4.40E−07 | *Tripsacum australe* | myc-like regulatory R gene product. |
| 291 | G1494 | gi1142621 | 4.80E−07 | *Phaseolus vulgaris* | phaseolin G-box binding protein PG2. |
| 293 | G1496 | BZ007786 | 2.00E−64 | *Brassica oleracea* | oed22d06.g1 B. oleracea002 *Brassica olerac* |
| 293 | G1496 | BQ875608 | 3.00E−41 | *Lactuca sativa* | QGI8J14.yg.ab1 QG_ABCDI lettuce salinas Lact |
| 293 | G1496 | BU081702 | 2.00E−40 | *Glycine max* | saq98c07.y1 Gm-c1049 *Glycine max* cDNA clone SOY |
| 293 | G1496 | CA525194 | 3.00E−37 | *Capsicum annuum* | KS12050G08 KS12 *Capsicum annuum* cDNA, mRNA |
| 293 | G1496 | BU791131 | 1.00E−36 | *Populus balsamifera* subsp. *trichocarpa* x *Populus deltoides* | |
| 293 | G1496 | AW906522 | 2.00E−34 | *Solanum tuberosum* | EST342644 potato stolon, Cornell Universi |
| 293 | G1496 | BF273293 | 2.00E−34 | *Gossypium arboreum* | GA_Eb0017H08f *Gossypium arboreum* 7-10 d |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 293 | G1496 | BJ267378 | 6.00E−34 | Triticum aestivum | BJ267378 Y. Ogihara unpublished cDNA libr |
| 293 | G1496 | BM497415 | 4.00E−33 | Avicennia marina | 901269 Avicennia marina leaf cDNA Library |
| 293 | G1496 | CA003238 | 1.00E−32 | Hordeum vulgare subsp. vulgare | HS09N06r HS Hordeum vulgare |
| 293 | G1496 | gi20804997 | 5.10E−35 | Oryza sativa (japonica cultivar-group) | DNA-binding protei |
| 293 | G1496 | gi11862964 | 9.50E−35 | Oryza sativa | hypothetical protein. |
| 293 | G1496 | gi5923912 | 7.00E−31 | Tulipa gesneriana | bHLH transcription factor GBOF-1. |
| 293 | G1496 | gi6166283 | 1.70E−10 | Pinus taeda | helix-loop-helix protein 1A. |
| 293 | G1496 | gi527655 | 2.00E−05 | Pennisetum glaucum | myc-like regulatory R gene product. |
| 293 | G1496 | gi527665 | 2.90E−05 | Sorghum bicolor | myc-like regulatory R gene product. |
| 293 | G1496 | gi527661 | 5.50E−05 | Phyllostachys acuta | myc-like regulatory R gene product. |
| 293 | G1496 | gi1086538 | 0.00019 | Oryza rufipogon | transcriptional activator Rb homolog. |
| 293 | G1496 | gi4206118 | 0.00024 | Mesembryanthemum crystallinum | transporter homolog. |
| 293 | G1496 | gi3399777 | 0.00025 | Glycine max | symbiotic ammonium transporter; nodulin. |
| 295 | G1499 | AT002234 | 1.00E−53 | Brassica rapa subsp. pekinensis | AT002234 Flower bud cDNA Br |
| 295 | G1499 | AP004462 | 1.00E−46 | Oryza sativa (japonica cultivar-group) | ( ) chromosome 8 clo |
| 295 | G1499 | AAAA01003354 | 1.00E−46 | Oryza sativa (indica cultivar-group) | ( ) scaffold003354 |
| 295 | G1499 | BH775806 | 1.00E−39 | Zea mays | fzmb011f018c05f1 fzmb filtered library Zea mays ge |
| 295 | G1499 | BH700922 | 4.00E−35 | Brassica oleracea | BOMMZ07TR BO_2_3_KB Brassica oleracea gen |
| 295 | G1499 | AP004693 | 1.00E−34 | Oryza sativa | chromosome 8 clone P0461F06, *** SEQUENCING IN |
| 295 | G1499 | AW832545 | 5.00E−34 | Glycine max | sm12e10.y1 Gm-c1027 Glycine max cDNA clone GENO |
| 295 | G1499 | BE451174 | 1.00E−32 | Lycopersicon esculentum | EST402062 tomato root, plants pre-a |
| 295 | G1499 | BF263465 | 4.00E−25 | Hordeum vulgare | HV_CEa0006N02f Hordeum vulgare seedling gre |
| 295 | G1499 | BG557011 | 5.00E−22 | Sorghum bicolor | EM1_41_E02.g1_A002 Embryo 1 (EM1) Sorghum b |
| 295 | G1499 | gi15528743 | 2.50E−30 | Oryza sativa | contains EST C74560(E31855)~unknown protein. |
| 295 | G1499 | gi19571105 | 2.80E−27 | Oryza sativa (japonica cultivar-group) | hypothetical prote |
| 295 | G1499 | gi11045087 | 1.10E−08 | Brassica napus | putative protein. |
| 295 | G1499 | gi3127045 | 6.20E−08 | Petunia x hybrida | bHLH transcription factor JAF13. |
| 295 | G1499 | gi1086538 | 1.30E−07 | Oryza rufipogon | transcriptional activator Rb homolog. |
| 295 | G1499 | gi6166283 | 1.60E−07 | Pinus taeda | helix-loop-helix protein 1A. |
| 295 | G1499 | gi5923912 | 1.00E−06 | Tulipa gesneriana | bHLH transcription factor GBOF-1. |
| 295 | G1499 | gi5669656 | 1.10E−06 | Lycopersicon esculentum | ER33 protein. |
| 295 | G1499 | gi527665 | 1.40E−06 | Sorghum bicolor | myc-like regulatory R gene product. |
| 295 | G1499 | gi1086534 | 3.10E−06 | Oryza officinalis | transcriptional activator Ra homolog. |
| 297 | G1519 | AY107434 | 1.00E−131 | Zea mays | PCO110680 mRNA sequence. |
| 297 | G1519 | BQ579759 | 4.00E−68 | Triticum aestivum | WHE2974_B12_D24ZS Wheat dormant embryo cD |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 297 | G1519 | BQ851827 | 3.00E−66 | *Lactuca sativa* | QGB16G12.yg.ab1 QG_ABCDI lettuce salinas Lac |
| 297 | G1519 | BM094986 | 2.00E−61 | *Glycine max* | saj24f10.y1 Gm-c1066 *Glycine max* cDNA clone GEN |
| 297 | G1519 | BE354396 | 3.00E−54 | *Lycopersicon esculentum* | EST355739 tomato flower buds, anthe |
| 297 | G1519 | AW618704 | 7.00E−52 | *Lycopersicon pennellii* | EST320690 *L. pennellii* trichome, Cor |
| 297 | G1519 | BF004323 | 4.00E−50 | *Medicago truncatula* | EST432821 KV1 *Medicago truncatula* cDNA |
| 297 | G1519 | BU833376 | 2.00E−49 | *Populus tremula* x *Populus tremuloides* | T047C03 *Populus* apica |
| 297 | G1519 | AJ470209 | 3.00E−45 | *Hordeum vulgare* | AJ470209 S00008 *Hordeum vulgare* cDNA clone |
| 297 | G1519 | BF053939 | 2.00E−43 | *Solanum tuberosum* | EST439169 potato leaves and petioles Sola |
| 297 | G1519 | gi14192879 | 1.00E−88 | *Oryza sativa* | Putative zinc-binding peroxisomal integral m |
| 297 | G1519 | gi22535577 | 8.90E−08 | *Oryza sativa* (*japonica* cultivar-group) | hypothetical prote |
| 297 | G1519 | gi22795037 | 4.30E−07 | *Populus* x *canescens* | putative RING protein. |
| 297 | G1519 | gi9294812 | 0.0026 | *Medicago truncatula* | MTD2. |
| 297 | G1519 | gi18129286 | 0.0028 | *Pinus pinaster* | putative RING zinc finger protein. |
| 297 | G1519 | gi4090943 | 0.0029 | *Lycopersicon esculentum* | COP1 homolog. |
| 297 | G1519 | gi22775495 | 0.0095 | *Arabis gemmifera* | similar to *A. thaliana* AT4g08590. |
| 297 | G1519 | gi20340241 | 0.021 | *Thellungiella halophila* | putative RING zinc finger protein |
| 297 | G1519 | gi1694900 | 0.022 | *Pisum sativum* | Cop1 protein. |
| 297 | G1519 | gi7592844 | 0.029 | *Oryza sativa* subsp. *japonica* | COP1. |
| 299 | G1526 | AAAA01000691 | 1.00E−103 | *Oryza sativa* (*indica* cultivar-group) | ( ) scaffold000691 |
| 299 | G1526 | BG599126 | 1.00E−101 | *Solanum tuberosum* | EST504026 cSTS *Solanum tuberosum* cDNA clo |
| 299 | G1526 | BI098460 | 7.00E−94 | *Sorghum bicolor* | IP1_32_F12.b1_A002 Immature pannicle 1 (IP1 |
| 299 | G1526 | AY110582 | 4.00E−74 | *Zea mays* | CL19105_1 mRNA sequence. |
| 299 | G1526 | AJ468417 | 8.00E−69 | *Hordeum vulgare* | AJ468417 S00008 *Hordeum vulgare* cDNA clone |
| 299 | G1526 | AL819754 | 9.00E−68 | *Triticum aestivum* | AL819754 n: 129 *Triticum aestivum* cDNA clo |
| 299 | G1526 | AW011575 | 2.00E−66 | *Pinus taeda* | ST22D10 Pine TriplEx shoot tip library *Pinus* ta |
| 299 | G1526 | AW704900 | 6.00E−63 | *Glycine max* | sk40h12.y1 GM-c1019 *Glycine max* cDNA clone GENO |
| 299 | G1526 | AP004879 | 4.00E−60 | *Oryza sativa* (*japonica* cultivar-group) | ( ) chromosome 2 clo |
| 299 | G1526 | BQ589890 | 1.00E−57 | *Beta vulgaris* | S015141-024-019-P15-SP6 MPIZ-ADIS-024-storage |
| 299 | G1526 | gi23237908 | 4.20E−115 | *Oryza sativa* (*japonica* cultivar-group) | helicase-like tran |
| 299 | G1526 | gi15289872 | 5.60E−80 | *Oryza sativa* | putative helicase-like transcription factor. |
| 299 | G1526 | gi18463957 | 1.90E−42 | *Zea mays* | chromatin complex subunit A101. |
| 299 | G1526 | gi23193481 | 8.70E−32 | *Hordeum vulgare* | SNF2P. |
| 299 | G1526 | gi23193487 | 9.70E−32 | *Triticum monococcum* | SNF2P. |
| 299 | G1526 | gi23193479 | 2.50E−30 | *Hordeum vulgare* subsp. *vulgare* | SNF2P. |
| 299 | G1526 | gi15029364 | 0.0012 | *Rosa hybrid* cultivar | photoregulatory zinc-finger protein |
| 299 | G1526 | gi1694900 | 0.0052 | *Pisum sativum* | Cop1 protein. |
| 299 | G1526 | gi7592844 | 0.011 | *Oryza sativa* subsp. *japonica* | COP1. |
| 299 | G1526 | gi4090943 | 0.014 | *Lycopersicon esculentum* | COP1 homolog. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 301 | G1540 | BZ081838 | 4.00E−70 | Brassica oleracea | 11f51h03.g1 B. oleracea002 Brassica olerac |
| 301 | G1540 | AF481951 | 7.00E−41 | Petunia × hybrida | wuschel protein (WUS) mRNA, complete cds. |
| 301 | G1540 | AAAA01000169 | 2.00E−28 | Oryza sativa (indica cultivar-group) | ( ) scaffold000169 |
| 301 | G1540 | OSJN00127 | 2.00E−28 | Oryza sativa | chromosome 4 clone OSJNBA0084K01, *** SEQUENC |
| 301 | G1540 | AX105289 | 2.00E−26 | Zea mays | Sequence 7 from Patent WO0123575. |
| 301 | G1540 | AC137078 | 2.00E−21 | Medicago truncatula | clone mth2-10e12, WORKING DRAFT SEQUENC |
| 301 | G1540 | BI204369 | 5.00E−20 | Lycopersicon esculentum | EST522409 cTOS Lycopersicon esculen |
| 301 | G1540 | CNS08CDT | 1.00E−19 | Oryza sativa (japonica cultivar-group) | ( ) chromosome 12 cl |
| 301 | G1540 | BU006325 | 2.00E−19 | Lactuca sativa | QGH10L09.yg.ab1 QG_EFGHJ lettuce serriola La |
| 301 | G1540 | AF322401 | 3.00E−19 | Vigna radiata | clone LR129 microsatellite sequence. |
| 301 | G1540 | gi22087128 | 5.10E−35 | Petunia × hybrida | wuschel protein. |
| 301 | G1540 | gi8099120 | 3.90E−21 | Oryza sativa | similar to a putative homeodomain transcript |
| 301 | G1540 | gi21104626 | 6.40E−21 | Oryza sativa (japonica cultivar-group) | hypothetical prote |
| 301 | G1540 | gi3955021 | 1.80E−09 | Populus tremula × Populus tremuloides | HB2 homeodomain pro |
| 301 | G1540 | gi18419580 | 0.00033 | Narcissus pseudonarcissus | putative homeobox-containing pr |
| 301 | G1540 | gi3868829 | 0.0014 | Ceratopteris richardii | CRHB1. |
| 301 | G1540 | gi24417147 | 0.0024 | Zinnia elegans | homeobox leucine-zipper protein. |
| 301 | G1540 | gi7209912 | 0.14 | Physcomitrella patens | homeobox protein PpHB10. |
| 301 | G1540 | gi13365610 | 0.74 | Pisum sativum | SCARECROW. |
| 301 | G1540 | gi1160484 | 0.94 | Pimpinella brachycarpa | homeobox-leucine zipper protein. |
| 303 | G1543 | AF145727 | 4.00E−51 | Oryza sativa | homeodomain leucine zipper protein (hox3) mRNA |
| 303 | G1543 | CA030381 | 6.00E−41 | Hordeum vulgare subsp. vulgare | HX06O07r HX Hordeum vulgare |
| 303 | G1543 | BQ741095 | 6.00E−39 | Glycine max | saq14c10.y1 Gm-c1045 Glycine max cDNA clone SOY |
| 303 | G1543 | AT002118 | 1.00E−38 | Brassica rapa subsp. pekinensis | AT002118 Flower bud cDNA Br |
| 303 | G1543 | BQ857226 | 2.00E−37 | Lactuca sativa | QGB6P03.yg.ab1 QG_ABCDI lettuce salinas Lact |
| 303 | G1543 | AB028075 | 4.00E−37 | Physcomitrella patens | mRNA for homeobox protein PpHB4, comp |
| 303 | G1543 | PBPHZ4GEN | 4.00E−37 | Pimpinella brachycarpa | P. brachycarpa mRNA for homeobox-leu |
| 303 | G1543 | LEHDZIPP | 5.00E−37 | Lycopersicon esculentum | L. esculentum mRNA for HD-ZIP protei |
| 303 | G1543 | AF443619 | 1.00E−36 | Craterostigma plantagineum | homeodomain leucine zipper prote |
| 303 | G1543 | AJ498394 | 2.00E−36 | Medicago truncatula | AJ498394 MTPOSE Medicago truncatula cDN |
| 303 | G1543 | gi5006851 | 8.30E−51 | Oryza sativa | homeodomain leucine zipper protein. |
| 303 | G1543 | gi20161555 | 1.70E−50 | Oryza sativa (japonica cultivar-group) | putative homeodoma |
| 303 | G1543 | gi18034437 | 1.60E−38 | Craterostigma plantagineum | homeodomain leucine zipper pro |
| 303 | G1543 | gi1149535 | 4.30E−38 | Pimpinella brachycarpa | homeobox-leucine zipper protein. |
| 303 | G1543 | gi992598 | 1.20E−37 | Lycopersicon esculentum | HP-ZIP protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 303 | G1543 | gi7415620 | 1.50E−37 | *Physcomitrella patens* | homeobox protein PpHB4. |
| 303 | G1543 | gi1234900 | 3.10E−37 | *Glycine max* | homeobox-leucine zipper protein. |
| 303 | G1543 | gi3868847 | 1.90E−35 | *Ceratopteris richardii* | CRHB10. |
| 303 | G1543 | gi8919876 | 1.90E−35 | *Capsella rubella* | hypothetical protein. |
| 303 | G1543 | gi1032372 | 3.20E−35 | *Helianthus annuus* | homeodomain protein. |
| 305 | G1634 | AW164275 | 6.00E−63 | *Glycine max* | se70d01.y1 Gm-c1023 *Glycine max* cDNA clone GENO |
| 305 | G1634 | AF239956 | 3.00E−60 | *Hevea brasiliensis* | unknown mRNA. |
| 305 | G1634 | BQ115848 | 9.00E−58 | *Solanum tuberosum* | EST601424 mixed potato tissues *Solanum* tu |
| 305 | G1634 | AW220831 | 5.00E−53 | *Lycopersicon esculentum* | EST297300 tomato fruit mature green |
| 305 | G1634 | BQ992139 | 9.00E−53 | *Lactuca sativa* | QGF24M24.yg.ab1 QG_EFGHJ lettuce serriola La |
| 305 | G1634 | BG525326 | 3.00E−46 | *Stevia rebaudiana* | 48-70 *Stevia* field grown leaf cDNA *Stevia* |
| 305 | G1634 | BE319813 | 2.00E−45 | *Medicago truncatula* | NF022C09RT1F1066 Developing root Medica |
| 305 | G1634 | AP003279 | 3.00E−45 | *Oryza sativa* | chromosome 1 clone P0529E05, *** SEQUENCING IN |
| 305 | G1634 | AAAA01017329 | 3.00E−45 | *Oryza sativa* (indica cultivar-group) | ( ) scaffold017329 |
| 305 | G1634 | AC130612 | 3.00E−45 | *Oryza sativa* (japonica cultivar-group) | ( ) chromosome 5 clo |
| 305 | G1634 | gi12005328 | 7.40E−59 | *Hevea brasiliensis* | unknown. |
| 305 | G1634 | gi18874263 | 1.10E−55 | *Antirrhinum majus* | MYB-like transcription factor DIVARICAT |
| 305 | G1634 | gi18461206 | 2.80E−50 | *Oryza sativa* (japonica cultivar-group) | contains ESTs AU10 |
| 305 | G1634 | gi10798825 | 2.10E−45 | *Oryza sativa* | putative myb-related transcription activator |
| 305 | G1634 | gi19911579 | 6.60E−42 | *Glycine max* | syringolide-induced protein 1-3-1B. |
| 305 | G1634 | gi15209176 | 2.00E−41 | *Solanum demissum* | putative I-box binding factor. |
| 305 | G1634 | gi6688529 | 2.30E−39 | *Lycopersicon esculentum* | I-box binding factor. |
| 305 | G1634 | gi12406995 | 3.30E−24 | *Hordeum vulgare* | MCB2 protein. |
| 305 | G1634 | gi7705206 | 2.30E−23 | *Solanum tuberosum* | MybSt1. |
| 305 | G1634 | gi20067661 | 3.40E−18 | *Zea mays* | one repeat myb transcriptional factor. |
| 307 | G1637 | BZ0113S1 | 4.00E−81 | *Brassica oleracea* | oed23f03.b1 *B. oleracea*002 *Brassica* olerac |
| 307 | G1637 | BE033910 | 3.00E−42 | *Mesembryanthemum crystallinum* | MG01H12 MG *Mesembryanthemum* c |
| 307 | G1637 | AY151044 | 9.00E−39 | *Oryza sativa* (japonica cultivar-group) | ( ) transcription fa |
| 307 | G1637 | BU832707 | 2.00E−38 | *Populus tremula* x *Populus tremuloides* | T037C12 *Populus* apica |
| 307 | G1637 | CA728673 | 3.00E−38 | *Triticum aestivum* | wdi1c.pk004.124 wdi1c *Triticum aestivum* c |
| 307 | G1637 | BG454685 | 1.00E−37 | *Medicago truncatula* | NF102F10LF1F1080 Developing leaf Medica |
| 307 | G1637 | CA799375 | 1.00E−37 | *Glycine max* | sat32h04.y1 Gm-c1056 *Glycine max* cDNA clone SOY |
| 307 | G1637 | BJ472691 | 2.00E−37 | *Hordeum vulgare* subsp. *vulgare* | BJ472691 K. Sato unpublished |
| 307 | G1637 | CA813590 | 3.00E−37 | *Vitis vinifera* | CA48LU10IVF-G11 CA48LU *Vitis vinifera* cDNA c |
| 307 | G1637 | BQ114109 | 8.00E−37 | *Solanum tuberosum* | EST599685 mixed potato tissues *Solanum* tu |
| 307 | G1637 | gi13569996 | 1.10E−39 | *Oryza sativa* | putative Myb-related protein. |
| 307 | G1637 | gi24850307 | 2.30E−39 | *Oryza sativa* (japonica cultivar-group) | transcription fact |
| 307 | G1637 | gi1076660 | 1.70E−36 | *Solanum tuberosum* | D13F(MYBST1) protein-potato. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 307 | G1637 | gi12406993 | 8.90E−31 | Hordeum vulgare | MCB1 protein. |
| 307 | G1637 | gi12005328 | 3.60E−27 | Hevea brasiliensis | unknown. |
| 307 | G1637 | gi18874263 | 2.50E−26 | Antirrhinum majus | MYB-like transcription factor DIVARICAT |
| 307 | G1637 | gi19911577 | 1.40E−25 | Glycine max | syringolide-induced protein 1-3-1A. |
| 307 | G1637 | gi6688529 | 3.00E−23 | Lycopersicon esculentum | I-box binding factor. |
| 307 | G1637 | gi15209176 | 7.60E−21 | Solanum demissum | putative I-box binding factor. |
| 307 | G1637 | gi20067661 | 3.40E−16 | Zea mays | one repeat myb transcriptional factor. |
| 309 | G1640 | AF034132 | 3.00E−60 | Gossypium hirsutum | MYB-like DNA-binding domain protein (Cmy |
| 309 | G1640 | AV421866 | 6.00E−57 | Lotus japonicus | AV421866 Lotus japonicus young plants (two- |
| 309 | G1640 | ZMU57002 | 8.00E−57 | Zea mays | P protein (P) mRNA, complete cds. |
| 309 | G1640 | BI924574 | 2.00E−56 | Lycopersicon esculentum | EST544463 tomato flower, buds 0-3 m |
| 309 | G1640 | AW255172 | 2.00E−55 | Mentha x piperita | ML160 peppermint glandular trichome Menth |
| 309 | G1640 | BE558747 | 3.00E−54 | Hordeum vulgare | HV_CEb0020E02f Hordeum vulgare seedling gre |
| 309 | G1640 | AW186273 | 1.00E−51 | Glycine max | se65f12.y1 Gm-c1019 Glycine max cDNA clone GENO |
| 309 | G1640 | PMU39448 | 2.00E−50 | Picea mariana | MYB-like transcriptional factor MBF1 mRNA, co |
| 309 | G1640 | BQ865372 | 3.00E−50 | Lactuca sativa | QGC4a02.yg.ab1 QG_ABCDI lettuce salinas Lact |
| 309 | G1640 | BQ046535 | 8.00E−49 | Solanum tuberosum | EST595653 P. infestans-challenged potato |
| 309 | G1640 | gi12060532 | 7.40E−59 | Oryza sativa | putative myb-related protein P. |
| 309 | G1640 | gi2921336 | 2.00E−58 | Gossypium hirsutum | MYB-like DNA-binding domain protein. |
| 309 | G1640 | gi11526779 | 2.00E−56 | Zea mays subsp. parviglumis | P-like protein. |
| 309 | G1640 | gi11526773 | 5.40E−56 | Zea mays | P2 protein. |
| 309 | G1640 | gi1101770 | 4.60E−50 | Picea mariana | MYB-like transcriptional factor MBF1. |
| 309 | G1640 | gi82308 | 8.60E−49 | Antirrhinum majus | myb protein 308-garden snapdragon. |
| 309 | G1640 | gi1370140 | 8.70E−49 | Lycopersicon esculentum | myb-related transcription factor. |
| 309 | G1640 | gi5139802 | 1.80E−48 | Glycine max | GmMYB29A1. |
| 309 | G1640 | gi127579 | 1.30E−47 | Hordeum vulgare | MYB-RELATED PROTEIN HV1. |
| 309 | G1640 | gi227030 | 1.30E−47 | Hordeum vulgare var. distichum | myb-related gene Hv1. |
| 311 | G1645 | AW624217 | 9.00E−59 | Lycopersicon esculentum | EST322258 tomato flower buds 3-8 mm |
| 311 | G1645 | AQ917084 | 1.00E−54 | Medicago truncatula | T233110b Medicago truncatula BAC librar |
| 311 | G1645 | AP005757 | 4.00E−53 | Oryza sativa (japonica cultivar-group) | ( ) chromosome 8 clo |
| 311 | G1645 | AAAA01001041 | 4.00E−53 | Oryza sativa (indica cultivar-group) | ( ) scaffold001041 |
| 311 | G1645 | BQ514458 | 7.00E−53 | Solanum tuberosum | EST621873 Generation of a set of potato c |
| 311 | G1645 | BF270511 | 3.00E−51 | Gossypium arboreum | GA_Eb0008O08f Gossypium arboreum 7-10 d |
| 311 | G1645 | AP000837 | 7.00E−51 | Oryza sativa | genomic DNA, chromosome 1, clone: P0424A08. |
| 311 | G1645 | AX288143 | 5.00E−49 | Physcomitrella patens | Sequence 14 from Patent WO0177311. |
| 311 | G1645 | AI164087 | 1.00E−48 | Populus tremula x Populus tremuloides | A054P76U Hybrid aspen |
| 311 | G1645 | BQ623005 | 1.00E−46 | Citrus sinensis | USDA-FP_00096 Ridge pineapple sweet orange |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 311 | G1645 | gi6539552 | 4.80E−58 | Oryza sativa | Similar to putative transcription factor (AF |
| 311 | G1645 | gi21321780 | 1.40E−46 | Oryza sativa (japonica cultivar-group) | putative Myb/Myb-r |
| 311 | G1645 | gi9954112 | 2.10E−34 | Solanum tuberosum | tuber-specific and sucrose-responsive e |
| 311 | G1645 | gi20565 | 2.30E−29 | Petunia x hybrida | protein 3. |
| 311 | G1645 | gi7230673 | 6.40E−29 | Papaver rhoeas | putative Myb-related domain. |
| 311 | G1645 | gi16326133 | 2.80E−28 | Nicotiana tabacum | Myb. |
| 311 | G1645 | gi8745321 | 2.90E−28 | Physcomitrella patens | putative c-myb-like transcription f |
| 311 | G1645 | gi8745325 | 3.10E−28 | Hordeum vulgare | putative c-myb-like transcription factor. |
| 311 | G1645 | gi7677132 | 5.10E−28 | Secale cereale | c-myb-like transcription factor. |
| 311 | G1645 | gi7677136 | 1.30E−27 | Adiantum raddianum | c-myb-like transcription factor. |
| 313 | G1646 | AW776719 | 3.00E−88 | Medicago truncatula | EST335784 DSIL Medicago truncatula cDNA |
| 313 | G1646 | BG591677 | 6.00E−87 | Solanum tuberosum | EST499519 P. infestans-challenged leaf So |
| 313 | G1646 | BQ411597 | 4.00E−85 | Gossypium arboreum | GA_Ed001B06f Gossypium arboreum 7-10 d |
| 313 | G1646 | BE208917 | 2.00E−84 | Citrus x paradisi | GF-FV-P3F5 Marsh grapefruit young flavedo |
| 313 | G1646 | BM065544 | 1.00E−83 | Capsicum annuum | KS07004F12 KS07 Capsicum annuum cDNA, mRNA |
| 313 | G1646 | BQ860015 | 1.00E−79 | Lactuca sativa | QGC14J23.yg.ab1 QG_ABCDI lettuce salinas Lac |
| 313 | G1646 | BI701620 | 3.00E−79 | Glycine max | sai18a04.y1 Gm-c1053 Glycine max cDNA clone GEN |
| 313 | G1646 | BH725354 | 2.00E−77 | Brassica oleracea | BOHVO37TF BO_2_3_KB Brassica oleracea gen |
| 313 | G1646 | AW093662 | 2.00E−73 | Lycopersicon esculentum | EST286842 tomato mixed elicitor, BT |
| 313 | G1646 | BI127986 | 7.00E−67 | Populus tremula x Populus tremuloides | G069P33Y Populus camb |
| 313 | G1646 | gi5257260 | 6.10E−48 | Oryza sativa | Similar to sequence of BAC F7G19 from Arabid |
| 313 | G1646 | gi20804442 | 2.30E−21 | Oryza sativa (japonica cultivar-group) | hypothetical prote |
| 313 | G1646 | gi18481626 | 5.00E−08 | Zea mays | repressor protein. |
| 313 | G1646 | gi169345 | 0.028 | Phaseolus vulgaris | hydroxyproline-rich glycoprotein. |
| 313 | G1646 | gi19700533 | 0.039 | Pyrus communis | unnamed protein product. |
| 313 | G1646 | gi2108256 | 0.095 | Bromheadia finlaysoniana | extensin. |
| 313 | G1646 | gi1778097 | 0.1 | Pinus taeda | expansin. |
| 313 | G1646 | gi347455 | 0.12 | Glycine max | hydroxyproline-rich glycoprotein. |
| 313 | G1646 | gi4105119 | 0.26 | Hordeum vulgare | dehydrin 10. |
| 313 | G1646 | gi1076601 | 0.39 | Lycopersicon esculentum | structural cell wall protein-to |
| 315 | G1652 | AI896266 | 6.00E−45 | Lycopersicon esculentum | EST265709 tomato callus, TAMU Lycop |
| 315 | G1652 | AI967554 | 2.00E−44 | Lotus japonicus | Ljirnpest05-403-e2 Ljirnp Lambda HybriZap t |
| 315 | G1652 | BU884552 | 2.00E−43 | Populus tremula x Populus tremuloides | R012C01 Populus root |
| 315 | G1652 | AF069738 | 1.00E−42 | Glycine max | symbiotic ammonium transporter (SAT1) mRNA, com |
| 315 | G1652 | AW775712 | 2.00E−40 | Medicago truncatula | EST334777 DSIL Medicago truncatula cDNA |
| 315 | G1652 | AF097665 | 3.00E−40 | Mesembryanthemum crystallinum | transporter homolog mRNA, par |
| 315 | G1652 | AAAA01000416 | 4.00E−36 | Oryza sativa (indica cultivar-group) | ( ) scaffold000416 |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 315 | G1652 | BQ483543 | 7.00E−31 | Triticum aestivum | WHE3509_H02_O03ZS Wheat unstressed root c |
| 315 | G1652 | AC099732 | 1.00E−26 | Oryza sativa (japonica cultivar-group) | ( ) chromosome 3 clo |
| 315 | G1652 | BF253652 | 2.00E−24 | Hordeum vulgare | HVSMEf0001L22f Hordeum vulgare seedling roo |
| 315 | G1652 | gi3399777 | 6.40E−44 | Glycine max | symbiotic ammonium transporter; nodulin. |
| 315 | G1652 | gi4206118 | 8.50E−42 | Mesembryanthemum crystallinum | transporter homolog. |
| 315 | G1652 | gi20532320 | 1.10E−32 | Oryza sativa (japonica cultivar-group) | Putative bHLH tran |
| 315 | G1652 | gi18542931 | 2.40E−28 | Oryza sativa | Putative bHLH transcription factor. |
| 315 | G1652 | gi1142619 | 2.70E−23 | Phaseolus vulgaris | phaseolin G-box binding protein PG1. |
| 315 | G1652 | gi4321762 | 4.30E−17 | Zea mays | transcription factor MYC7E. |
| 315 | G1652 | gi6175252 | 1.10E−14 | Lycopersicon esculentum | jasmonic acid 3. |
| 315 | G1652 | gi10998404 | 1.80E−13 | Petunia x hybrida | anthocyanin 1. |
| 315 | G1652 | gi527657 | 1.80E−12 | Pennisetum glaucum | myc-like regulatory R gene product. |
| 315 | G1652 | gi527661 | 5.10E−12 | Phyllostachys acuta | myc-like regulatory R gene product. |
| 317 | G1672 | BQ148509 | 9.00E−86 | Medicago truncatula | NF069A08FL1F1065 Developing flower Medi |
| 317 | G1672 | BH478545 | 4.00E−82 | Brassica oleracea | BOHSE63TR BOHS Brassica oleracea genomic |
| 317 | G1672 | BI129724 | 3.00E−72 | Populus tremula x Populus tremuloides | G094P85Y Populus camb |
| 317 | G1672 | BI960052 | 5.00E−71 | Hordeum vulgare | HVSMEn0023A06f Hordeum vulgare rachis EST 1 |
| 317 | G1672 | AC124143 | 5.00E−69 | Oryza sativa (japonica cultivar-group) | ( ) chromosome 5 clo |
| 317 | G1672 | AAAA01011028 | 7.00E−69 | Oryza sativa (indica cultivar-group) | ( ) scaffold011028 |
| 317 | G1672 | BM527360 | 3.00E−66 | Glycine max | sal60h11.y1 Gm-c1061 Glycine max cDNA clone SOY |
| 317 | G1672 | BF518231 | 2.00E−65 | Pinus taeda | NXSI_036_F03_F NXSI (Nsf Xylem Side wood Inclin |
| 317 | G1672 | BQ508125 | 8.00E−61 | Solanum tuberosum | EST615540 Generation of a set of potato c |
| 317 | G1672 | BE403509 | 1.00E−58 | Triticum aestivum | WHE0427_D02_H03ZS Wheat etiolated seedlin |
| 317 | G1672 | gi9049470 | 7.10E−78 | Oryza sativa | hypothetical protein. |
| 317 | G1672 | gi18461166 | 6.30E−69 | Oryza sativa (japonica cultivar-group) | contains ESTs AU09 |
| 317 | G1672 | gi12751304 | 1.60E−47 | Brassica napus | CUC2-like protein. |
| 317 | G1672 | gi7716952 | 5.40E−07 | Medicago truncatula | NAC1. |
| 317 | G1672 | gi6732156 | 9.90E−07 | Triticum monococcum | unnamed protein product. |
| 317 | G1672 | gi21389170 | 1.50E−06 | Petunia x hybrida | nam-like protein 16. |
| 317 | G1672 | gi6175246 | 3.10E−06 | Lycopersicon esculentum | jasmonic acid 2. |
| 317 | G1672 | gi4218537 | 0.00019 | Triticum sp. | GRAB2 protein. |
| 317 | G1672 | gi15148912 | 0.00051 | Phaseolus vulgaris | NAC domain protein NAC1. |
| 317 | G1672 | gi22597158 | 0.00071 | Glycine max | no apical meristem-like protein. |
| 319 | G1677 | BU926268 | 7.00E−68 | Glycine max | sas88f08.y1 Gm-c1036 Glycine max cDNA clone SOY |
| 319 | G1677 | BH519017 | 2.00E−59 | Brassica oleracea | BOHHW49TR BOHH Brassica oleracea genomic |
| 319 | G1677 | BF649854 | 4.00E−58 | Medicago truncatula | NF085A08EC1F1055 Elicited cell culture |
| 319 | G1677 | BI422020 | 3.00E−57 | Lycopersicon esculentum | EST532686 tomato callus, TAMU Lycop |
| 319 | G1677 | BU894596 | 3.00E−48 | Populus tremula x Populus tremuloides | X011H04 Populus wood |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 319 | G1677 | BF625246 | 1.00E−47 | *Hordeum vulgare* | HVSMEa0008A15f *Hordeum vulgare* seedling sho |
| 319 | G1677 | CA810372 | 1.00E−46 | *Vitis vinifera* | CA22LI05IF-C9 CA22LI *Vitis vinifera* cDNA clo |
| 319 | G1677 | BQ118483 | 2.00E−46 | *Solanum tuberosum* | EST604059 mixed potato tissues *Solanum tu* |
| 319 | G1677 | AB028183 | 2.00E−46 | *Oryza sativa* | mRNA for OsNAC4 protein, complete cds. |
| 319 | G1677 | AF402603 | 6.00E−46 | *Phaseolus vulgaris* | NAC domain protein NAC2 mRNA, complete c |
| 319 | G1677 | gi20303588 | 3.40E−54 | *Oryza sativa (japonica cultivar-group)* | putative NAM (no a |
| 319 | G1677 | gi10697197 | 8.70E−49 | *Oryza sativa* | putative NAM protein. |
| 319 | G1677 | gi21105748 | 5.30E−47 | *Petunia x hybrida* | nam-like protein 10. |
| 319 | G1677 | gi4218535 | 1.80E−44 | *Triticum* sp. | GRAB1 protein. |
| 319 | G1677 | gi6732158 | 1.80E−44 | *Triticum monococcum* | unnamed protein product. |
| 319 | G1677 | gi14485513 | 1.60E−43 | *Solanum tuberosum* | putative NAC domain protein. |
| 319 | G1677 | gi15148914 | 4.10E−42 | *Phaseolus vulgaris* | NAC domain protein NAC2. |
| 319 | G1677 | gi6175246 | 9.70E−41 | *Lycopersicon esculentum* | jasmonic acid 2. |
| 319 | G1677 | gi22597158 | 1.00E−38 | *Glycine max* | no apical meristem-like protein. |
| 319 | G1677 | gi7716952 | 7.30E−38 | *Medicago truncatula* | NAC1. |
| 321 | G1749 | BH723520 | 3.00E−44 | *Brassica oleracea* | BOHTN77TF BO_2_3_KB *Brassica oleracea* gen |
| 321 | G1749 | AW559374 | 3.00E−22 | *Medicago truncatula* | EST314422 DSIR *Medicago truncatula* cDNA |
| 321 | G1749 | AW152963 | 1.00E−17 | *Glycine max* | se33c03.y1 Gm-c1015 *Glycine max* cDNA clone GENO |
| 321 | G1749 | BI422101 | 2.00E−16 | *Lycopersicon esculentum* | EST532767 tomato callus, TAMU Lycop |
| 321 | G1749 | AP005418 | 2.00E−15 | *Oryza sativa (japonica cultivar-group)* | ( ) chromosome 9 clo |
| 321 | G1749 | AAAA01002932 | 2.00E−15 | *Oryza sativa (indica cultivar-group)* | ( ) scaffold002932 |
| 321 | G1749 | BU998389 | 2.00E−14 | *Hordeum vulgare* subsp. *vulgare* | HI10O11r HI *Hordeum vulgare* |
| 321 | G1749 | BQ469024 | 4.00E−14 | *Hordeum vulgare* | HM03C08r HM *Hordeum vulgare* cDNA clone HM03 |
| 321 | G1749 | CA728820 | 4.00E−13 | *Triticum aestivum* | wdi1c.pk005.j15 wdi1c *Triticum aestivum* c |
| 321 | G1749 | BQ803638 | 2.00E−12 | *Triticum monococcum* | WHE2839_H12_P23ZS *Triticum monococcum* v |
| 321 | G1749 | gi20160854 | 1.30E−15 | *Oryza sativa (japonica cultivar-group)* | hypothetical prote |
| 321 | G1749 | gi21740822 | 4.90E−14 | *Oryza sativa* | OSJNBa0042L16.10. |
| 321 | G1749 | gi8809573 | 2.10E−13 | *Nicotiana sylvestris* | ethylene-responsive element binding |
| 321 | G1749 | gi1208496 | 5.60E−13 | *Nicotiana tabacum* | EREBP-3. |
| 321 | G1749 | gi20340233 | 5.60E−13 | *Thellungiella halophila* | ethylene responsive element bindi |
| 321 | G1749 | gi3264767 | 1.20E−12 | *Prunus armeniaca* | AP2 domain containing protein. |
| 321 | G1749 | gi18266198 | 1.90E−12 | *Narcissus pseudonarcissus* | AP-2 domain containing protein. |
| 321 | G1749 | gi4099914 | 4.00E−12 | *Stylosanthes hamata* | ethylene-responsive element binding p |
| 321 | G1749 | gi24940524 | 4.70E−12 | *Triticum aestivum* | ethylene response element binding prote |
| 321 | G1749 | gi18535580 | 5.10E−12 | *Lycopersicon esculentum* | putative transcriptional activato |
| 323 | G1750 | BH459103 | 8.00E−61 | *Brassica oleracea* | BOGEX73TR BOGE *Brassica oleracea* genomic |
| 323 | G1750 | AP004902 | 7.00E−44 | *Lotus japonicus* | genomic DNA, chromosome 2, clone: LjT04G24, |
| 323 | G1750 | AW685524 | 9.00E−39 | *Medicago truncatula* | NF031C12NR1F1000 Nodulated root Medicag |
| 323 | G1750 | LEU89257 | 4.00E−36 | *Lycopersicon esculentum* | DNA-binding protein Pti6 mRNA, comp |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 323 | G1750 | BM886518 | 1.00E−35 | *Glycine max* | sam17f08.y1 Gm-c1068 *Glycine max* cDNA clone SOY |
| 323 | G1750 | AF058827 | 5.00E−32 | *Nicotiana tabacum* | TSI1 (Tsi1) mRNA, complete cds. |
| 323 | G1750 | BQ873772 | 4.00E−30 | *Lactuca sativa* | QGI2I03.yg.ab1 QG_ABCDI lettuce salinas Lact |
| 323 | G1750 | AP002835 | 1.00E−28 | *Oryza sativa* | genomic DNA, chromosome 1, PAC clone: P0417G05. |
| 323 | G1750 | AAAA01000263 | 3.00E−28 | *Oryza sativa* (*indica* cultivar-group) | ( ) scaffold000263 |
| 323 | G1750 | BQ507568 | 1.00E−23 | *Solanum tuberosum* | EST614971 Generation of a set of potato c |
| 323 | G1750 | gi2213785 | 5.10E−35 | *Lycopersicon esculentum* | Pti6. |
| 323 | G1750 | gi8096469 | 1.50E−33 | *Oryza sativa* | Similar to *Arabidopsis thaliana* chromosome 4 |
| 323 | G1750 | gi3065895 | 1.10E−32 | *Nicotiana tabacum* | TSI1. |
| 323 | G1750 | gi7528276 | 1.90E−21 | *Mesembryanthemum crystallinum* | AP2-related transcription f |
| 323 | G1750 | gi8571476 | 2.50E−21 | *Atriplex hortensis* | apetala2 domain-containing protein. |
| 323 | G1750 | gi8809575 | 1.30E−20 | *Nicotiana sylvestris* | ethylene-responsive element binding |
| 323 | G1750 | gi17385636 | 1.70E−20 | *Matricaria chamomilla* | ethylene-responsive element binding |
| 323 | G1750 | gi24060156 | 9.30E−20 | *Oryza sativa* (*japonica* cultivar-group) | contains ESTs AU16 |
| 323 | G1750 | gi4099914 | 1.50E−19 | *Stylosanthes hamata* | ethylene-responsive element binding p |
| 323 | G1750 | gi3264767 | 1.90E−19 | *Prunus armeniaca* | AP2 domain containing protein. |
| 325 | G1756 | BH509555 | 1.00E−66 | *Brassica oleracea* | BOHIT47TF BOHI *Brassica oleracea* genomic |
| 325 | G1756 | BU837263 | 4.00E−42 | *Populus tremula* x *Populus tremuloides* | T096G05 *Populus* apica |
| 325 | G1756 | AW596933 | 2.00E−38 | *Glycine max* | sj84f07.y1 Gm-c1034 *Glycine max* cDNA clone GENO |
| 325 | G1756 | AV423663 | 7.00E−38 | *Lotus japonicus* | AV423663 *Lotus japonicus* young plants (two- |
| 325 | G1756 | BI923414 | 6.00E−37 | *Lycopersicon esculentum* | EST543319 tomato callus *Lycopersico* |
| 325 | G1756 | BM112869 | 6.00E−32 | *Solanum tuberosum* | EST560405 potato roots *Solanum tuberosum* |
| 325 | G1756 | BF519892 | 7.00E−32 | *Medicago truncatula* | EST457357 DSIL *Medicago truncatula* cDNA |
| 325 | G1756 | AAAA01007990 | 5.00E−30 | *Oryza sativa* (*indica* cultivar-group) | ( ) scaffold007990 |
| 325 | G1756 | AP004683 | 5.00E−30 | *Oryza sativa* (*japonica* cultivar-group) | ( ) chromosome 2 clo |
| 325 | G1756 | AW447931 | 3.00E−29 | *Triticum aestivum* | BRY_1082 BRY *Triticum aestivum* cDNA clone |
| 325 | G1756 | gi11761072 | 3.00E−30 | *Oryza sativa* | hypothetical protein. |
| 325 | G1756 | gi4322940 | 1.20E−23 | *Nicotiana tabacum* | DNA-binding protein 2. |
| 325 | G1756 | gi4894963 | 2.20E−20 | *Avena sativa* | DNA-binding protein WRKY3. |
| 325 | G1756 | gi1432056 | 5.70E−20 | *Petroselinum crispum* | WRKY3. |
| 325 | G1756 | gi11993901 | 1.60E−19 | *Dactylis glomerata* | somatic embryogenesis related protein. |
| 325 | G1756 | gi13620227 | 2.00E−18 | *Lycopersicon esculentum* | hypothetical protein. |
| 325 | G1756 | gi23305051 | 2.50E−18 | *Oryza sativa* (*indica* cultivar-group) | WRKY transcription f |
| 325 | G1756 | gi18158619 | 2.30E−17 | *Retama raetam* | WRKY-like drought-induced protein. |
| 325 | G1756 | gi22830985 | 7.60E−17 | *Oryza sativa* (*japonica* cultivar-group) | WRKY transcription |
| 325 | G1756 | gi7484759 | 1.70E−16 | *Cucumis sativus* | SP8 binding protein homolog-cucumber. |
| 327 | G1765 | BF649854 | 7.00E−74 | *Medicago truncatula* | NF085A08EC1F1055 Elicited cell culture |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 327 | G1765 | BI421877 | 2.00E−70 | *Lycopersicon esculentum* | EST532543 tomato callus, TAMU Lycop |
| 327 | G1765 | BG511369 | 8.00E−60 | *Glycine max* | sad17a06.y1 Gm-c1074 *Glycine max* cDNA clone GEN |
| 327 | G1765 | CA810372 | 9.00E−53 | *Vitis vinifera* | CA22LI05IF-C9 CA22LI *Vitis vinifera* cDNA clo |
| 327 | G1765 | BH519017 | 3.00E−47 | *Brassica oleracea* | BOHHW49TR BOHH *Brassica oleracea* genomic |
| 327 | G1765 | BQ586991 | 2.00E−46 | *Beta vulgaris* | E012352-024-011-F06-SP6 MPIZ-ADIS-024-leaf Be |
| 327 | G1765 | BQ516602 | 9.00E−45 | *Solanum tuberosum* | EST624017 Generation of a set of potato c |
| 327 | G1765 | BE034140 | 4.00E−44 | *Mesembryanthemum crystallinum* | MG05E02 MG *Mesembryanthemum* c |
| 327 | G1765 | AF509873 | 8.00E−44 | *Petunia x hybrida* | nam-like protein 10 (NH10) mRNA, complete |
| 327 | G1765 | BU883830 | 2.00E−43 | *Populus tremula* x *Populus tremuloides* | R002A08 *Populus* root |
| 327 | G1765 | gi20303588 | 1.60E−67 | *Oryza sativa* (japonica cultivar-group) | putative NAM (no a |
| 327 | G1765 | gi6175246 | 3.30E−47 | *Lycopersicon esculentum* | jasmonic acid 2. |
| 327 | G1765 | gi21105748 | 5.60E−45 | *Petunia x hybrida* | nam-like protein 10. |
| 327 | G1765 | gi15148914 | 1.70E−43 | *Phaseolus vulgaris* | NAC domain protein NAC2. |
| 327 | G1765 | gi15528779 | 9.40E−43 | *Oryza sativa* | development regulation gene OsNAC4. |
| 327 | G1765 | gi22597158 | 1.40E−41 | *Glycine max* | no apical meristem-like protein. |
| 327 | G1765 | gi14485513 | 3.70E−41 | *Solanum tuberosum* | putative NAC domain protein. |
| 327 | G1765 | gi4218537 | 1.00E−38 | *Triticum* sp. | GRAB2 protein. |
| 327 | G1765 | gi6732160 | 1.00E−38 | *Triticum monococcum* | unnamed protein product. |
| 327 | G1765 | gi7716952 | 7.30E−36 | *Medicago truncatula* | NAC1. |
| 329 | G1777 | BQ996439 | 1.00E−120 | *Lactuca sativa* | QGG12N12.yg.ab1 QG_EFGHJ lettuce serriola La |
| 329 | G1777 | BM985639 | 1.00E−101 | *Thellungiella halophila* | 2_F04_T3 Ath *Thellungiella* halophil |
| 329 | G1777 | BM887188 | 4.00E−93 | *Glycine max* | sam35d01.y1 Gm-c1068 *Glycine max* cDNA clone SOY |
| 329 | G1777 | BM661323 | 5.00E−87 | *Zea mays* | 952046G05.y1 952-BMS tissue from Walbot Lab (red |
| 329 | G1777 | BU026535 | 9.00E−86 | *Helianthus annuus* | QHG17C11.yg.ab1 QH_EFGHJ sunflower RHA280 |
| 329 | G1777 | BH998711 | 1.00E−84 | *Brassica oleracea* | oep82h07.g1 *B. oleracea*002 *Brassica* olerac |
| 329 | G1777 | AAAA01003274 | 1.00E−76 | *Oryza sativa* (indica cultivar-group) | ( ) scaffold003274 |
| 329 | G1777 | AC103891 | 2.00E−76 | *Oryza sativa* | chromosome 3 clone OJ1175C11, *** SEQUENCING I |
| 329 | G1777 | BG136684 | 1.00E−75 | *Lycopersicon pennellii* | EST477126 wild tomato pollen Lycoper |
| 329 | G1777 | BG600834 | 4.00E−72 | *Solanum tuberosum* | EST505729 cSTS *Solanum tuberosum* cDNA clo |
| 329 | G1777 | gi20330766 | 1.10E−199 | *Oryza sativa* (japonica cultivar-group) | Putative RING zinc |
| 329 | G1777 | gi1666171 | 4.90E−35 | *Nicotiana plumbaginifolia* | unknown. |
| 329 | G1777 | gi1362039 | 0.76 | *Fragaria x ananassa* | hypothetical protein (clone RJ39)-g |
| 329 | G1777 | gi2244705 | 1 | *Nicotiana excelsior* | gamma-thionin. |
| 331 | G1792 | AI776626 | 5.00E−35 | *Lycopersicon esculentum* | EST257726 tomato resistant, Cornell |
| 331 | G1792 | BQ045702 | 1.00E−32 | *Solanum tuberosum* | EST594820 *P. infestans*-challenged potato |
| 331 | G1792 | BM178875 | 7.00E−32 | *Glycine max* | saj60f01.y1 Gm-c1072 *Glycine max* cDNA clone SOY |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 331 | G1792 | BF649790 | 1.00E−31 | Medicago truncatula | NF084C07EC1F1052 Elicited cell culture |
| 331 | G1792 | BZ020356 | 1.00E−30 | Brassica oleracea | oeg04a10.g1 B. oleracea002 Brassica olerac |
| 331 | G1792 | BZ337899 | 3.00E−30 | Sorghum bicolor | ia91f11.b1 WGS-SbicolorF (JM107 adapted met |
| 331 | G1792 | AC025907 | 3.00E−30 | Oryza sativa | chromosome 10 clone nbxb0094K20, *** SEQUENCIN |
| 331 | G1792 | AAAA01002491 | 3.00E−30 | Oryza sativa (indica cultivar-group) | ( ) scaffold002491 |
| 331 | G1792 | BZ359367 | 8.00E−30 | Zea mays | id72f11.b1 WGS-ZmaysF (JM107 adapted methyl filter |
| 331 | G1792 | AC137635 | 2.00E−27 | Oryza sativa (japonica cultivar-group) | Genomic sequence for |
| 331 | G1792 | gi23452024 | 4.00E−26 | Lycopersicon esculentum | transcription factor TSRF1. |
| 331 | G1792 | gi1732406 | 2.10E−25 | Nicotiana tabacum | S25-XP1 DNA binding protein. |
| 331 | G1792 | gi12597874 | 3.70E−25 | Oryza sativa | putative ethylene-responsive element binding |
| 331 | G1792 | gi7528276 | 7.60E−25 | Mesembryanthemum crystallinum | AP2-related transcription f |
| 331 | G1792 | gi24060081 | 1.30E−23 | Oryza sativa (japonica cultivar-group) | putative ethylene |
| 331 | G1792 | gi8980313 | 1.80E−23 | Catharanthus roseus | AP2-domain DNA-binding protein. |
| 331 | G1792 | gi8809571 | 1.80E−23 | Nicotiana sylvestris | ethylene-responsive element binding |
| 331 | G1792 | gi17385636 | 1.20E−21 | Matricaria chamomilla | ethylene-responsive element binding |
| 331 | G1792 | gi21304712 | 3.10E−21 | Glycine max | ethylene-responsive element binding protein 1 |
| 331 | G1792 | gi8571476 | 1.10E−20 | Atriplex hortensis | apetala2 domain-containing protein. |
| 333 | G1793 | CA783156 | 1.00E−121 | Glycine max | sat20d05.y1 Gm-c1036 Glycine max cDNA clone SOY |
| 333 | G1793 | AF317904 | 1.00E−101 | Brassica napus | AP2/EREBP transcription factor BABY BOOM1 (B |
| 333 | G1793 | AY109146 | 2.00E−99 | Zea mays | PCO137288 mRNA sequence. |
| 333 | G1793 | AY062179 | 2.00E−99 | Oryza sativa | aintegumenta-like protein mRNA, complete cds. |
| 333 | G1793 | BQ864461 | 4.00E−91 | Lactuca sativa | QGC26M12.yg.ab1 QG_ABCDI lettuce salinas Lac |
| 333 | G1793 | BJ178045 | 8.00E−89 | Physcomitrella patens subsp. patens | BJ178045 normalized ful |
| 333 | G1793 | BF647766 | 3.00E−80 | Medicago truncatula | NF025G09EC1F1071 Elicited cell culture |
| 333 | G1793 | AJ475492 | 1.00E−72 | Hordeum vulgare | AJ475492 S00008 Hordeum vulgare cDNA clone |
| 333 | G1793 | BQ625052 | 9.00E−69 | Citrus sinensis | USDA-FP_02143 Ridge pineapple sweet orange |
| 333 | G1793 | BJ312281 | 5.00E−65 | Triticum aestivum | BJ312281 Y. Ogihara unpublished cDNA libr |
| 333 | G1793 | gi20161013 | 1.00E−107 | Oryza sativa (japonica cultivar-group) | putative ovule dev |
| 333 | G1793 | gi21069053 | 5.70E−107 | Brassica napus | AP2/EREBP transcription factor BABY BOOM2. |
| 333 | G1793 | gi21304227 | 1.50E−106 | Oryza sativa | ovule development aintegumenta-like protein |
| 333 | G1793 | gi2652938 | 6.10E−97 | Zea mays | orf. |
| 333 | G1793 | gi13173164 | 5.60E−45 | Pisum sativum | APETAL2-like protein. |
| 333 | G1793 | gi11181612 | 3.20E−43 | Picea abies | APETALA2-related transcription factor 2. |
| 333 | G1793 | gi18476518 | 9.40E−43 | Hordeum vulgare | APETALA2-like protein. |
| 333 | G1793 | gi5081555 | 1.40E−41 | Petunia x hybrida | PHAP2A protein. |
| 333 | G1793 | gi21717332 | 9.70E−41 | Malus x domestica | transcription factor AHAP2. |
| 333 | G1793 | gi5360996 | 1.80E−34 | Hyacinthus orientalis | APETALA2 protein homolog HAP2. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 335 | G1794 | BH471138 | 4.00E−77 | Brassica oleracea | BOGTX58TF BOGT Brassica oleracea genomic |
| 335 | G1794 | BU873559 | 2.00E−36 | Populus balsamifera subsp. trichocarpa | Q056H03 Populus flow |
| 335 | G1794 | AI485175 | 2.00E−36 | Lycopersicon esculentum | EST243479 tomato ovary, TAMU Lycope |
| 335 | G1794 | BQ121959 | 3.00E−34 | Solanum tuberosum | EST607535 mixed potato tissues Solanum tu |
| 335 | G1794 | AC137522 | 3.00E−34 | Medicago truncatula | clone mth2-9h8, WORKING DRAFT SEQUENCE, |
| 335 | G1794 | BU763025 | 3.00E−31 | Glycine max | sas36c11.y1 Gm-c1080 Glycine max cDNA clone SOY |
| 335 | G1794 | CA015575 | 5.00E−31 | Hordeum vulgare subsp. vulgare | HT14L19r HT Hordeum vulgare |
| 335 | G1794 | BQ483206 | 6.00E−31 | Triticum aestivum | WHE3505_G10_M19ZS Wheat unstressed root c |
| 335 | G1794 | AV428124 | 1.00E−30 | Lotus japonicus | AV428124 Lotus japonicus young plants (two- |
| 335 | G1794 | AP003286 | 9.00E−30 | Oryza sativa | chromosome 1 clone P0677H08, *** SEQUENCING IN |
| 335 | G1794 | gi20160854 | 4.80E−39 | Oryza sativa (japonica cultivar-group) | hypothetical prote |
| 335 | G1794 | gi21740822 | 2.50E−26 | Oryza sativa | OSJNBa0042L16.10. |
| 335 | G1794 | gi10798644 | 9.80E−25 | Nicotiana tabacum | AP2 domain-containing transcription fac |
| 335 | G1794 | gi3342211 | 3.30E−24 | Lycopersicon esculentum | Pti4. |
| 335 | G1794 | gi8809575 | 2.60E−23 | Nicotiana sylvestris | ethylene-responsive element binding |
| 335 | G1794 | gi24940524 | 3.10E−23 | Triticum aestivum | ethylene response element binding prote |
| 335 | G1794 | gi24817250 | 9.50E−23 | Cicer arietinum | transcription factor EREBP-like protein. |
| 335 | G1794 | gi3264767 | 1.70E−22 | Prunus armeniaca | AP2 domain containing protein. |
| 335 | G1794 | gi20340233 | 1.70E−22 | Thellungiella halophila | ethylene responsive element bindi |
| 335 | G1794 | gi21908036 | 3.80E−22 | Zea mays | DRE binding factor 1. |
| 337 | G1804 | BH496021 | 7.00E−87 | Brassica oleracea | BOGJA54TR BOGJ Brassica oleracea genomic |
| 337 | G1804 | AF001453 | 2.00E−84 | Helianthus annuus | Dc3 promoter-binding factor-1 (DPBF-1) mR |
| 337 | G1804 | AF519804 | 5.00E−53 | Triticum aestivum | ABA response element binding factor (ABFB |
| 337 | G1804 | AP003287 | 8.00E−53 | Oryza sativa | chromosome 1 clone P0679C12, *** SEQUENCING IN |
| 337 | G1804 | AAAA01001410 | 8.00E−53 | Oryza sativa (indica cultivar-group) | ( ) scaffold001410 |
| 337 | G1804 | VV1237992 | 7.00E−48 | Vitis vinifera | mRNA for putative ripening-related bZIP pro |
| 337 | G1804 | AF369792 | 2.00E−46 | Phaseolus vulgaris | bZIP transcription factor 6 mRNA, comple |
| 337 | G1804 | AB063648 | 2.00E−40 | Nicotiana tabacum | mRNA for phi-2, complete cds. |
| 337 | G1804 | AP006057 | 9.00E−40 | Oryza sativa (japonica cultivar-group) | ( ) chromosome 9 clo |
| 337 | G1804 | AY110385 | 1.00E−38 | Zea mays | CL940_-1 mRNA sequence. |
| 337 | G1804 | gi2228771 | 1.40E−78 | Helianthus annuus | Dc3 promoter-binding factor-1. |
| 337 | G1804 | gi20161640 | 4.90E−47 | Oryza sativa (japonica cultivar-group) | putative abscisic |
| 337 | G1804 | gi21693585 | 9.10E−43 | Triticum aestivum | ABA response element binding factor. |
| 337 | G1804 | gi7406677 | 2.30E−40 | Vitis vinifera | putative ripening-related bZIP protein. |
| 337 | G1804 | gi13775111 | 2.40E−37 | Phaseolus vulgaris | bZIP transcription factor 6. |
| 337 | G1804 | gi5821255 | 8.00E−35 | Oryza sativa | TRAB1. |
| 337 | G1804 | gi14571808 | 3.10E−26 | Nicotiana tabacum | phi-2. |
| 337 | G1804 | gi1060935 | 1.30E−07 | Zea mays | mLIP15. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 337 | G1804 | gi2104677 | 1.70E−07 | *Vicia faba* | transcription factor. |
| 337 | G1804 | gi6018699 | 2.20E−07 | *Lycopersicon esculentum* | THY5 protein. |
| 339 | G1818 | BM065544 | 2.00E−29 | *Capsicum annuum* | KS07004F12 KS07 *Capsicum annuum* cDNA, mRNA |
| 339 | G1818 | BU819346 | 7.00E−29 | *Populus tremula* | UA42BPF01 *Populus tremula* cambium cDNA libr |
| 339 | G1818 | AW776719 | 2.00E−28 | *Medicago truncatula* | EST335784 DSIL *Medicago truncatula* cDNA |
| 339 | G1818 | BG591677 | 5.00E−28 | *Solanum tuberosum* | EST499519 *P. infestans*-challenged leaf So |
| 339 | G1818 | BI321875 | 3.00E−27 | *Glycine max* | saf52e11.y3 Gm-c1077 *Glycine max* cDNA clone GEN |
| 339 | G1818 | BE208917 | 1.00E−26 | *Citrus* x *paradisi* | GF-FV-P3F5 Marsh grapefruit young flavedo |
| 339 | G1818 | BG440805 | 1.00E−26 | *Gossypium arboreum* | GA_Ea0010D12f *Gossypium arboreum* 7-10 d |
| 339 | G1818 | BU582324 | 4.00E−26 | *Zea mays* | 946188B03.y1 946-tassel primordium prepared by S |
| 339 | G1818 | BI127986 | 4.00E−26 | *Populus tremula* x *Populus tremuloides* | G069P33Y *Populus* camb |
| 339 | G1818 | AW093662 | 4.00E−26 | *Lycopersicon esculentum* | EST286842 tomato mixed elicitor, BT |
| 339 | G1818 | gi5257260 | 4.60E−27 | *Oryza sativa* | Similar to sequence of BAC F7G19 from Arabid |
| 339 | G1818 | gi20804442 | 4.40E−13 | *Oryza sativa* (*japonica* cultivar-group) | hypothetical prote |
| 339 | G1818 | gi18481626 | 2.60E−07 | *Zea mays* | repressor protein. |
| 339 | G1818 | gi169195 | 0.95 | *Petunia* x *hybrida* | Major Cab protein. |
| 339 | G1818 | gi1262851 | 0.98 | *Pinus palustris* | type 2 light-harvesting chlorophyll a/b-b |
| 339 | G1818 | gi22536010 | 0.99 | *Phaseolus coccineus* | LEC1-like protein |
| 341 | G1820 | AW776719 | 1.00E−43 | *Medicago truncatula* | EST335784 DSIL *Medicago truncatula* cDNA |
| 341 | G1820 | BM065544 | 3.00E−40 | *Capsicum annuum* | KS07004F12 KS07 *Capsicum annuum* cDNA, mRNA |
| 341 | G1820 | BG591677 | 4.00E−40 | *Solanum tuberosum* | EST499519 *P. infestans*-challenged leaf So |
| 341 | G1820 | BI701620 | 1.00E−38 | *Glycine max* | sai18a04.y1 Gm-c1053 *Glycine max* cDNA clone GEN |
| 341 | G1820 | BQ411597 | 3.00E−37 | *Gossypium arboreum* | GA_Ed0041B06f *Gossypium arboreum* 7-10 d |
| 341 | G1820 | BE208917 | 6.00E−37 | *Citrus* x *paradisi* | GF-FV-P3F5 Marsh grapefruit young flavedo |
| 341 | G1820 | BH725354 | 1.00E−36 | *Brassica oleracea* | BOHVO37TF BO_2_3_KB *Brassica oleracea* gen |
| 341 | G1820 | AW093662 | 9.00E−36 | *Lycopersicon esculentum* | EST286842 tomato mixed elicitor, BT |
| 341 | G1820 | BU819346 | 4.00E−35 | *Populus tremula* | UA42BPF01 *Populus tremula* cambium cDNA libr |
| 341 | G1820 | AAAA01002977 | 3.00E−34 | *Oryza sativa* (*indica* cultivar-group) | ( ) scaffold002977 |
| 341 | G1820 | gi5257260 | 1.40E−34 | *Oryza sativa* | Similar to sequence of BAC F7G19 from Arabid |
| 341 | G1820 | gi20804442 | 1.70E−15 | *Oryza sativa* (*japonica* cultivar-group) | hypothetical prote |
| 341 | G1820 | gi18481626 | 6.30E−08 | *Zea mays* | repressor protein. |
| 341 | G1820 | gi297871 | 0.39 | *Picea abies* | histone H2A. |
| 341 | G1820 | gi297887 | 0.41 | *Daucus carota* | glycine rich protein. |
| 341 | G1820 | gi2130105 | 0.54 | *Triticum aestivum* | histone H2A.4-wheat. |
| 341 | G1820 | gi6782438 | 0.74 | *Nicotiana glauca* | glycine-rich protein. |
| 341 | G1820 | gi15214035 | 0.98 | *Cicer arietinum* | HISTONE H2A. |
| 341 | G1820 | gi2317760 | 0.98 | *Pinus taeda* | H2A homolog. |
| 341 | G1820 | gi1173628 | 0.99 | *Phalaenopsis* sp. SM9108 | glycine-rich protein. |
| 343 | G1836 | BI701620 | 7.00E−35 | *Glycine max* | sai18a04.y1 Gm-c1053 *Glycine max* cDNA clone GEN |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 343 | G1836 | AW776719 | 2.00E−33 | Medicago truncatula | EST335784 DSIL Medicago truncatula cDNA |
| 343 | G1836 | BQ411597 | 2.00E−33 | Gossypium arboreum | GA_Ed0041B06f Gossypium arboreum 7-10 d |
| 343 | G1836 | BM065544 | 2.00E−32 | Capsicum annuum | KS07004F12 KS07 Capsicum annuum cDNA, mRNA |
| 343 | G1836 | BG591677 | 3.00E−31 | Solanum tuberosum | EST499519 P. infestans-challenged leaf So |
| 343 | G1836 | BU819346 | 6.00E−31 | Populus tremula | UA42BPF01 Populus tremula cambium cDNA libr |
| 343 | G1836 | BH725354 | 4.00E−30 | Brassica oleracea | BOHVO37TF BO_2_3_KB Brassica oleracea gen |
| 343 | G1836 | BE208917 | 6.00E−30 | Citrus x paradisi | GF-FV-P3F5 Marsh grapefruit young flavedo |
| 343 | G1836 | AAAA01024926 | 5.00E−29 | Oryza sativa (indica cultivar-group) | ( ) scaffold024926 |
| 343 | G1836 | AW093662 | 9.00E−29 | Lycopersicon esculentum | EST286842 tomato mixed elicitor, BT |
| 343 | G1836 | gi5257260 | 2.10E−29 | Oryza sativa | Similar to sequence of BAC F7G19 from Arabid |
| 343 | G1836 | gi20804442 | 6.30E−16 | Oryza sativa (japonica cultivar-group) | hypothetical prote |
| 343 | G1836 | gi18481626 | 2.00E−06 | Zea mays | repressor protein. |
| 343 | G1836 | gi18539425 | 0.84 | Pinus sylvestris | putative malate dehydrogenase. |
| 343 | G1836 | gi122084 | 1 | Hordeum vulgare | Histone H3. |
| 343 | G1836 | gi225348 | 1 | Hordeum vulgare subsp. vulgare | histone H3. |
| 345 | G1838 | AF317904 | 2.00E−98 | Brassica napus | AP2/EREBP transcription factor BABY BOOM1 (B |
| 345 | G1838 | CA783156 | 7.00E−97 | Glycine max | sat20d05.y1 Gm-c1036 Glycine max cDNA clone SOY |
| 345 | G1838 | AY109146 | 6.00E−96 | Zea mays | PCO137288 mRNA sequence. |
| 345 | G1838 | AY062179 | 2.00E−93 | Oryza sativa | aintegumenta-like protein mRNA, complete cds. |
| 345 | G1838 | BJ178045 | 3.00E−84 | Physcomitrella patens subsp. patens | BJ178045 normalized ful |
| 345 | G1838 | BQ864461 | 2.00E−83 | Lactuca sativa | QGC26M12.yg.ab1 QG_ABCDI lettuce salinas Lac |
| 345 | G1838 | BF647766 | 5.00E−73 | Medicago truncatula | NF025G09EC1F1071 Elicited cell culture |
| 345 | G1838 | AJ475492 | 3.00E−69 | Hordeum vulgare | AJ475492 S00008 Hordeum vulgare cDNA clone |
| 345 | G1838 | BQ625052 | 6.00E−69 | Citrus sinensis | USDA-FP_02143 Ridge pineapple sweet orange |
| 345 | G1838 | BJ312281 | 4.00E−60 | Triticum aestivum | BJ312281 Y. Ogihara unpublished cDNA libr |
| 345 | G1838 | gi21069051 | 3.00E−100 | Brassica napus | AP2/EREBP transcription factor BABY BOOM1. |
| 345 | G1838 | gi21304225 | 1.30E−95 | Oryza sativa | aintegumenta-like protein. |
| 345 | G1838 | gi20161013 | 3.00E−91 | Oryza sativa (japonica cultivar-group) | putative ovule dev |
| 345 | G1838 | gi2652938 | 2.50E−90 | Zea mays | orf. |
| 345 | G1838 | gi13173164 | 1.10E−51 | Pisum sativum | APETAL2-like protein. |
| 345 | G1838 | gi21717332 | 1.10E−46 | Malus x domestica | transcription factor AHAP2. |
| 345 | G1838 | gi5081557 | 1.50E−44 | Petunia x hybrida | PHAP2B protein. |
| 345 | G1838 | gi18476518 | 9.40E−43 | Hordeum vulgare | APETALA2-like protein. |
| 345 | G1838 | gi11181612 | 9.90E−42 | Picea abies | APETALA2-related transcription factor 2. |
| 345 | G1838 | gi5360996 | 3.60E−34 | Hyacinthus orientalis | APETALA2 protein homolog HAP2. |
| 347 | G1841 | BI421895 | 2.00E−37 | Lycopersicon esculentum | EST532561 tomato callus, TAMU Lycop |
| 347 | G1841 | BU873559 | 3.00E−36 | Populus balsamifera subsp. trichocarpa | Q056H03 Populus flow |
| 347 | G1841 | AC120527 | 6.00E−35 | Oryza sativa | chromosome 11 clone OSJNBa0011J22, *** SEQUENC |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 347 | G1841 | AAAA01002409 | 2.00E−34 | Oryza sativa (indica cultivar-group) | ( ) scaffold002409 |
| 347 | G1841 | BE429439 | 7.00E−34 | Triticum aestivum | TAS000.B08R990618 ITEC TAS Wheat cDNA Lib |
| 347 | G1841 | AW685799 | 2.00E−32 | Medicago truncatula | NF030D09NR1F1000 Nodulated root Medicag |
| 347 | G1841 | BE494041 | 5.00E−32 | Secale cereale | WHE1277_B09_D17ZS Secale cereale anther cDNA |
| 347 | G1841 | BU763025 | 1.00E−31 | Glycine max | sas36c11.y1 Gm-c1080 Glycine max cDNA clone SOY |
| 347 | G1841 | CA015575 | 4.00E−31 | Hordeum vulgare subsp. vulgare | HT14L19r HT Hordeum vulgare |
| 347 | G1841 | AV428124 | 8.00E−30 | Lotus japonicus | AV428124 Lotus japonicus young plants (two- |
| 347 | G1841 | gi20160854 | 4.00E−37 | Oryza sativa (japonica cultivar-group) | hypothetical prote |
| 347 | G1841 | gi10798644 | 2.80E−27 | Nicotiana tabacum | AP2 domain-containing transcription fac |
| 347 | G1841 | gi21740822 | 2.50E−26 | Oryza sativa | OSJNBa0042L16.10. |
| 347 | G1841 | gi22074046 | 4.20E−24 | Lycopersicon esculentum | transcription factor JERF1. |
| 347 | G1841 | gi24817250 | 4.20E−24 | Cicer arietinum | transcription factor EREBP-like protein. |
| 347 | G1841 | gi1688233 | 5.40E−24 | Solanum tuberosum | DNA binding protein homolog. |
| 347 | G1841 | gi3264767 | 1.10E−23 | Prunus armeniaca | AP2 domain containing protein. |
| 347 | G1841 | gi18496063 | 3.00E−23 | Fagus sylvatica | ethylene responsive element binding prote |
| 347 | G1841 | gi24940524 | 1.00E−22 | Triticum aestivum | ethylene response element binding prote |
| 347 | G1841 | gi20340233 | 2.70E−22 | Thellungiella halophila | ethylene responsive element bindi |
| 349 | G1842 | AY036888 | 5.00E−56 | Brassica napus | MADS-box protein (FLC1) mRNA, complete cds. |
| 349 | G1842 | BG544805 | 2.00E−37 | Brassica rapa subsp. pekinensis | E2809 Chinese cabbage etiol |
| 349 | G1842 | BG596731 | 7.00E−36 | Solanum tuberosum | EST495409 cSTS Solanum tuberosum cDNA clo |
| 349 | G1842 | AW219962 | 9.00E−36 | Lycopersicon esculentum | EST302445 tomato root during/after |
| 349 | G1842 | BM436799 | 4.00E−34 | Vitis vinifera | VVA010B05_53181 An expressed sequence tag da |
| 349 | G1842 | BQ868455 | 2.00E−30 | Lactuca sativa | QGD14A13.yg.ab1 QG_ABCDI lettuce salinas Lac |
| 349 | G1842 | BI957545 | 1.00E−29 | Hordeum vulgare | HVSMEn0010B09f Hordeum vulgare rachis EST 1 |
| 349 | G1842 | BJ213269 | 2.00E−29 | Triticum aestivum | BJ213269 Y. Ogihara unpublished cDNA libr |
| 349 | G1842 | AI900863 | 4.00E−29 | Glycine max | sb95d06.y1 Gm-c1012 Glycine max cDNA clone GENO |
| 349 | G1842 | AF112150 | 5.00E−29 | Zea mays | MADS box protein 3 (mads3) mRNA, complete cds. |
| 349 | G1842 | gi17933450 | 4.80E−55 | Brassica napus | MADS-box protein. |
| 349 | G1842 | gi1483232 | 1.10E−30 | Betula pendula | MADS5 protein. |
| 349 | G1842 | gi9367313 | 1.40E−30 | Hordeum vulgare | MADS-box protein 8. |
| 349 | G1842 | gi6469345 | 1.80E−30 | Brassica rapa subsp. pekinensis | DNA-binding protein. |
| 349 | G1842 | gi12002141 | 3.00E−30 | Zea mays | MADS box protein 3. |
| 349 | G1842 | gi11037010 | 6.30E−30 | Eucalyptus globulus | MADS-box protein EAP2S. |
| 349 | G1842 | gi1561784 | 6.30E−30 | Brassica oleracea | homeotic protein boiCAL. |
| 349 | G1842 | gi4204234 | 8.00E−30 | Lolium temulentum | MADS-box protein 2. |
| 349 | G1842 | gi13446154 | 1.70E−29 | Pisum sativum | MADS-box transcription factor. |
| 349 | G1842 | gi21070923 | 1.70E−29 | Oryza sativa (japonica cultivar-group) | AP1-like MADS-box |
| 351 | G1843 | AY036889 | 5.00E−56 | Brassica napus | MADS-box protein (FLC2) mRNA, complete cds. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 351 | G1843 | BG596731 | 3.00E−35 | Solanum tuberosum | EST495409 cSTS Solanum tuberosum cDNA clo |
| 351 | G1843 | BG544805 | 4.00E−35 | Brassica rapa subsp. pekinensis | E2809 Chinese cabbage etiol |
| 351 | G1843 | AW219962 | 2.00E−34 | Lycopersicon esculentum | EST302445 tomato root during/after |
| 351 | G1843 | BM436799 | 4.00E−34 | Vitis vinifera | VVA010B05_53181 An expressed sequence tag da |
| 351 | G1843 | BQ850592 | 4.00E−32 | Lactuca sativa | QGB13A16.yg.ab1 QG_ABCDI lettuce salinas Lac |
| 351 | G1843 | BU875165 | 8.00E−32 | Populus balsamifera subsp. trichocarpa | V003A12 Populus flow |
| 351 | G1843 | BU887610 | 9.00E−31 | Populus tremula x Populus tremuloides | R064B01 Populus root |
| 351 | G1843 | AF035379 | 3.00E−30 | Lolium temulentum | MADS-box protein 2 (MADS2) mRNA, alternat |
| 351 | G1843 | AY040247 | 6.00E−30 | Antirrhinum majus | MADS-box transcription factor DEFH28 mRNA |
| 351 | G1843 | gi17933452 | 2.30E−55 | Brassica napus | MADS-box protein. |
| 351 | G1843 | gi21070923 | 7.80E−32 | Oryza sativa (japonica cultivar-group) | AP1-like MADS-box |
| 351 | G1843 | gi16874557 | 1.60E−31 | Antirrhinum majus | MADS-box transcription factor DEFH28. |
| 351 | G1843 | gi4204234 | 2.60E−31 | Lolium temulentum | MADS-box protein 2. |
| 351 | G1843 | gi7592642 | 2.60E−31 | Oryza sativa | AP1-like MADS box protein. |
| 351 | G1843 | gi9367313 | 7.00E−31 | Hordeum vulgare | MADS-box protein 8. |
| 351 | G1843 | gi3688589 | 4.90E−30 | Triticum aestivum | MADS box transcription factor. |
| 351 | G1843 | gi6467974 | 1.00E−29 | Dendrobium grex Madame Thong-In | MADS box protein DOMADS2. |
| 351 | G1843 | gi1483232 | 1.30E−29 | Betula pendula | MADS5 protein. |
| 351 | G1843 | gi13384068 | 1.70E−29 | Petunia x hybrida | MADS-box transcription factor FBP29. |
| 353 | G1852 | AAAA01018591 | 1.00E−135 | Oryza sativa (indica cultivar-group) | ( ) scaffold018591 |
| 353 | G1852 | AF220204 | 1.00E−129 | Malus domestica | unknown mRNA. |
| 353 | G1852 | BQ507509 | 1.00E−119 | Solanum tuberosum | EST614924 Generation of a set of potato c |
| 353 | G1852 | BM412458 | 1.00E−114 | Lycopersicon esculentum | EST586785 tomato breaker fruit Lyco |
| 353 | G1852 | AY104480 | 1.00E−113 | Zea mays | PCO099563 mRNA sequence. |
| 353 | G1852 | BG581705 | 1.00E−108 | Medicago truncatula | EST483440 GVN Medicago truncatula cDNA |
| 353 | G1852 | BF009089 | 1.00E−102 | Glycine max | ss73d04.y1 Gm-c1062 Glycine max cDNA clone GENO |
| 353 | G1852 | AC087192 | 1.00E−101 | Oryza sativa | chromosome 10 clone OSJNBa0005K07, *** SEQUENC |
| 353 | G1852 | BU013091 | 1.00E−100 | Lactuca sativa | QGJ3L13.yg.ab1 QG_EFGHJ lettuce serriola Lac |
| 353 | G1852 | BG445922 | 9.00E−99 | Gossypium arboreum | GA_Ea0030A23f Gossypium arboreum 7-10 d |
| 353 | G1852 | gi24413975 | 8.10E−124 | Oryza sativa (japonica cultivar-group) | hypothetical prote |
| 353 | G1852 | gi6752888 | 2.70E−123 | Malus x domestica | unknown. |
| 353 | G1852 | gi18071395 | 1.20E−122 | Oryza sativa | hypothetical protein. |
| 353 | G1852 | gi18419598 | 1.30E−22 | Narcissus pseudonarcissus | putative methyltransferase prot |
| 353 | G1852 | gi20218829 | 6.60E−16 | Pinus pinaster | hypothetical protein. |
| 353 | G1852 | gi15144514 | 0.089 | Lycopersicon esculentum | unknown. |
| 353 | G1852 | gi498042 | 0.23 | Senecio odorus | ORF. |
| 353 | G1852 | gi4432741 | 0.69 | Dioscorea tenuipes | phosphoglucose isomerase. |
| 353 | G1852 | gi1399380 | 0.81 | Glycine max | S-adenosyl-L-methionine:delta24-sterol-C-meth |
| 355 | G1863 | BH582941 | 4.00E−61 | Brassica oleracea | BOHOL42TF BOHO Brassica oleracea genomic |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 355 | G1863 | AF201895 | 1.00E−34 | Oryza sativa | growth-regulating factor 1 (GRF1) mRNA, comple |
| 355 | G1863 | BM404872 | 2.00E−34 | Solanum tuberosum | EST579199 potato roots Solanum tuberosum |
| 355 | G1863 | AW981431 | 8.00E−34 | Medicago truncatula | EST392584 DSIL Medicago truncatula cDNA |
| 355 | G1863 | BI786182 | 1.00E−33 | Glycine max | sai33h05.y1 Gm-c1065 Glycine max cDNA clone GEN |
| 355 | G1863 | BQ852906 | 3.00E−33 | Lactuca sativa | QGB19E24.yg.ab1 QG_ABCDI lettuce salinas Lac |
| 355 | G1863 | AW442227 | 1.00E−32 | Lycopersicon esculentum | EST311623 tomato fruit red ripe, TA |
| 355 | G1863 | CA029723 | 3.00E−32 | Hordeum vulgare subsp. vulgare | HX05A15r HX Hordeum vulgare |
| 355 | G1863 | AP005538 | 6.00E−32 | Oryza sativa (japonica cultivar-group) | ( ) chromosome 2 clo |
| 355 | G1863 | AAAA01004865 | 1.00E−31 | Oryza sativa (indica cultivar-group) | ( ) scaffold004865 |
| 355 | G1863 | gi6573149 | 1.90E−39 | Oryza sativa | growth-regulating factor 1. |
| 355 | G1863 | gi18390099 | 1.20E−37 | Sorghum bicolor | putative growth-regulating factor 1. |
| 355 | G1863 | gi24413958 | 1.20E−33 | Oryza sativa (japonica cultivar-group) | putative growth-re |
| 355 | G1863 | gi19171209 | 0.12 | Lycopersicon esculentum | viroid RNA-binding protein. |
| 355 | G1863 | gi7008009 | 0.67 | Pisum sativum | PsAD1. |
| 355 | G1863 | gi1061308 | 0.79 | Zea mays | Dof3 gene. |
| 355 | G1863 | gi2129829 | 0.96 | Glycine max | heat shock transcription factor HSF29-soybe |
| 355 | G1863 | gi4680184 | 0.99 | Oryza sativa (indica cultivar-group) | unknown. |
| 355 | G1863 | gi12655953 | 1 | Brassica rapa | luminidependens. |
| 355 | G1863 | gi3790264 | 1 | Triticum aestivum | PBF protein. |
| 357 | G1880 | BI265111 | 1.00E−75 | Medicago truncatula | NF078A11IN1F1085 Insect herbivory Medic |
| 357 | G1880 | BJ192201 | 8.00E−75 | Physcomitrella patens subsp. patens | BJ192201 normalized ful |
| 357 | G1880 | BH714361 | 3.00E−73 | Brassica oleracea | BOMMJ59TR BO_2_3_KB Brassica oleracea gen |
| 357 | G1880 | BI972592 | 1.00E−71 | Glycine max | sai80b06.y1 Gm-c1065 Glycine max cDNA clone GEN |
| 357 | G1880 | AP005381 | 2.00E−71 | Oryza sativa (japonica cultivar-group) | ( ) chromosome 8 clo |
| 357 | G1880 | AAAA01002232 | 2.00E−69 | Oryza sativa (indica cultivar-group) | ( ) scaffold002232 |
| 357 | G1880 | BM063853 | 4.00E−61 | Capsicum annuum | KS01060C10 KS01 Capsicum annuum cDNA, mRNA |
| 357 | G1880 | BU039744 | 1.00E−60 | Prunus persica | PP_LEa0003M02f Peach developing fruit mesoca |
| 357 | G1880 | BM407709 | 3.00E−60 | Solanum tuberosum | EST582036 potato roots Solanum tuberosum |
| 357 | G1880 | BF050813 | 7.00E−60 | Lycopersicon esculentum | EST435971 tomato developing/immatur |
| 357 | G1880 | gi9858780 | 1.50E−58 | Lycopersicon esculentum | BAC19.12. |
| 357 | G1880 | gi10934090 | 1.20E−57 | Oryza sativa | putative zinc finger protein. |
| 357 | G1880 | gi563623 | 2.20E−57 | Solanum tuberosum | putative DNA/RNA binding protein. |
| 357 | G1880 | gi3170601 | 3.30E−57 | Zea mays | zinc finger protein ID1. |
| 357 | G1880 | gi20160482 | 1.40E−56 | Oryza sativa (japonica cultivar-group) | zinc finger protei |
| 357 | G1880 | gi18376601 | 4.40E−12 | Glycine max | WIP1 protein. |
| 357 | G1880 | gi2346988 | 0.059 | Petunia x hybrida | ZPT4-4. |
| 357 | G1880 | gi1076538 | 0.1 | Pisum sativum | gibberellin-responsive ovarian protein G14 |
| 357 | G1880 | gi3129939 | 0.81 | Cicer arietinum | hypothetical protein. |
| 357 | G1880 | gi12585428 | 0.91 | Nicotiana tabacum | Vacuolar ATP synthase subunit G 1 (V-AT |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 359 | G1895 | BH418383 | 5.00E−94 | Brassica oleracea | BOHQS10TR BOHQ Brassica oleracea genomic |
| 359 | G1895 | AC073556 | 7.00E−35 | Oryza sativa | chromosome unknown clone OSJNBa0091P11, *** SE |
| 359 | G1895 | D45066 | 3.00E−34 | Cucurbita maxima | mRNA for AOBP (ascorbate oxidase promoter- |
| 359 | G1895 | BQ488386 | 2.00E−33 | Beta vulgaris | 43-E8885-006-003-F11-T3 Sugar beet MPIZ-ADIS- |
| 359 | G1895 | BF649498 | 9.00E−33 | Medicago truncatula | NF079C08EC1F1065 Elicited cell culture |
| 359 | G1895 | BQ860203 | 3.00E−32 | Lactuca sativa | QGC15B22.yg.ab1 QG_ABCDI lettuce salinas Lac |
| 359 | G1895 | HVU312330 | 4.00E−32 | Hordeum vulgare subsp. vulgare | Hordeum vulgare partial dof |
| 359 | G1895 | AW931465 | 3.00E−31 | Lycopersicon esculentum | EST357308 tomato fruit mature green |
| 359 | G1895 | AAAA01007635 | 4.00E−31 | Oryza sativa (indica cultivar-group) | ( ) scaffold007635 |
| 359 | G1895 | CA783807 | 1.00E−30 | Glycine max | sat57f01.y1 Gm-c1056 Glycine max cDNA clone SOY |
| 359 | G1895 | gi19071625 | 1.80E−41 | Oryza sativa (japonica cultivar-group) | putative zinc fing |
| 359 | G1895 | gi7242908 | 1.40E−40 | Oryza sativa | ESTs C23582(S11122), AU056531 (S20663) corresp |
| 359 | G1895 | gi1669341 | 1.50E−39 | Cucurbita maxima | AOBP (ascorbate oxidase promoter-binding |
| 359 | G1895 | gi21538791 | 4.90E−30 | Hordeum vulgare subsp. vulgare | dof zinc finger protein. |
| 359 | G1895 | gi3929325 | 6.90E−24 | Dendrobium grex Madame Thong-In | putative DNA-binding prot |
| 359 | G1895 | gi1360078 | 1.10E−23 | Nicotiana tabacum | Zn finger protein. |
| 359 | G1895 | gi6092016 | 1.30E−22 | Pisum sativum | elicitor-responsive Dof protein ERDP. |
| 359 | G1895 | gi7688355 | 3.40E−22 | Solanum tuberosum | Dof zinc finger protein. |
| 359 | G1895 | gi1061306 | 9.00E−22 | Zea mays | Dof2. |
| 359 | G1895 | gi3790264 | 3.90E−21 | Triticum aestivum | PBF protein. |
| 361 | G1902 | BH516623 | 8.00E−87 | Brassica oleracea | BOGHO31TR BOGH Brassica oleracea genomic |
| 361 | G1902 | BE610227 | 3.00E−40 | Glycine max | sq51e07.y1 Gm-c1019 Glycine max cDNA clone GENO |
| 361 | G1902 | BE433484 | 2.00E−38 | Lycopersicon esculentum | EST400013 tomato breaker fruit, TIG |
| 361 | G1902 | BQ790994 | 3.00E−38 | Brassica rapa subsp. pekinensis | E4860 Chinese cabbage etiol |
| 361 | G1902 | BQ505729 | 3.00E−37 | Solanum tuberosum | EST613144 Generation of a set of potato c |
| 361 | G1902 | BG454338 | 1.00E−35 | Medicago truncatula | NF113E12LF1F1088 Developing leaf Medica |
| 361 | G1902 | BU832216 | 1.00E−31 | Populus tremula x Populus tremuloides | T030H07 Populus apica |
| 361 | G1902 | BM066503 | 6.00E−30 | Capsicum annuum | KS07015B04 KS07 Capsicum annuum cDNA, mRNA |
| 361 | G1902 | AC133003 | 7.00E−30 | Oryza sativa (japonica cultivar-group) | ( ) chromosome 3 clo |
| 361 | G1902 | AW398140 | 1.00E−29 | Lycopersicon pennellii | EST298023 L. pennellii trichome, Cor |
| 361 | G1902 | gi4996640 | 3.70E−31 | Oryza sativa | Dof zinc finger protein. |
| 361 | G1902 | gi3341468 | 1.80E−30 | Nicotiana tabacum | Dof zinc finger protein. |
| 361 | G1902 | gi3790264 | 2.60E−30 | Triticum aestivum | PBF protein. |
| 361 | G1902 | gi19387252 | 3.30E−30 | Oryza sativa (japonica cultivar-group) | putative zinc-fing |
| 361 | G1902 | gi21538793 | 1.30E−29 | Hordeum vulgare subsp. vulgare | dof zinc finger protein. |
| 361 | G1902 | gi3777436 | 1.80E−29 | Hordeum vulgare | DNA binding protein. |
| 361 | G1902 | gi6092016 | 2.10E−29 | Pisum sativum | elicitor-responsive Dof protein ERDP. |
| 361 | G1902 | gi1061308 | 6.60E−28 | Zea mays | Dof3 gene. |
| 361 | G1902 | gi7688355 | 1.70E−27 | Solanum tuberosum | Dof zinc finger protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 361 | G1902 | gi1669341 | 1.00E−22 | Cucurbita maxima | AOBP (ascorbate oxidase promoter-binding |
| 363 | G1903 | BH590326 | 1.00E−111 | Brassica oleracea | BOGGK32TR BOGG Brassica oleracea genomic |
| 363 | G1903 | AC073556 | 2.00E−41 | Oryza sativa | chromosome unknown clone OSJNBa0091P11, *** SE |
| 363 | G1903 | D45066 | 1.00E−39 | Cucurbita maxima | mRNA for AOBP (ascorbate oxidase promoter- |
| 363 | G1903 | HVU312330 | 3.00E−37 | Hordeum vulgare subsp. vulgare | Hordeum vulgare partial dof |
| 363 | G1903 | AP005167 | 3.00E−35 | Oryza sativa (japonica cultivar-group) | ( ) chromosome 7 clo |
| 363 | G1903 | BQ860203 | 3.00E−35 | Lactuca sativa | QGC15B22.yg.ab1 QG_ABCDI lettuce salinas Lac |
| 363 | G1903 | BI934963 | 3.00E−35 | Lycopersicon esculentum | EST554852 tomato flower, anthesis L |
| 363 | G1903 | AAAA01004298 | 4.00E−35 | Oryza sativa (indica cultivar-group) | ( ) scaffold004298 |
| 363 | G1903 | BF649498 | 9.00E−35 | Medicago truncatula | NF079C08EC1F1065 Elicited cell culture |
| 363 | G1903 | CA484955 | 2.00E−33 | Triticum aestivum | WHE4312_F07_L14ZS Wheat meiotic anther cD |
| 363 | G1903 | gi19071625 | 6.70E−47 | Oryza sativa (japonica cultivar-group) | putative zinc fing |
| 363 | G1903 | gi7242908 | 3.20E−43 | Oryza sativa | ESTs C23582(S11122), AU056531 (S20663) corresp |
| 363 | G1903 | gi1669341 | 8.50E−43 | Cucurbita maxima | AOBP (ascorbate oxidase promoter-binding |
| 363 | G1903 | gi21538791 | 1.90E−39 | Hordeum vulgare subsp. vulgare | dof zinc finger protein. |
| 363 | G1903 | gi1360084 | 6.20E−26 | Nicotiana tabacum | Zn finger protein. |
| 363 | G1903 | gi3790264 | 9.20E−26 | Triticum aestivum | PBF protein. |
| 363 | G1903 | gi2393775 | 7.10E−25 | Zea mays | prolamin box binding factor. |
| 363 | G1903 | gi7688355 | 4.20E−24 | Solanum tuberosum | Dof zinc finger protein. |
| 363 | G1903 | gi6092016 | 5.50E−24 | Pisum sativum | elicitor-responsive Dof protein ERDP. |
| 363 | G1903 | gi3929325 | 9.50E−24 | Dendrobium grex Madame Thong-In | putative DNA-binding prot |
| 365 | G1919 | BH997456 | 3.00E−39 | Brassica oleracea | oef07e04.b1 B. oleracea002 Brassica olerac |
| 365 | G1919 | AP005090 | 7.00E−28 | Oryza sativa (japonica cultivar-group) | ( ) chromosome 9 clo |
| 365 | G1919 | AAAA01013304 | 2.00E−27 | Oryza sativa (indica cultivar-group) | ( ) scaffold013304 |
| 365 | G1919 | AC126012 | 3.00E−26 | Medicago truncatula | clone mth2-27p4, WORKING DRAFT SEQUENCE |
| 365 | G1919 | NPY09105 | 1.00E−23 | Nicotiana plumbaginifolia | N. plumbaginifolia mRNA for unknow |
| 365 | G1919 | BU000353 | 1.00E−22 | Lactuca sativa | QGG24J16.yg.ab1 QG_EFGHJ lettuce serriola La |
| 365 | G1919 | AV914826 | 1.00E−20 | Hordeum vulgare subsp. vulgare | AV914826 K. Sato unpublished |
| 365 | G1919 | AW704699 | 4.00E−18 | Glycine max | sk39d07.y1 Gm-c1028 Glycine max cDNA clone GENO |
| 369 | G1930 | AC135925 | 7.00E−79 | Oryza sativa (japonica cultivar-group) | ( ) chromosome 5 clo |
| 369 | G1930 | AAAA01000997 | 3.00E−78 | Oryza sativa (indica cultivar-group) | ( ) scaffold000997 |
| 369 | G1930 | BU994579 | 1.00E−65 | Hordeum vulgare subsp. vulgare | HM07I08r HM Hordeum vulgare |
| 369 | G1930 | BQ405698 | 1.00E−65 | Gossypium arboreum | GA_Ed0085H02f Gossypium arboreum 7-10 d |
| 369 | G1930 | BF520598 | 1.00E−64 | Medicago truncatula | EST458071 DSIL Medicago truncatula cDNA |
| 369 | G1930 | BZ015521 | 1.00E−64 | Brassica oleracea | oeg86a05.g1 B. oleracea002 Brassica olerac |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 369 | G1930 | BF424857 | 2.00E−58 | *Glycine max* | su59h03.y1 Gm-c1069 *Glycine max* cDNA clone GENO |
| 369 | G1930 | BU870896 | 1.00E−56 | *Populus balsamifera* subsp. *trichocarpa* | Q019F06 *Populus* flow |
| 369 | G1930 | gi18565433 | 4.10E−74 | *Oryza sativa* (*japonica* cultivar-group) | DNA-binding protei |
| 369 | G1930 | gi12328560 | 1.80E−71 | *Oryza sativa* | putative DNA binding protein RAV2. |
| 369 | G1930 | gi10798644 | 1.40E−13 | *Nicotiana tabacum* | AP2 domain-containing transcription fac |
| 369 | G1930 | gi20340233 | 5.10E−11 | *Thellungiella halophila* | ethylene responsive element bindi |
| 369 | G1930 | gi4099921 | 1.30E−10 | *Stylosanthes hamata* | EREBP-3 homolog. |
| 369 | G1930 | gi18496063 | 1.60E−10 | *Fagus sylvatica* | ethylene responsive element binding prote |
| 369 | G1930 | gi22074046 | 2.10E−10 | *Lycopersicon esculentum* | transcription factor JERF1. |
| 369 | G1930 | gi3264767 | 2.30E−10 | *Prunus armeniaca* | AP2 domain containing protein. |
| 369 | G1930 | gi18266198 | 1.10E−09 | *Narcissus pseudonarcissus* | AP-2 domain containing protein. |
| 369 | G1930 | gi24940524 | 1.10E−09 | *Triticum aestivum* | ethylene response element binding prote |
| 371 | G1936 | AX540653 | 1.00E−139 | *Zea mays* | Sequence 9 from Patent WO0240688. |
| 371 | G1936 | BH735681 | 4.00E−45 | *Brassica oleracea* | BOHTG58TR BO_2_3_KB *Brassica oleracea* gen |
| 371 | G1936 | AW279046 | 2.00E−28 | *Glycine max* | sg07b03.y1 Gm-c1019 *Glycine max* cDNA clone GENO |
| 371 | G1936 | BQ874162 | 2.00E−26 | *Lactuca sativa* | QGI4J06.yg.ab1 QG_ABCDI lettuce salinas Lact |
| 371 | G1936 | BG645784 | 5.00E−26 | *Medicago truncatula* | EST507403 KV3 *Medicago truncatula* cDNA |
| 371 | G1936 | AP004223 | 5.00E−26 | *Oryza sativa* (*japonica* cultivar-group) | ( ) genomic DNA, chr |
| 371 | G1936 | AW219090 | 2.00E−23 | *Lycopersicon esculentum* | EST301572 tomato root during/after |
| 371 | G1936 | BQ118395 | 5.00E−23 | *Solanum tuberosum* | EST603971 mixed potato tissues *Solanum* tu |
| 371 | G1936 | CA816557 | 6.00E−23 | *Vitis vinifera* | CA12EI303IVF_H11 Cabernet Sauvignon Leaf-C |
| 371 | G1936 | BG445379 | 3.00E−22 | *Gossypium arboreum* | GA_Ea0027O21f *Gossypium arboreum* 7-10 d transcription fact |
| 371 | G1936 | gi20975251 | 7.50E−23 | *Oryza sativa* (*japonica* cultivar-group) | |
| 371 | G1936 | gi2580440 | 2.20E−21 | *Oryza sativa* | PCF2. |
| 371 | G1936 | gi5731257 | 5.00E−21 | *Gossypium hirsutum* | auxin-induced basic helix-loop-helix t |
| 371 | G1936 | gi6358622 | 0.00035 | *Digitalis purpurea* | cyc4 protein. |
| 371 | G1936 | gi6358625 | 0.00035 | *Misopates orontium* | cyc4 protein. |
| 371 | G1936 | gi6358621 | 0.00061 | *Antirrhinum majus* subsp. *cirrhigerum* | cyc4 protein. |
| 371 | G1936 | gi6358623 | 0.00061 | *Antirrhinum graniticum* | cyc4 protein. |
| 371 | G1936 | gi6466188 | 0.00085 | *Antirrhinum majus* | flower asymmetry protein DICHOTOMA. |
| 371 | G1936 | gi12002867 | 0.0036 | *Lycopersicon esculentum* | cycloidea. |
| 371 | G1936 | gi6358551 | 0.0092 | *Antirrhinum majus* subsp. *linkianum* | cyc1A protein. |
| 373 | G1944 | BU926769 | 1.00E−86 | *Glycine max* | sas91d09.y1 Gm-c1036 *Glycine max* cDNA clone SOY |
| 373 | G1944 | BU814921 | 8.00E−73 | *Populus tremula* x *Populus tremuloides* | N034H11 *Populus* bark |
| 373 | G1944 | BG589060 | 8.00E−70 | *Medicago truncatula* | EST490869 MHRP- *Medicago truncatula* cDN |
| 373 | G1944 | BG441060 | 1.00E−64 | *Gossypium arboreum* | GA_Ea0011I19f *Gossypium arboreum* 7-10 d |
| 373 | G1944 | BI139442 | 3.00E−64 | *Populus balsamifera* subsp. *trichocarpa* | F131P74Y *Populus* flo |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 373 | G1944 | BG643949 | 5.00E−59 | Lycopersicon esculentum | EST512143 tomato shoot/meristem Lyc |
| 373 | G1944 | AU289368 | 2.00E−58 | Zinnia elegans | AU289368 zinnia cultured mesophyll cell equa |
| 373 | G1944 | BQ868100 | 3.00E−52 | Lactuca sativa | QGD13A19.yg.ab1 QG_ABCDI lettuce salinas Lac |
| 373 | G1944 | BU892499 | 2.00E−50 | Populus tremula | P064F04 Populus petioles cDNA library Popul |
| 373 | G1944 | AV425818 | 1.00E−48 | Lotus japonicus | AV425818 Lotus japonicus young plants (two- |
| 373 | G1944 | gi12643044 | 7.80E−58 | Oryza sativa | putative AT-Hook DNA-binding protein. |
| 373 | G1944 | gi2213536 | 4.40E−45 | Pisum sativum | DNA-binding protein PD1. |
| 373 | G1944 | gi4165183 | 3.20E−41 | Antirrhinum majus | SAP1 protein. |
| 373 | G1944 | gi24418033 | 4.50E−15 | Oryza sativa (japonica cultivar-group) | Hypothetical prote |
| 373 | G1944 | gi100212 | 0.0032 | Lycopersicon esculentum | extensin class II (clones u1/u2) |
| 373 | G1944 | gi167556 | 0.016 | Daucus carota | extensin. |
| 373 | G1944 | gi555655 | 0.035 | Nicotiana tabacum | DNA-binding protein. |
| 373 | G1944 | gi72327 | 0.043 | Zea mays | glutelin 5-maize. |
| 373 | G1944 | gi1076237 | 0.06 | Pinus taeda | arabinogalactan-like protein-loblolly pine. |
| 373 | G1944 | gi1247390 | 0.076 | Nicotiana alata | PRP3. |
| 375 | G1946 | LPHSF8 | 1.00E−127 | Lycopersicon peruvianum | L. peruvianum Lp-hsf8 mRNA for heat |
| 375 | G1946 | AC087771 | 4.00E−96 | Medicago truncatula | clone 8D15, *** SEQUENCING IN PROGRESS |
| 375 | G1946 | LEHSF8 | 300E−86 | Lycopersicon esculentum | L. esculentum Le-hsf8 gene for heat |
| 375 | G1946 | AW569256 | 1.00E−84 | Glycine max | si64g09.y1 Gm-r1030 Glycine max cDNA clone GENO |
| 375 | G1946 | AAAA01005302 | 7.00E−80 | Oryza sativa (indica cultivar-group) | ( )scaffold0053O02 |
| 375 | G1946 | AC120506 | 1.00E−79 | Oryza sativa | chromosome 3 clone OSJNBb0006008, *** SEQUENCI |
| 375 | G1946 | BG890899 | 2.00E−79 | Solanum tuberosum | EST516750 cSTD Solanum tuberosum cDNA clo |
| 375 | G1946 | BU834690 | 8.00E−73 | Populus tremula x Populus tremuloides | T064E07 Populus apica |
| 375 | G1946 | AV833112 | 1.00E−60 | Hordeum vulgare subsp. vulgare | AV833112 K. Sato unpublished |
| 375 | G1946 | BQ916240 | 4.00E−59 | Helianthus annuus | QHB17D05.yg.ab1 QH_ABCDI sunflower RHA801 |
| 375 | G1946 | gi100264 | 1.90E−123 | Lycopersicon peruvianum | heat shock transcription factor H |
| 375 | G1946 | gi100225 | 9.10E−109 | Lycopersicon esculentum | heat shock transcription factor H |
| 375 | G1946 | gi24308618 | 5.40E−63 | Oryza sativa (japonica cultivar-group) | Putative heat shoc |
| 375 | G1946 | gi5821138 | 5.40E−55 | Nicotiana tabacum | heat shock factor. |
| 375 | G1946 | gi662924 | 2.10E−52 | Glycine max | heat shock transcription factor 21. |
| 375 | G1946 | gi25052685 | 2.50E−51 | Helianthus annuus | heat stress transcription factor HSFA9. |
| 375 | G1946 | gi16118447 | 4.80E−50 | Phaseolus acutifolius | heat shock transcription factor. |
| 375 | G1946 | gi14209551 | 6.10E−48 | Oryza sativa | putative heat shock factor. |
| 375 | G1946 | gi20162459 | 1.40E−46 | Medicago sativa | heat shock transcription factor. |
| 375 | G1946 | gi1362193 | 3.40E−45 | Zea mays | heat shock factor-maize. |
| 377 | G1947 | BE319312 | 1.00E−49 | Medicago truncatula | NF015D08NR1F1035 Nodulated root Medicag |
| 377 | G1947 | LPHSF30 | 1.00E−48 | Lycopersicon peruvianum | L. peruvianum Lp-hsf30 mRNA for heat |
| 377 | G1947 | BM086093 | 5.00E−48 | Glycine max | sah35d07.y1 Gm-c1036 Glycine max cDNA clone SOY |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 377 | G1947 | AV833112 | 6.00E−47 | Hordeum vulgare subsp. vulgare | AV833112 K. Sato unpublished |
| 377 | G1947 | BI406849 | 2.00E−44 | Solanum tuberosum | 182A06 Mature tuber lambda ZAP Solanum tu |
| 377 | G1947 | AY099451 | 2.00E−44 | Helianthus annuus | heat stress transcription factor HSFA9 mR |
| 377 | G1947 | AW034874 | 8.00E−44 | Lycopersicon esculentum | EST279103 tomato callus, TAMU Lycop |
| 377 | G1947 | AAAA01016817 | 1.00E−42 | Oryza sativa (indica cultivar-group) | ( )scaffold016817 |
| 377 | G1947 | BI305378 | 6.00E−39 | Oryza sativa | NRS_2_7_8_A01_K18 Drought stress (root) Oryza |
| 377 | G1947 | BI479783 | 4.00E−38 | Triticum aestivum | WHE3452_A08_A16ZS Wheat pre-anthesis spik |
| 377 | G1947 | gi100265 | 2.10E−47 | Lycopersicon peruvianum | heat shock transcription factor H |
| 377 | G1947 | gi2129828 | 8.70E−40 | Glycine max | heat shock transcription factor HSF21-soybe |
| 377 | G1947 | gi20521264 | 4.30E−39 | Oryza sativa (japonica cultivar-group) | putative heat shoc |
| 377 | G1947 | gi25052685 | 5.50E−38 | Helianthus annuus | heat stress transcription factor HSFA9. |
| 377 | G1947 | gi14209551 | 9.30E−38 | Oryza sativa | putative heat shock factor. |
| 377 | G1947 | gi16118447 | 1.20E−37 | Phaseolus acutifolius | heat shock transcription factor. |
| 377 | G1947 | gi20162459 | 2.70E−36 | Medicago sativa | heat shock transcription factor. |
| 377 | G1947 | gi5821138 | 4.50E−36 | Nicotiana tabacum | heat shock factor. |
| 377 | G1947 | gi2130133 | 7.30E−36 | Zea mays | heat shock transcription factor (clone hsfa)-m |
| 377 | G1947 | gi100225 | 2.50E−35 | Lycopersicon esculentum | heat shock transcription factor H |
| 379 | G1948 | BG321479 | 1.00E−128 | Descurainia sophia | Ds01_07g10_A Ds01_AAFC_ECORC_cold_stress |
| 379 | G1948 | BQ704285 | 1.00E−100 | Brassica napus | Bn01_04d19_A |
| 379 | G1948 | AC098693 | 3.00E−92 | Oryza sativa | chromosome 3 clone OJ1004_C08, *** SEQUENCING |
| 379 | G1948 | BH435688 | 2.00E−88 | Brassica oleracea | BOHHK12TF BOHH Brassica oleracea genomic |
| 379 | G1948 | BI933410 | 4.00E−59 | Lycopersicon esculentum | EST553311 tomato flower, anthesis L |
| 379 | G1948 | BQ511165 | 7.00E−58 | Solanum tuberosum | EST618580 Generation of a set of potato c |
| 379 | G1948 | AAAA01005130 | 5.00E−57 | Oryza sativa (indica cultivar-group) | ( ) scaffold005130 |
| 379 | G1948 | BU011081 | 9.00E−53 | Lactuca sativa | QGJ15D24.yg.ab1 QG_EFGHJ lettuce serriola La |
| 379 | G1948 | BU031848 | 6.00E−39 | Helianthus annuus | QHJ19M09.yg.ab1 QH_EFGHJ sunflower RHA280 |
| 379 | G1948 | BG300992 | 3.00E−36 | Hordeum vulgare | HVSMEb0019C24f Hordeum vulgare seedling sho |
| 379 | G1948 | gi20502992 | 5.50E−86 | Oryza sativa (japonica cultivar-group) | Putative CAO prote |
| 379 | G1948 | gi549986 | 1.40E−12 | Pennisetum ciliare | possible apospory-associated protein. |
| 379 | G1948 | gi19070767 | 3.10E−12 | Oryza sativa | apospory-associated protein. |
| 379 | G1948 | gi24637568 | 5.50E−12 | Nicotiana tabacum | ankyrin domain protein. |
| 379 | G1948 | gi17645766 | 9.80E−12 | Glycine max | unnamed protein product. |
| 379 | G1948 | gi7110220 | 1.20E−06 | Triticum aestivum | AKT1-like potassium channel. |
| 379 | G1948 | gi2104908 | 1.50E−05 | Zea mays | potassium channel. |
| 379 | G1948 | gi24745936 | 1.70E−05 | Solanum tuberosum | ankyrin-like protein. |
| 379 | G1948 | gi20127124 | 0.00014 | Brassica napus | calmodulin-binding transcription activator |
| 379 | G1948 | gi16550932 | 0.00031 | Eucalyptus camaldulensis | inward-rectifying K+ channel. |
| 381 | G1950 | BG599002 | 2.00E−83 | Solanum tuberosum | EST503902 cSTS Solanum tuberosum cDNA clo |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 381 | G1950 | BQ857787 | 4.00E−78 | *Lactuca sativa* | QGB8H12.yg.ab1 QG_ABCDI lettuce salinas Lact |
| 381 | G1950 | AW100050 | 3.00E−69 | *Glycine max* | sd25e07.y1 Gm-c1012 *Glycine max* cDNA clone GENO |
| 381 | G1950 | BF177815 | 4.00E−60 | *Lotus japonicus* | Ljirnpest34-724-d7 Ljirnp Lambda HybriZap t |
| 381 | G1950 | BG466155 | 1.00E−59 | *Euphorbia esula* | 00918 leafy spurge Lambda HybriZAP 2.1 two- |
| 381 | G1950 | BU820489 | 3.00E−55 | *Populus tremula* | UB10CPG06 *Populus tremula* cambium cDNA libr |
| 381 | G1950 | BE443704 | 1.00E−50 | *Triticum aestivum* | WHE1121_C05_E09ZS Wheat etiolated seedlin |
| 381 | G1950 | BG267984 | 3.00E−49 | *Zea mays* | 1000144D01.x1 1000- Unigene I from Maize Genome P |
| 381 | G1950 | BI266915 | 1.00E−47 | *Medicago truncatula* | NF097B04IN1F1041 Insect herbivory Medic |
| 381 | G1950 | BM412345 | 2.00E−46 | *Lycopersicon esculentum* | EST586672 tomato breaker fruit Lyco |
| 381 | G1950 | gi15341604 | 1.00E−77 | *Oryza sativa* | putative ankyrin. |
| 381 | G1950 | gi24745936 | 5.80E−21 | *Solanum tuberosum* | ankyrin-like protein. |
| 381 | G1950 | gi13310811 | 9.00E−17 | *Nicotiana tabacum* | ankyrin-repeat protein HBP1. |
| 381 | G1950 | gi7110220 | 1.10E−16 | *Triticum aestivum* | AKT1-like potassium channel. |
| 381 | G1950 | gi21328024 | 4.00E−16 | *Oryza sativa (japonica cultivar-group)* | putative AKT1-like |
| 381 | G1950 | gi17645764 | 9.90E−16 | *Glycine max* | unnamed protein product. |
| 381 | G1950 | gi549986 | 1.60E−15 | *Pennisetum ciliare* | possible apospory- associated protein. |
| 381 | G1950 | gi2104908 | 4.30E−15 | *Zea mays* | potassium channel. |
| 381 | G1950 | gi2832781 | 3.70E−13 | *Egeria densa* | inward potassium channel alpha subunit. |
| 381 | G1950 | gi8896127 | 1.20E−11 | *Mesembryanthemum crystallinum* | putative potassium channel |
| 383 | G1958 | BH495974 | 5.00E−76 | *Brassica oleracea* | BOHHB37TF BOHH *Brassica oleracea* genomic |
| 383 | G1958 | AB017693 | 7.00E−70 | *Nicotiana tabacum* | WERBP-1 mRNA, complete cds. |
| 383 | G1958 | AF219972 | 4.00E−62 | *Mesembryanthemum crystallinum* | CDPK substrate protein 1 (csp |
| 383 | G1958 | AW507631 | 1.00E−60 | *Glycine max* | si42c09.y1 Gm-r1030 *Glycine max* cDNA clone GENO |
| 383 | G1958 | AW684291 | 6.00E−59 | *Medicago truncatula* | NF015B02NR1F1000 Nodulated root Medicag |
| 383 | G1958 | BQ806133 | 4.00E−58 | *Triticum aestivum* | WHE3575_B11_C21ZS Wheat developing grains |
| 383 | G1958 | AW030183 | 3.00E−56 | *Lycopersicon esculentum* | EST273438 tomato callus, TAMU Lycop |
| 383 | G1958 | BQ587750 | 2.00E−53 | *Beta vulgaris* | E012340-024-010-G07-SP6 MPIZ-ADIS-024-leaf Be |
| 383 | G1958 | AY107734 | 2.00E−53 | *Zea mays* | PCO065209 mRNA sequence. |
| 383 | G1958 | CA516596 | 4.00E−51 | *Capsicum annuum* | KS09060E12 KS09 *Capsicum annuum* cDNA, mRNA |
| 383 | G1958 | gi4519671 | 3.70E−66 | *Nicotiana tabacum* | transfactor. |
| 383 | G1958 | gi6942190 | 1.50E−58 | *Mesembryanthemum crystallinum* | CDPK substrate protein 1; C |
| 383 | G1958 | gi5916207 | 9.80E−27 | *Chlamydomonas reinhardtii* | regulatory protein of P- starvat |
| 383 | G1958 | gi23306130 | 6.00E−13 | *Oryza sativa (japonica cultivar-group)* | Unknown protein. |
| 383 | G1958 | gi15289981 | 8.40E−13 | *Oryza sativa* | hypothetical protein. |
| 383 | G1958 | gi11177540 | 6.60E−10 | *Zea mays* | putative transcription factor Golden2. |
| 383 | G1958 | gi1946222 | 0.81 | *Malus domestica* | knotted1-like homeobox protein. |
| 383 | G1958 | gi15144509 | 0.96 | *Lycopersicon esculentum* | unknown. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 383 | G1958 | gi2317676 | 0.96 | Fagopyrum esculentum | declined protein during seed develo |
| 383 | G1958 | gi538502 | 0.96 | Stylosanthes humilis | peroxidase. |
| 385 | G2007 | AF161711 | 9.00E−78 | Pimpinella brachycarpa | myb-related transcription factor mRN |
| 385 | G2007 | CA783329 | 7.00E−75 | Glycine max | sat22g04.y1 Gm-c1036 Glycine max cDNA clone SOY |
| 385 | G2007 | BU81821 | 1.00E−69 | Populus tremula x Populus tremuloides | UL88TH12 Populus leaf |
| 385 | G2007 | AI770808 | 1.00E−67 | Zea mays | 606058F03.x2 606-Ear tissue cDNA library from Sc |
| 385 | G2007 | OSA311053 | 2.00E−67 | Oryza sativa | mRNA for Myb15 protein (myb15 gene). |
| 385 | G2007 | LETHM16 | 2.00E−66 | Lycopersicon esculentum | L. esculentum mRNA for myb-related t |
| 385 | G2007 | BQ624834 | 5.00E−65 | Citrus sinensis | USDA-FP_01925 Ridge pineapple sweet orange |
| 385 | G2007 | BU868208 | 2.00E−64 | Populus balsamifera subsp. trichocarpa | M112E10 Populus flow |
| 385 | G2007 | AW685586 | 7.00E−64 | Medicago truncatula | NF032A05NR1F1000 Nodulated root Medicag |
| 385 | G2007 | BQ245626 | 2.00E−62 | Triticum aestivum | TaE15022B12R TaE15 Triticum aestivum cDNA |
| 385 | G2007 | gi6651292 | 7.50E−78 | Pimpinella brachycarpa | myb-related transcription factor. |
| 385 | G2007 | gi23343577 | 4.60E−66 | Oryza sativa | Myb13 protein. |
| 385 | G2007 | gi1430846 | 4.10E−65 | Lycopersicon esculentum | myb-related transcription factor. |
| 385 | G2007 | gi19072740 | 5.00E−60 | Zea mays | typical P-type R2R3 Myb protein. |
| 385 | G2007 | gi19073330 | 4.50E−59 | Sorghum bicolor | typical P-type R2R3 Myb protein. |
| 385 | G2007 | gi20563 | 2.60E−53 | Petunia x hybrida | protein 1. |
| 385 | G2007 | gi22638 | 3.00E−53 | Physcomitrella patens | Pp2. |
| 385 | G2007 | gi13346194 | 1.50E−51 | Gossypium hirsutum | GHMYB9. |
| 385 | G2007 | gi19386839 | 2.60E−51 | Oryza sativa (japonica cultivar-group) | putative myb-relat |
| 385 | G2007 | gi4886264 | 5.90E−50 | Antirrhinum majus | Myb-related transcription factor mixta- |
| 387 | G2010 | BH969114 | 2.00E−41 | Brassica oleracea | odg08d11.b1 B. oleracea002 Brassica olerac |
| 387 | G2010 | BQ847567 | 1.00E−34 | Lactuca sativa | QGA3h03.yg.ab1 QG_ABCDI lettuce salinas Lact |
| 387 | G2010 | BG525285 | 4.00E−34 | Stevia rebaudiana | 48-3 Stevia field grown leaf cDNA Stevia |
| 387 | G2010 | BI928213 | 5.00E−34 | Lycopersicon esculentum | EST548102 tomato flower, 3-8 mm b |
| 387 | G2010 | BU824105 | 8.00E−34 | Populus tremula | UB60BPD08 Populus tremula cambium cDNA libr |
| 387 | G2010 | AMSPB1 | 1.00E−32 | Antirrhinum majus | A. majus mRNA for squamosa-promoter bindin |
| 387 | G2010 | CA516258 | 3.00E−32 | Capsicum annuum | KS09055D03 KS09 Capsicum annuum cDNA, mRNA |
| 387 | G2010 | BE058432 | 5.00E−32 | Glycine max | sn16a06.y1 Gm-c1016 Glycine max cDNA clone GENO |
| 387 | G2010 | BG455868 | 6.00E−32 | Medicago truncatula | NF068F05PL1F1045 Phosphate starved leaf |
| 387 | G2010 | BU028945 | 2.00E−30 | Helianthus annuus | QHH6J19.yg.ab1 QH_EFGHJ sunflower RHA280 |
| 387 | G2010 | gi1183866 | 2.50E−33 | Antirrhinum majus | squamosa-promoter binding protein 1. |
| 387 | G2010 | gi5931780 | 1.10E−27 | Zea mays | SBP-domain protein 2. |
| 387 | G2010 | gi8468036 | 2.30E−23 | Oryza sativa | Similar to Arabidopsis thaliana chromosome 2 |
| 387 | G2010 | gi9087308 | 1.50E−10 | Mitochondrion Beta vulgaris var. altissima | orf102a. |
| 387 | G2010 | gi22535625 | 0.53 | Oryza sativa (japonica cultivar-group) | hypothetical prote |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 387 | G2010 | gi14597634 | 1 | *Physcomitrella patens* | 15_ppprot1_080_c02. |
| 387 | G2010 | gi7209500 | 1 | *Brassica rapa* | S-locus pollen protein. |
| 389 | G2053 | BH923697 | 3.00E−31 | *Brassica oleracea* | odi23h12.b1 *B. oleracea*002 *Brassica* olerac |
| 389 | G2053 | AF532619 | 2.00E−25 | *Glycine max* | no apical meristem-like protein mRNA, complete |
| 389 | G2053 | AF509874 | 2.00E−24 | *Petunia* x *hybrida* | nam-like protein 11 (NH11) mRNA, complete |
| 389 | G2053 | BQ864249 | 4.00E−24 | *Lactuca sativa* | QGC26D03.yg.ab1 QG_ABCDI lettuce salinas Lac |
| 389 | G2053 | BI246023 | 8.00E−24 | *Sorghum bicolor* | IP1_66_F11.b1_A002 Immature pannicle 1 (IP1 |
| 389 | G2053 | CA815703 | 1.00E−23 | *Vitis vinifera* | CA12EI204IVF_E10 Cabernet Sauvignon Leaf-C |
| 389 | G2053 | BQ586991 | 1.00E−23 | *Beta vulgaris* | E012352-024-011-F06-SP6 MPIZ-ADIS-024-leaf Be |
| 389 | G2053 | BF645220 | 1.00E−23 | *Medicago truncatula* | NF032F12EC1F1102 Elicited cell culture |
| 389 | G2053 | BU894596 | 1.00E−23 | *Populus tremula* x *Populus tremuloides* | X011H04 *Populus* wood |
| 389 | G2053 | BG543974 | 1.00E−23 | *Brassica rapa* subsp. *pekinensis* | E1725 Chinese cabbage etiol |
| 389 | G2053 | gi22597158 | 6.50E−28 | *Glycine max* | no apical meristem-like protein. |
| 389 | G2053 | gi21105736 | 2.00E−26 | *Petunia* x *hybrida* | nam-like protein 4. |
| 389 | G2053 | gi15148912 | 8.50E−26 | *Phaseolus vulgaris* | NAC domain protein NAC1. |
| 389 | G2053 | gi19225018 | 1.10E−25 | *Oryza sativa* (*japonica* cultivar-group) | putative NAM (no a |
| 389 | G2053 | gi7716952 | 1.10E−25 | *Medicago truncatula* | NAC1. |
| 389 | G2053 | gi6175246 | 2.30E−25 | *Lycopersicon esculentum* | jasmonic acid 2. |
| 389 | G2053 | gi4218535 | 2.00E−24 | *Triticum* sp. | GRAB1 protein. |
| 389 | G2053 | gi6730936 | 2.00E−24 | *Oryza sativa* | OsNAC3 protein. |
| 389 | G2053 | gi6732154 | 2.00E−24 | *Triticum monococcum* | unnamed protein product. |
| 389 | G2053 | gi14485513 | 6.20E−23 | *Solanum tuberosum* | putative NAC domain protein. |
| 391 | G2059 | AW257352 | 3.00E−44 | *Medicago truncatula* | EST305489 KV2 *Medicago truncatula* cDNA |
| 391 | G2059 | BI972689 | 1.00E−36 | *Glycine max* | sai81e12.y1 Gm-c1065 *Glycine max* cDNA clone GEN |
| 391 | G2059 | BQ408107 | 5.00E−29 | *Gossypium arboreum* | GA_Ed0006B09f *Gossypium arboreum* 7-10 d |
| 391 | G2059 | BI922932 | 2.00E−28 | *Lycopersicon esculentum* | EST542836 tomato callus Lycopersico |
| 391 | G2059 | CA018649 | 6.00E−28 | *Hordeum vulgare* subsp. *vulgare* | HV09E02r HV *Hordeum vulgare* |
| 391 | G2059 | BM406373 | 6.00E−28 | *Solanum tuberosum* | EST580796 potato roots *Solanum tuberosum* |
| 391 | G2059 | AW618459 | 1.00E−27 | *Lycopersicon pennellii* | EST320445 *L. pennellii* trichome, Cor |
| 391 | G2059 | BI958427 | 1.00E−27 | *Hordeum vulgare* | HVSMEn0014O18f *Hordeum vulgare* rachis EST 1 |
| 391 | G2059 | BU894329 | 1.00E−27 | *Populus tremula* x *Populus tremuloides* | X007E05 *Populus* wood |
| 391 | G2059 | AI166481 | 5.00E−27 | *Populus balsamifera* subsp. *trichocarpa* | xylem.est.309 Poplar |
| 391 | G2059 | gi19920190 | 1.40E−29 | *Oryza sativa* (*japonica* cultivar-group) | Putative AP2 domai |
| 391 | G2059 | gi8571476 | 1.90E−28 | *Atriplex hortensis* | apetala2 domain-containing protein. |
| 391 | G2059 | gi21908036 | 4.60E−27 | *Zea mays* | DRE binding factor 1. |
| 391 | G2059 | gi14140163 | 3.30E−23 | *Oryza sativa* | putative AP2 domain containing protein. |
| 391 | G2059 | gi131754 | 1.60E−19 | *Lupinus polyphyllus* | PPLZ02 PROTEIN. |
| 391 | G2059 | gi3342211 | 2.10E−19 | *Lycopersicon esculentum* | Pti4. |
| 391 | G2059 | gi1208497 | 1.90E−18 | *Nicotiana tabacum* | EREBP-4. |
| 391 | G2059 | gi20303011 | 5.70E−18 | *Brassica napus* | CBF-like protein CBF5. |
| 391 | G2059 | gi19071243 | 7.40E−18 | *Hordeum vulgare* | CRT/DRE binding factor 1. |
| 391 | G2059 | gi7528276 | 9.70E−18 | *Mesembryanthemum crystallinum* | AP2-related transcription f |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 393 | G2085 | BI498544 | 7.00E−59 | *Glycine max* | sai15e07.y1 Gm-c1053 *Glycine max* cDNA clone GEN |
| 393 | G2085 | BM437375 | 8.00E−47 | *Vitis vinifera* | VVA018E12_54245 An expressed sequence tag da |
| 393 | G2085 | BI308204 | 7.00E−46 | *Medicago truncatula* | EST529614 GPOD *Medicago truncatula* cDNA |
| 393 | G2085 | BQ295376 | 8.00E−45 | *Triticum aestivum* | WHE2869_C08_F15ZS Wheat unstressed root t |
| 393 | G2085 | BF199732 | 7.00E−44 | *Triticum monococcum* | WHE0591-0594_H22_H22ZE *Triticum monococ* |
| 393 | G2085 | AY103800 | 2.00E−43 | *Zea mays* | PCO084138 mRNA sequence. |
| 393 | G2085 | BH723453 | 3.00E−40 | *Brassica oleracea* | BOMBQ10TR BO_2_3_KB *Brassica oleracea* gen |
| 393 | G2085 | BU993000 | 4.00E−39 | *Hordeum vulgare* | HD12E09r HD *Hordeum vulgare* cDNA clone HD12 |
| 393 | G2085 | BU815658 | 4.00E−38 | *Populus tremula* x *Populus tremuloides* | N044F04 *Populus* bark |
| 393 | G2085 | BQ987329 | 1.00E−36 | *Lactuca sativa* | QGF11O18.yg.ab1 QG_EFGHJ lettuce serriola La |
| 393 | G2085 | gi13174240 | 3.20E−42 | *Oryza sativa* | putative zinc finger protein. |
| 393 | G2085 | gi23237937 | 4.30E−09 | *Oryza sativa (japonica cultivar-group)* | transposase-like. |
| 393 | G2085 | gi12711287 | 0.00061 | *Nicotiana tabacum* | GATA-1 zinc finger protein. |
| 393 | G2085 | gi21655162 | 0.0027 | *Hordeum vulgare* subsp. *vulgare* | CONSTANS-like protein CO9. |
| 393 | G2085 | gi1076609 | 0.015 | *Nicotiana plumbaginifolia* | NTL1 protein-curled-leaved to |
| 393 | G2085 | gi22854920 | 0.017 | *Brassica nigra* | COL1 protein. |
| 393 | G2085 | gi3341723 | 0.082 | *Raphanus sativus* | CONSTANS-like 1 protein. |
| 393 | G2085 | gi21667485 | 0.15 | *Hordeum vulgare* | CONSTANS-like protein. |
| 393 | G2085 | gi4091804 | 0.46 | *Malus* x *domestica* | CONSTANS-like protein 1. |
| 393 | G2085 | gi2303681 | 0.49 | *Brassica napus* | unnamed protein product. |
| 395 | G2105 | BM110736 | 3.00E−50 | *Solanum tuberosum* | EST558272 potato roots *Solanum tuberosum* |
| 395 | G2105 | BQ866994 | 2.00E−49 | *Lactuca sativa* | QGC9I02.yg.ab1 QG_ABCDI lettuce salinas Lact |
| 395 | G2105 | BH975294 | 6.00E−45 | *Brassica oleracea* | odh15d05.b1 *B. oleracea*002 *Brassica olerac* |
| 395 | G2105 | BF646615 | 2.00E−41 | *Medicago truncatula* | NF066C08EC1F1065 Elicited cell culture |
| 395 | G2105 | OSGT2 | 4.00E−32 | *Oryza sativa* | *O. sativa* gt-2 gene. |
| 395 | G2105 | AI777252 | 1.00E−28 | *Lycopersicon esculentum* | EST258217 tomato resistant, Cornell |
| 395 | G2105 | BU049946 | 3.00E−27 | *Zea mays* | 1111017E09.y1 1111-Unigene III from Maize Genome |
| 395 | G2105 | AB052729 | 4.00E−26 | *Pisum sativum* | mRNA for DNA-binding protein DF1, complete cd |
| 395 | G2105 | AF372499 | 4.00E−25 | *Glycine max* | GT-2 factor mRNA, partial cds. |
| 395 | G2105 | BU889446 | 4.00E−24 | *Populus tremula* | P021A05 *Populus* petioles cDNA library Popul |
| 395 | G2105 | gi13646986 | 2.40E−39 | *Pisum sativum* | DNA-binding protein DF1. |
| 395 | G2105 | gi20249 | 2.20E−35 | *Oryza sativa* | gt-2. |
| 395 | G2105 | gi18182311 | 1.70E−27 | *Glycine max* | GT-2 factor. |
| 395 | G2105 | gi20161567 | 9.10E−08 | *Oryza sativa (japonica cultivar-group)* | hypothetical prote |
| 395 | G2105 | gi170271 | 1.70E−05 | *Nicotiana tabacum* | DNA-binding protein. |
| 395 | G2105 | gi4456620 | 0.36 | *Hordeum vulgare* | alpha-galactosidase. |
| 395 | G2105 | gi3645898 | 0.68 | *Zea mays* | in-frame stop codon; possibly a post-transpositi |
| 395 | G2105 | gi531098 | 0.95 | *Zinnia elegans* | TED3. |
| 395 | G2105 | gi1657853 | 1 | *Triticum aestivum* | cold acclimation protein WCOR825. |
| 395 | G2105 | gi20086402 | 1 | *Isoetes asiatica* | LFY homolog. |
| 397 | G2110 | BH472587 | 4.00E−87 | *Brassica oleracea* | BOGPM69TR BOGP *Brassica oleracea* genomic |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 397 | G2110 | BI422533 | 9.00E−57 | Lycopersicon esculentum | EST533199 tomato callus, TAMU Lycop |
| 397 | G2110 | AP002486 | 1.00E−52 | Oryza sativa | genomic DNA, chromosome 1, PAC clone: P0510F03. |
| 397 | G2110 | AAAA01001635 | 2.00E−52 | Oryza sativa (indica cultivar-group) | ( ) scaffold001635 |
| 397 | G2110 | BM370908 | 1.00E−47 | Hordeum vulgare | EBro04_SQ002_M09_R IGF Barley EBro04 librar |
| 397 | G2110 | AU083645 | 5.00E−44 | Cryptomeria japonica | AU083645 Cryptomeria japonica inner ba |
| 397 | G2110 | BG551253 | 2.00E−43 | Glycine max | sad35a10.y1 Gm-c1074 Glycine max cDNA clone GEN |
| 397 | G2110 | BQ625082 | 3.00E−43 | Citrus sinensis | USDA-FP_02173 Ridge pineapple sweet orange |
| 397 | G2110 | BF636342 | 5.00E−42 | Medicago truncatula | NF088G12DT1F1099 Drought Medicago trunc |
| 397 | G2110 | BG838724 | 2.00E−40 | Glycine clandestina | Gc02_02f10_R Gc02_AAFC_ECORC_cold_stres |
| 397 | G2110 | gi11320830 | 4.00E−59 | Oryza sativa | putative WRKY DNA binding protein. |
| 397 | G2110 | gi20160973 | 4.00E−35 | Oryza sativa (japonica cultivar-group) | hypothetical prote |
| 397 | G2110 | gi1159879 | 1.20E−27 | Avena fatua | DNA-binding protein. |
| 397 | G2110 | gi11493822 | 1.50E−27 | Petroselinum crispum | transcription factor WRKY4. |
| 397 | G2110 | gi6683537 | 1.10E−25 | Nicotiana tabacum | TMV response-related gene product. |
| 397 | G2110 | gi4894965 | 1.70E−20 | Avena sativa | DNA-binding protein WRKY1. |
| 397 | G2110 | gi18158619 | 7.50E−20 | Retama raetam | WRKY-like drought-induced protein. |
| 397 | G2110 | gi24745606 | 2.20E−19 | Solanum tuberosum | WRKY-type DNA binding protein. |
| 397 | G2110 | gi1076685 | 3.90E−19 | Ipomoea batatas | SPF1 protein-sweet potato. |
| 397 | G2110 | gi13620227 | 4.30E−19 | Lycopersicon esculentum | hypothetical protein. |
| 399 | G2114 | AX555218 | 2.00E−99 | Glycine max | Sequence 3 from Patent WO02059332. |
| 399 | G2114 | AX555220 | 2.00E−94 | Oryza sativa | Sequence 5 from Patent WO02059332. |
| 399 | G2114 | AF317904 | 3.00E−94 | Brassica napus | AP2/EREBP transcription factor BABY BOOM1 (B |
| 399 | G2114 | AY109146 | 3.00E−89 | Zea mays | PCO137288 mRNA sequence. |
| 399 | G2114 | BJ188928 | 9.00E−87 | Physcomitrella patens subsp. patens | BJ188928 normalized ful |
| 399 | G2114 | BQ864461 | 2.00E−78 | Lactuca sativa | QGC26M12.yg.ab1 QG_ABCDI lettuce salinas Lac |
| 399 | G2114 | BQ122372 | 2.00E−74 | Medicago truncatula | EST607948 GLSD Medicago truncatula cDNA |
| 399 | G2114 | BQ625052 | 2.00E−70 | Citrus sinensis | USDA-FP_02143 Ridge pineapple sweet orange |
| 399 | G2114 | AJ475492 | 2.00E−66 | Hordeum vulgare | AJ475492 S00008 Hordeum vulgare cDNA clone |
| 399 | G2114 | BJ312281 | 5.00E−66 | Triticum aestivum | BJ312281 Y. Ogihara unpublished cDNA libr |
| 399 | G2114 | gi21069051 | 2.10E−95 | Brassica napus | AP2/EREBP transcription factor BABY BOOM1. |
| 399 | G2114 | gi21304227 | 7.10E−90 | Oryza sativa | ovule development aintegumenta-like protein |
| 399 | G2114 | gi20161013 | 9.10E−90 | Oryza sativa (japonica cultivar-group) | putative ovule dev |
| 399 | G2114 | gi2652938 | 1.20E−83 | Zea mays | orf. |
| 399 | G2114 | gi18476518 | 2.10E−45 | Hordeum vulgare | APETALA2-like protein. |
| 399 | G2114 | gi5081557 | 2.60E−45 | Petunia x hybrida | PHAP2B protein. |
| 399 | G2114 | gi11181612 | 6.40E−44 | Picea abies | APETALA2-related transcription factor 2. |
| 399 | G2114 | gi13173164 | 9.40E−43 | Pisum sativum | APETAL2-like protein. |
| 399 | G2114 | gi21717332 | 4.10E−42 | Malus x domestica | transcription factor AHAP2. |
| 399 | G2114 | gi5360996 | 1.10E−34 | Hyacinthus orientalis | APETALA2 protein homolog HAP2. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 401 | G2117 | BH928153 | 3.00E−36 | Brassica oleracea | odi35d09.b1 B. oleracea002 Brassica olerac |
| 401 | G2117 | BU080897 | 9.00E−21 | Glycine max | saq31e07.y1 Gm-c1045 Glycine max cDNA clone SOY |
| 401 | G2117 | BI977302 | 9.00E−21 | Rosa chinensis | eG09 Old Blush petal SMART library Rosa chin |
| 401 | G2117 | BI417596 | 4.00E−19 | Lotus japonicus | LjNEST33b4r Lotus japonicus nodule library |
| 401 | G2117 | BE450859 | 6.00E−19 | Lycopersicon esculentum | EST401746 tomato root, plants pre-a |
| 401 | G2117 | BE941078 | 6.00E−19 | Medicago truncatula | EST420657 MGHG Medicago truncatula cDNA |
| 401 | G2117 | BM300051 | 8.00E−19 | Mesembryanthemum crystallinum | MCR054F01_24630 Ice plant Lam |
| 401 | G2117 | AF350505 | 2.00E−17 | Phaseolus vulgaris | bZip transcription factor mRNA, complete |
| 401 | G2117 | AY026054 | 8.00E−17 | Phaseolus acutifolius | bZip mRNA, complete cds. |
| 401 | G2117 | AAAA01000368 | 1.00E−14 | Oryza sativa (indica cultivar-group) | ( ) scaffold000368 |
| 401 | G2117 | gi13430400 | 1.50E−19 | Phaseolus vulgaris | bZip transcription factor. |
| 401 | G2117 | gi12829956 | 3.20E−19 | Phaseolus acutifolius | bZIP. |
| 401 | G2117 | gi10241920 | 8.00E−14 | Nicotiana tabacum | TBZF. |
| 401 | G2117 | gi5901747 | 5.60E−13 | Lycopersicon esculentum | bZIP DNA-binding protein. |
| 401 | G2117 | gi9650826 | 5.60E−13 | Petroselinum crispum | common plant regulatory factor 6. |
| 401 | G2117 | gi22597162 | 5.10E−12 | Glycine max | bZIP transcription factor ATB2. |
| 401 | G2117 | gi2244742 | 5.10E−12 | Antirrhinum majus | bZIP DNA-binding protein. |
| 401 | G2117 | gi13236840 | 2.00E−11 | Catharanthus roseus | G-box binding factor bZIP transcripti |
| 401 | G2117 | gi435942 | 4.40E−11 | Oryza sativa | DNA-binding factor of bZIP class. |
| 401 | G2117 | gi24460973 | 150E−10 | Capsicum chinense | bZIP transcription factor. |
| 403 | G2123 | AX281102 | 2.00E−58 | Physcomitrella patens | Sequence 8 from Patent WO0177355. |
| 403 | G2123 | BU836035 | 1.00E−56 | Populus tremula x Populus tremuloides | T081H08 Populus apica |
| 403 | G2123 | AF272573 | 2.00E−56 | Populus alba x Populus tremula | clone INRA717-1-B4 14-3-3 pr |
| 403 | G2123 | BM436731 | 2.00E−56 | Vitis vinifera | VVA008H10_53045 An expressed sequence tag da |
| 403 | G2123 | AB071968 | 4.00E−55 | Nicotiana tabacum | D75 mRNA for 14-3-3 protein, complete cds |
| 403 | G2123 | BM411329 | 4.00E−55 | Lycopersicon esculentum | EST585656 tomato breaker fruit Lyco |
| 403 | G2123 | BM408090 | 4.00E−55 | Solanum tuberosum | EST582417 potato roots Solanum tuberosum |
| 403 | G2123 | BG581482 | 5.00E−55 | Medicago truncatula | EST483216 GVN Medicago truncatula cDNA |
| 403 | G2123 | BQ994376 | 5.00E−55 | Lactuca sativa | QGF7A23.yg.ab1 QG_EFGHJ lettuce serriola Lac |
| 403 | G2123 | AF228501 | 1.00E−54 | Glycine max | 14-3-3-like protein mRNA, complete cds. |
| 403 | G2123 | gi8515890 | 1.10E−55 | Populus alba x Populus tremula | 14-3-3 protein. |
| 403 | G2123 | gi8099061 | 2.30E−55 | Populus x canescens | 14-3-3 protein. |
| 403 | G2123 | gi15637114 | 2.10E−54 | Lycopersicon esculentum | 14-3-3 family protein. |
| 403 | G2123 | gi15778154 | 2.70E−54 | Nicotiana tabacum | 14-3-3 protein. |
| 403 | G2123 | gi1575731 | 5.50E−54 | Glycine max | SGF14D. |
| 403 | G2123 | gi2822483 | 3.90E−53 | Maackia amurensis | 14-3-3 protein homolog. |
| 403 | G2123 | gi6752903 | 6.30E−53 | Euphorbia esula | 14-3-3-like protein. |
| 403 | G2123 | gi1076543 | 1.30E−52 | Vicia faba | 14-3-3 protein homolog Vfa-1433b-fava bean. |
| 403 | G2123 | gi16755676 | 1.30E−52 | Fritillaria cirrhosa | 14-3-3 protein. |
| 403 | G2123 | gi15984178 | 3.50E−52 | Nicotiana benthamiana | unnamed protein product. |
| 405 | G2130 | BH556628 | 1.00E−83 | Brassica oleracea | BOHAM82TF BOHA Brassica oleracea genomic |
| 405 | G2130 | AP004902 | 4.00E−35 | Lotus japonicus | genomic DNA, chromosome 2, clone: LjT04G24, |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 405 | G2130 | AW685524 | 5.00E−34 | *Medicago truncatula* | NF031C12NR1F1000 Nodulated root Medicag |
| 405 | G2130 | BM886518 | 2.00E−30 | *Glycine max* | sam17f08.y1 Gm-c1068 *Glycine max* cDNA clone SOY |
| 405 | G2130 | LEU89257 | 1.00E−28 | *Lycopersicon esculentum* | DNA-binding protein Pti6 mRNA, comp |
| 405 | G2130 | AAAA01000263 | 3.00E−27 | *Oryza sativa (indica cultivar-group)* | ( ) scaffold000263 |
| 405 | G2130 | AB026295 | 3.00E−27 | *Oryza sativa* | genomic DNA, chromosome 6, clone: P0681F10, com |
| 405 | G2130 | BQ873772 | 6.00E−27 | *Lactuca sativa* | QGI2I03.yg.ab1 QG_ABCDI lettuce salinas Lact |
| 405 | G2130 | AF058827 | 2.00E−25 | *Nicotiana tabacum* | TSI1 (Tsi1) mRNA, complete cds. |
| 405 | G2130 | BQ704534 | 2.00E−20 | *Brassica napus* | Bn01_03k04_A |
| 405 | G2130 | gi2213785 | 5.50E−31 | *Lycopersicon esculentum* | Pti6. |
| 405 | G2130 | gi5295944 | 1.70E−29 | *Oryza sativa* | Similar to *Nicotiana tabacum* mRNA for ERF1, TSI1. |
| 405 | G2130 | gi3065895 | 1.30E−27 | *Nicotiana tabacum* | |
| 405 | G2130 | gi8809571 | 6.00E−22 | *Nicotiana sylvestris* | ethylene-responsive element binding |
| 405 | G2130 | gi7528276 | 6.00E−22 | *Mesembryanthemum crystallinum* | AP2-related transcription f |
| 405 | G2130 | gi22415744 | 1.20E−21 | *Zea mays* | AP2 domain transcription factor. |
| 405 | G2130 | gi8571476 | 1.40E−20 | *Atriplex hortensis* | apetala2 domain-containing protein. |
| 405 | G2130 | gi24817250 | 3.50E−20 | *Cicer arietinum* | transcription factor EREBP-like protein. |
| 405 | G2130 | gi20805105 | 6.30E−20 | *Oryza sativa (japonica cultivar-group)* | contains ESTs AU06 |
| 405 | G2130 | gi4099921 | 2.50E−19 | *Stylosanthes hamata* | EREBP-3 homolog. |
| 407 | G2133 | BH420519 | 1.00E−53 | *Brassica oleracea* | BOGUH88TF BOGU *Brassica oleracea* genomic |
| 407 | G2133 | BG543936 | 6.00E−43 | *Brassica rapa* subsp. *pekinensis* | E1686 Chinese cabbage etiol |
| 407 | G2133 | AU292603 | 2.00E−28 | *Zinnia elegans* | AU292603 *zinnia* cultured mesophyll cell equa |
| 407 | G2133 | BE320193 | 6.00E−24 | *Medicago truncatula* | NF024B04RT1F1029 Developing root Medica |
| 407 | G2133 | AP003346 | 3.00E−22 | *Oryza sativa* | chromosome 1 clone P0434C04, *** SEQUENCING IN |
| 407 | G2133 | AAAA01000718 | 3.00E−22 | *Oryza sativa (indica cultivar-group)* | ( ) scaffold000718 |
| 407 | G2133 | AC124836 | 6.00E−22 | *Oryza sativa (japonica cultivar-group)* | ( ) chromosome 5 clo |
| 407 | G2133 | BZ403609 | 2.00E−20 | *Zea mays* | OGABN17TM ZM_0.7_1.5_KB *Zea mays* genomic clone ZMM |
| 407 | G2133 | BM985484 | 6.00E−19 | *Thellungiella halophila* | 10_C12_T Ath *Thellungiella* halophil |
| 407 | G2133 | BM403179 | 3.00E−17 | *Selaginella lepidophylla* | SLA012F10_35741 An expressed seque |
| 407 | G2133 | gi20161239 | 6.90E−24 | *Oryza sativa (japonica cultivar-group)* | hypothetical prote |
| 407 | G2133 | gi8571476 | 6.00E−17 | *Atriplex hortensis* | apetala2 domain-containing protein. |
| 407 | G2133 | gi14140155 | 7.80E−16 | *Oryza sativa* | putative AP2 domain transcription factor. |
| 407 | G2133 | gi5616086 | 7.00E−15 | *Brassica napus* | dehydration responsive element binding pro |
| 407 | G2133 | gi21908034 | 8.90E−15 | *Zea mays* | DRE binding factor 2. |
| 407 | G2133 | gi19071243 | 6.30E−14 | *Hordeum vulgare* | CRT/DRE binding factor 1. |
| 407 | G2133 | gi18535580 | 2.10E−13 | *Lycopersicon esculentum* | putative transcriptional activato |
| 407 | G2133 | gi1208496 | 3.30E−13 | *Nicotiana tabacum* | EREBP-3. |
| 407 | G2133 | gi8980313 | 4.40E−13 | *Catharanthus roseus* | AP2-domain DNA-binding protein. |
| 407 | G2133 | gi15488459 | 2.20E−12 | *Triticum aestivum* | AP2-containing protein. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 409 | G2138 | BH545016 | 2.00E−63 | Brassica oleracea | BOHFD22TR BOHF Brassica oleracea genomic |
| 409 | G2138 | BQ704534 | 7.00E−43 | Brassica napus | Bn01_03k04_A |
| 409 | G2138 | AP004902 | 6.00E−28 | Lotus japonicus | genomic DNA, chromosome 2, clone: LjT04G24, |
| 409 | G2138 | BM886518 | 1.00E−25 | Glycine max | sam17f08.y1 Gm-c1068 Glycine max cDNA clone SOY |
| 409 | G2138 | AW685524 | 2.00E−25 | Medicago truncatula | NF031C12NR1F1000 Nodulated root Medicag |
| 409 | G2138 | BQ873772 | 1.00E−23 | Lactuca sativa | QGI2I03.yg.ab1 QG_ABCDI lettuce salinas Lact |
| 409 | G2138 | AF058827 | 9.00E−22 | Nicotiana tabacum | TSI1 (Tsi1) mRNA, complete cds. |
| 409 | G2138 | LEU89257 | 2.00E−20 | Lycopersicon esculentum | DNA-binding protein Pti6 mRNA, comp |
| 409 | G2138 | BG350434 | 5.00E−20 | Solanum tuberosum | 091E08 Mature tuber lambda ZAP Solanum tu |
| 409 | G2138 | AP002835 | 1.00E−17 | Oryza sativa | genomic DNA, chromosome 1, PAC clone: P0417G05. |
| 409 | G2138 | gi3065895 | 9.30E−20 | Nicotiana tabacum | TSI1. |
| 409 | G2138 | gi5295944 | 1.50E−19 | Oryza sativa | Similar to Nicotiana tabacum mRNA for ERF1, Pti6. |
| 409 | G2138 | gi2213785 | 1.40E−18 | Lycopersicon esculentum | |
| 409 | G2138 | gi8809573 | 1.60E−17 | Nicotiana sylvestris | ethylene-responsive element binding |
| 409 | G2138 | gi8571476 | 1.80E−16 | Atriplex hortensis | apetala2 domain-containing protein. |
| 409 | G2138 | gi21908036 | 4.80E−16 | Zea mays | DRE binding factor 1. |
| 409 | G2138 | gi3264767 | 7.80E−16 | Prunus armeniaca | AP2 domain containing protein. |
| 409 | G2138 | gi23617235 | 1.30E−15 | Oryza sativa (japonica cultivar-group) | contains ESTs AU16 |
| 409 | G2138 | gi4099921 | 7.00E−15 | Stylosanthes hamata | ERFBP-3 homolog. |
| 409 | G2138 | gi24817250 | 1.50E−14 | Cicer arietinum | transcription factor EREBP-like protein. |
| 411 | G2140 | BH501999 | 1.00E−70 | Brassica oleracea | BOHLI02TF BOHL Brassica oleracea genomic |
| 411 | G2140 | AI488313 | 5.00E−66 | Lycopersicon esculentum | EST246635 tomato ovary, TAMU Lycope |
| 411 | G2140 | BE020519 | 2.00E−60 | Glycine max | sm44g03.y1 Gm-c1028 Glycine max cDNA clone GENO |
| 411 | G2140 | AU093196 | 1.00E−51 | Oryza sativa subsp. japonica | AU093196 Rice callus Oryza sat |
| 411 | G2140 | BF647687 | 2.00E−41 | Medicago truncatula | NF025A04EC1F1024 Elicited cell culture |
| 411 | G2140 | BH860622 | 7.00E−39 | Populus balsamifera subsp. trichocarpa | ORNL097 Poplar BAC L |
| 411 | G2140 | BU813371 | 1.00E−38 | Populus tremula x Populus tremuloides | N009F04 Populus bark |
| 411 | G2140 | AC125495 | 8.00E−38 | Oryza sativa (japonica cultivar-group) | ( ) chromosome 3 clo |
| 411 | G2140 | BU891490 | 4.00E−35 | Populus tremula | P051C02 Populus petioles cDNA library Popul |
| 411 | G2140 | AI054433 | 3.00E−34 | Mesembryanthemum crystallinum | R6-R97 Ice plant Lambda Uni-Z |
| 411 | G2140 | gi8570062 | 8.90E−31 | Oryza sativa | ESTs C26093(C11622), AU090634 (C12429) corresp |
| 411 | G2140 | gi21327944 | 1.80E−30 | Oryza sativa (japonica cultivar-group) | contains ESTs AU06 |
| 411 | G2140 | gi527655 | 3.80E−10 | Pennisetum glaucum | myc-like regulatory R gene product. |
| 411 | G2140 | gi527661 | 7.80E−09 | Phyllostachys acuta | myc-like regulatory R gene product. |
| 411 | G2140 | gi527665 | 1.70E−08 | Sorghum bicolor | myc-like regulatory R gene product. |
| 411 | G2140 | gi114217 | 2.60E−08 | Zea mays | ANTHOCYANIN REGULATORY R-S PROTEIN. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 411 | G2140 | gi527663 | 9.60E−08 | *Tripsacum australe* | myc-like regulatory R gene product. |
| 411 | G2140 | gi1086526 | 1.20E−07 | *Oryza australiensis* | transcriptional activator Ra homolog. |
| 411 | G2140 | gi1086534 | 1.60E−07 | *Oryza officinalis* | transcriptional activator Ra homolog. |
| 411 | G2140 | gi1086536 | 9.20E−07 | *Oryza rufipogon* | transcriptional activator Ra homolog. |
| 413 | G2143 | BH650724 | 5.00E−76 | *Brassica oleracea* | BOMIW43TR BO_2_3_KB *Brassica oleracea* gen |
| 413 | G2143 | CA783614 | 1.00E−43 | *Glycine max* | sat50g04.y1 Gm-c1056 *Glycine max* cDNA clone SOY |
| 413 | G2143 | BE451174 | 9.00E−43 | *Lycopersicon esculentum* | EST402062 tomato root, plants pre-a |
| 413 | G2143 | AP004693 | 6.00E−41 | *Oryza sativa* | chromosome 8 clone P0461F06, *** SEQUENCING IN |
| 413 | G2143 | AAAA01006870 | 7.00E−40 | *Oryza sativa* (*indica* cultivar-group) | ( ) scaffold006870 |
| 413 | G2143 | AP005655 | 7.00E−40 | *Oryza sativa* (*japonica* cultivar-group) | ( ) chromosome 9 clo |
| 413 | G2143 | BH775806 | 2.00E−34 | *Zea mays* | fzmb011f018c05f1 fzmb filtered library *Zea mays* ge |
| 413 | G2143 | AT002234 | 1.00E−33 | *Brassica rapa* subsp. *pekinensis* | AT002234 Flower bud cDNA Br |
| 413 | G2143 | BF263465 | 3.00E−27 | *Hordeum vulgare* | HV_CEa0006N02f *Hordeum vulgare* seedling gre |
| 413 | G2143 | CA015528 | 3.00E−25 | *Hordeum vulgare* subsp. *vulgare* | HT14J12r HT *Hordeum vulgare* |
| 413 | G2143 | gi19571105 | 9.20E−29 | *Oryza sativa* (*japonica* cultivar-group) | hypothetical prote |
| 413 | G2143 | gi15528743 | 1.10E−26 | *Oryza sativa* | contains EST C74560(E31855)~unknown protein. |
| 413 | G2143 | gi1086538 | 1.60E−09 | *Oryza rufipogon* | transcriptional activator Rb homolog. |
| 413 | G2143 | gi6166283 | 2.30E−09 | *Pinus taeda* | helix-loop-helix protein 1A. |
| 413 | G2143 | gi1142621 | 9.70E−08 | *Phaseolus vulgaris* | phaseolin G-box binding protein PG2. |
| 413 | G2143 | gi3399777 | 1.10E−07 | *Glycine max* | symbiotic ammonium transporter; nodulin. |
| 413 | G2143 | gi5923912 | 1.30E−07 | *Tulipa gesneriana* | bHLH transcription factor GBOF-1. |
| 413 | G2143 | gi10998404 | 1.90E−07 | *Petunia* x *hybrida* | anthocyanin 1. |
| 413 | G2143 | gi4321762 | 1.10E−06 | *Zea mays* | transcription factor MYC7E. |
| 413 | G2143 | gi166428 | 1.30E−06 | *Antirrhinum majus* | DEL. |
| 415 | G2144 | BQ404603 | 4.00E−59 | *Gossypium arboreum* | GA_Ed0072F04f *Gossypium arboreum* 7-10 d |
| 415 | G2144 | BQ517427 | 3.00E−53 | *Solanum tuberosum* | EST624842 Generation of a set of potato c |
| 415 | G2144 | BQ583438 | 3.00E−51 | *Beta vulgaris* | E011979-024-005-B19-SP6 MPIZ-ADIS-024-inflore |
| 415 | G2144 | BQ122428 | 6.00E−50 | *Medicago truncatula* | EST608004 GLSD *Medicago truncatula* cDNA |
| 415 | G2144 | BI427219 | 1.00E−49 | *Glycine max* | sah77g01.y1 Gm-c1049 *Glycine max* cDNA clone GEN |
| 415 | G2144 | AI725733 | 1.00E−40 | *Gossypium hirsutum* | BNLGHi12783 Six-day Cotton fiber Gossypi |
| 415 | G2144 | BH999551 | 2.00E−38 | *Brassica oleracea* | oeg96e04.b1 *B. oleracea*002 *Brassica* olerac |
| 415 | G2144 | BI926089 | 1.00E−33 | *Lycopersicon esculentum* | EST545978 tomato flower, buds 0-3 m |
| 415 | G2144 | BU791131 | 4.00E−33 | *Populus balsamifera* subsp. *trichocarpa* x *Populus deltoides* | |
| 415 | G2144 | BU015022 | 2.00E−32 | *Lactuca sativa* | QGJ9A23.yg.ab1 QG_EFGHJ lettuce serriola Lac |
| 415 | G2144 | gi20804997 | 2.70E−36 | *Oryza sativa* (*japonica* cultivar-group) | DNA-binding protei |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 415 | G2144 | gi11862964 | 2.70E−34 | Oryza sativa | hypothetical protein. |
| 415 | G2144 | gi5923912 | 8.60E−33 | Tulipa gesneriana | bHLH transcription factor GBOF-1. |
| 415 | G2144 | gi6166283 | 5.10E−09 | Pinus taeda | helix-loop-helix protein 1A. |
| 415 | G2144 | gi3399777 | 3.00E−05 | Glycine max | symbiotic ammonium transporter; nodulin. |
| 415 | G2144 | gi1086538 | 6.70E−05 | Oryza rufipogon | transcriptional activator Rb homolog. |
| 415 | G2144 | gi13346180 | 0.00013 | Gossypium hirsutum | GHDEL61. |
| 415 | G2144 | gi527655 | 0.00021 | Pennisetum glaucum | myc-like regulatory R gene product. |
| 415 | G2144 | gi527665 | 0.00029 | Sorghum bicolor | myc-like regulatory R gene product. |
| 415 | G2144 | gi527661 | 0.00033 | Phyllostachys acuta | myc-like regulatory R gene product. |
| 417 | G2153 | BH566718 | 1.00E−127 | Brassica oleracea | BOHCV23TR BOHC Brassica oleracea genomic |
| 417 | G2153 | AP004971 | 2.00E−90 | Lotus japonicus | genomic DNA, chromosome 5, clone: LjT45G21, |
| 417 | G2153 | AP004020 | 1.00E−79 | Oryza sativa | chromosome 2 clone OJ1119_A01, *** SEQUENCING |
| 417 | G2153 | AAAA01017331 | 2.00E−72 | Oryza sativa (indica cultivar-group) | ( ) scaffold017331 |
| 417 | G2153 | BQ165495 | 2.00E−67 | Medicago truncatula | EST611364 KVKC Medicago truncatula cDNA |
| 417 | G2153 | AP005653 | 1.00E−66 | Oryza sativa (japonica cultivar-group) | ( ) chromosome 2 clo |
| 417 | G2153 | BQ785950 | 8.00E−64 | Glycine max | saq61f09.y1 Gm-c1076 Glycine max cDNA clone SOY |
| 417 | G2153 | BZ412041 | 3.00E−63 | Zea mays | OGACG56TC ZM_0.7_1.5_KB Zea mays genomic clone ZMM |
| 417 | G2153 | BM110212 | 3.00E−63 | Solanum tuberosum | EST557748 potato roots Solanum tuberosum |
| 417 | G2153 | BQ865858 | 7.00E−63 | Lactuca sativa | QGC6B08.yg.ab1 QG_ABCDI lettuce salinas Lact |
| 417 | G2153 | gi24059979 | 3.80E−39 | Oryza sativa (japonica cultivar-group) | similar to DNA-bin |
| 417 | G2153 | gi15528814 | 1.70E−36 | Oryza sativa | hypothetical protein~similar to Arabidopsis |
| 417 | G2153 | gi4165183 | 5.00E−21 | Antirrhinum majus | SAP1 protein. |
| 417 | G2153 | gi2213534 | 1.30E−19 | Pisum sativum | DNA-binding PD1-dike protein. |
| 417 | G2153 | gi7439981 | 2.60E−08 | Triticum aestivum | glycine-rich RNA-binding protein GRP1- |
| 417 | G2153 | gi21623 | 1.90E−06 | Sorghum bicolor | glycine-rich RNA-binding protein. |
| 417 | G2153 | gi11545668 | 3.50E−06 | Chlamydomonas reinhardtii | CIA5. |
| 417 | G2153 | gi21068672 | 6.60E−06 | Cicer arietinum | putative glicine-rich protein. |
| 417 | G2153 | gi7489714 | 6.60E−06 | Zea mays | aluminum-induced protein al1-maize. |
| 417 | G2153 | gi395147 | 1.60E−05 | Nicotiana tabacum | glycine-rich protein. |
| 419 | G2155 | BG543096 | 2.00E−69 | Brassica rapa subsp. pekinensis | E0571 Chinese cabbage etiol |
| 419 | G2155 | BH480897 | 7.00E−66 | Brassica oleracea | BOGRA01TF BOGR Brassica oleracea genomic |
| 419 | G2155 | BG646893 | 2.00E−53 | Medicago truncatula | EST508512 HOGA Medicago truncatula cDNA |
| 419 | G2155 | BU023570 | 3.00E−44 | Helianthus annuus | QHF11M19.yg.ab1 QH_EFGHJ sunflower RHA280 |
| 419 | G2155 | AP004020 | 2.00E−41 | Oryza sativa | chromosome 2 clone OJ1119_A01, *** SEQUENCING |
| 419 | G2155 | BI426899 | 4.00E−41 | Glycine max | sag08g12.y1 Gm-c1080 Glycine max cDNA clone GEN |
| 419 | G2155 | AAAA01000383 | 2.00E−40 | Oryza sativa (indica cultivar-group) | ( ) scaffold000383 |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 419 | G2155 | AP004971 | 2.00E−40 | *Lotus japonicus* | genomic DNA, chromosome 5, clone: LjT45G21, |
| 419 | G2155 | AP005755 | 2.00E−40 | *Oryza sativa* (*japonica* cultivar-group) | ( ) chromosome 9 clo |
| 419 | G2155 | BZ412041 | 8.00E−39 | *Zea mays* | OGACG56TC ZM_0.7_1.5_KB *Zea mays* genomic clone ZMM |
| 419 | G2155 | gi15528814 | 3.70E−32 | *Oryza sativa* | hypothetical protein~similar to *Arabidopsis* |
| 419 | G2155 | gi24059979 | 1.20E−21 | *Oryza sativa* (*japonica* cultivar-group) | similar to DNA-bin |
| 419 | G2155 | gi4165183 | 3.50E−20 | *Antirrhinum majus* | SAP1 protein. |
| 419 | G2155 | gi2213534 | 1.60E−16 | *Pisum sativum* | DNA-binding PD1-like protein. |
| 419 | G2155 | gi2224911 | 0.98 | *Daucus carota* | somatic embryogenesis receptor-like kinase. |
| 419 | G2155 | gi454279 | 1 | *Avena sativa* | DNA-binding protein. |
| 421 | G2192 | AY061812 | 1.0e−999 | *Brassica nigra* | Lm1 mRNA, complete sequence. |
| 421 | G2192 | BH544406 | 1.00E−118 | *Brassica oleracea* | BOGYW04TF BOGY *Brassica oleracea* genomic |
| 421 | G2192 | AC131240 | 1.00E−98 | *Medicago truncatula* | clone mth2-33j22, WORKING DRAFT SEQUENC |
| 421 | G2192 | LJA239041 | 3.00E−92 | *Lotus japonicus* | mRNA for nodule inception protein (nin). |
| 421 | G2192 | AP001539 | 2.00E−90 | *Oryza sativa* | genomic DNA, chromosome 1, clone: P0708G02. |
| 421 | G2192 | AAAA01000250 | 2.00E−90 | *Oryza sativa* (*indica* cultivar-group) | ( ) scaffold000250 |
| 421 | G2192 | BU007504 | 2.00E−85 | *Lactuca sativa* | QGH3e07.yg.ab1 QG_EFGHJ lettuce serriola Lac |
| 421 | G2192 | BF272061 | 2.00E−71 | *Gossypium arboreum* | GA_Eb0013L09f *Gossypium arboreum* 7-10 d |
| 421 | G2192 | BE600221 | 1.00E−69 | *Sorghum bicolor* | PI1_80_G08.b1_A002 Pathogen induced 1 (PI1) |
| 421 | G2192 | BG508620 | 2.00E−66 | *Glycine max* | sac75c04.y1 Gm-c1072 *Glycine max* cDNA clone GEN |
| 421 | G2192 | gi7339715 | 2.20E−187 | *Oryza sativa* | EST AU057816(S21817) corresponds to a region |
| 421 | G2192 | gi20503001 | 2.40E−132 | *Oryza sativa* (*japonica* cultivar-group) | Putataive nodule i |
| 421 | G2192 | gi6448579 | 3.20E−95 | *Lotus japonicus* | nodule inception protein. |
| 421 | G2192 | gi23504757 | 8.10E−95 | *Pisum sativum* | nodule inception protein. |
| 421 | G2192 | gi2190980 | 0.0002 | *Chlamydomonas incerta* | minus dominance gene product. |
| 421 | G2192 | gi1928929 | 0.0021 | *Chlamydomonas reinhardtii* | minus dominance protein. |
| 421 | G2192 | gi100897 | 0.48 | *Zea mays* | Lc regulatory protein-maize. |
| 421 | G2192 | gi170732 | 0.93 | *Triticum aestivum* | gamma-gliadin. |
| 421 | G2192 | gi13346180 | 0.97 | *Gossypium hirsutum* | GHDEL61. |
| 421 | G2192 | gi100212 | 1 | *Lycopersicon esculentum* | extensin class II (clones u1/u2) |
| 423 | G2295 | BZ059285 | 1.00E−27 | *Brassica oleracea* | llf45f10.b1 *B. oleracea*002 *Brassica* olerac |
| 423 | G2295 | AAAA01000422 | 7.00E−13 | *Oryza sativa* (*indica* cultivar-group) | ( ) scaffold000422 |
| 423 | G2295 | AP002480 | 7.00E−13 | *Oryza sativa* | genomic DNA, chromosome 1, clone: P0469E05. |
| 423 | G2295 | AW508033 | 9.00E−11 | *Glycine max* | si49c04.y1 Gm-r1030 *Glycine max* cDNA clone GENO |
| 423 | G2295 | AC135316 | 3.00E−09 | *Medicago truncatula* | clone mth2-2018, WORKING DRAFT SEQUENCE |
| 423 | G2295 | BE054256 | 3.00E−07 | *Gossypium arboreum* | GA_Ea0026J19f *Gossypium arboreum* 7-10 d |
| 423 | G2295 | BH023181 | 8.00E−07 | *Gossypium hirsutum* | GH_MBb0004F02r *Gossypium hirsutum* L. Gos |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 423 | G2295 | BZ344426 | 2.00E−06 | Sorghum bicolor | hp63g11.b1 WGS-SbicolorF (JM107 adapted met |
| 423 | G2295 | AX540653 | 9.00E−06 | Zea mays | Sequence 9 from Patent WO0240688. |
| 423 | G2295 | BQ583447 | 1.00E−05 | Beta vulgaris | E011979-024-005-D15-SP6 MPIZ-ADIS-024-inflore |
| 423 | G2295 | gi8096379 | 6.20E−15 | Oryza sativa | Similar to *Arabidopsis thaliana* chromosome 5 |
| 423 | G2295 | gi15623935 | 1.40E−09 | Oryza sativa (japonica cultivar-group) | hypothetical prote |
| 423 | G2295 | gi3170502 | 9.00E−07 | Papaver nudicaule | APETALA3 homolog PnAP3-2. |
| 423 | G2295 | gi6580943 | 5.40E−06 | Picea abies | MADS-box transcription factor. |
| 423 | G2295 | gi6970411 | 8.30E−06 | Rosa rugosa | MADS-box protein. |
| 423 | G2295 | gi1049022 | 8.40E−06 | Sinapis alba | transcription factor SaMADS A. |
| 423 | G2295 | gi3170512 | 8.90E−06 | Peperomia hirta | APETALA3 homolog PhAP3. |
| 423 | G2295 | gi23304676 | 1.00E−05 | Brassica oleracea var. botrytis | MAPS-box protein FUL-c. |
| 423 | G2295 | gi4322475 | 1.30E−05 | Eucalyptus globulus subsp. globulus | putative MADS box tra |
| 423 | G2295 | gi3913005 | 1.30E−05 | Panax ginseng | AGAMOUS PROTEIN (GAG2). |
| 425 | G2340 | BU882839 | 2.00E−53 | Populus balsamifera subsp. trichocarpa | UM82TH11 Populus flo |
| 425 | G2340 | BE054276 | 3.00E−53 | Gossypium arboreum | GA_Ea0002O18f Gossypium arboreum 7-10 d |
| 425 | G2340 | PHMYBPH31 | 6.00E−53 | Petunia x hybrida | P. hybrida myb.Ph3 gene encoding protein |
| 425 | G2340 | BG269414 | 2.00E−52 | Mesembryanthemum crystallinum | L0-3478T3 Ice plant Lambda Un |
| 425 | G2340 | BU892831 | 2.00E−52 | Populus tremula | P070A09 Populus petioles cDNA library Popul |
| 425 | G2340 | CA516461 | 2.00E−52 | Capsicum annuum | KS09058G09 KS09 Capsicum annuum cDNA, mRNA |
| 425 | G2340 | OSMYB1355 | 4.00E−52 | Oryza sativa | O. sativa mRNA for myb factor, 1355 bp. |
| 425 | G2340 | BG592600 | 9.00E−52 | Solanum tuberosum | EST491278 cSTS Solanum tuberosum cDNA clo |
| 425 | G2340 | BG128147 | 1.00E−51 | Lycopersicon esculentum | EST473793 tomato shoot/meristem Lyc |
| 425 | G2340 | BI542536 | 2.00E−51 | Zea mays | 949021A03.y1 949-Juvenile leaf and shoot cDNA fr |
| 425 | G2340 | gi21739235 | 6.30E−53 | Oryza sativa | OSJNBa0072F16.14. |
| 425 | G2340 | gi20563 | 1.70E−52 | Petunia x hybrida | protein 1. |
| 425 | G2340 | gi13346188 | 5.70E−52 | Gossypium hirsutum | GHMYB25. |
| 425 | G2340 | gi485867 | 8.30E−51 | Antirrhinum majus | mixta. |
| 425 | G2340 | gi22795039 | 3.60E−50 | Populus x canescens | putative MYB transcription factor. |
| 425 | G2340 | gi19072748 | 6.70E−49 | Zea mays | typical P-type R2R3 Myb protein. |
| 425 | G2340 | gi22266675 | 4.70E−48 | Vitis labrusca x Vitis vinifera | myb-related transcription |
| 425 | G2340 | gi19386839 | 9.90E−48 | Oryza sativa (japonica cultivar-group) | putative myb-relat |
| 425 | G2340 | gi23476313 | 9.90E−48 | Gossypium raimondii | myb-like transcription factor 6. |
| 425 | G2340 | gi6552389 | 1.20E−47 | Nicotiana tabacum | myb-related transcription factor LBM4. |
| 427 | G2343 | LETHM1 | 1.00E−73 | Lycopersicon esculentum | L. esculentum mRNA for THM1 protein. |
| 427 | G2343 | BE611938 | 1.00E−67 | Glycine max | sr01h04.y1 Gm-c1049 Glycine max cDNA clone GENO |
| 427 | G2343 | BH966627 | 9.00E−64 | Brassica oleracea | odd90f02.g1 B. oleracea002 Brassica olerac |
| 427 | G2343 | AV421932 | 1.00E−61 | Lotus japonicus | AV421932 Lotus japonicus young plants (two- |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 427 | G2343 | BF484214 | 1.00E−54 | *Triticum aestivum* | WHE2309_F07_K13ZS Wheat pre-anthesis spik |
| 427 | G2343 | BU998112 | 5.00E−54 | *Hordeum vulgare* subsp. *vulgare* | HI10A14r HI *Hordeum vulgare* |
| 427 | G2343 | AW672062 | 6.00E−52 | *Sorghum bicolor* | LG1_354_G05.b1_A002 Light Grown 1 (LG1) Sor |
| 427 | G2343 | BI311137 | 6.00E−52 | *Medicago truncatula* | EST5312887 GESD *Medicago truncatula* cDN |
| 427 | G2343 | BQ634727 | 4.00E−51 | *Pinus taeda* | NXRV072_E09_F NXRV (Nsf Xylem Root wood Vertica |
| 427 | G2343 | AY108777 | 2.00E−50 | *Zea mays* | PCO139596 mRNA sequence. |
| 427 | G2343 | gi1167486 | 1.10E−66 | *Lycopersicon esculentum* | transcription factor. |
| 427 | G2343 | gi13366181 | 1.90E−53 | *Oryza sativa* | putative transcription factor. |
| 427 | G2343 | gi22093748 | 2.20E−50 | *Oryza sativa* (*japonica* cultivar-group) | putative myb-relat |
| 427 | G2343 | gi13346188 | 7.60E−46 | *Gossypium hirsutum* | GHMYB25. |
| 427 | G2343 | gi22795039 | 7.60E−46 | *Populus* x *canescens* | putative MYB transcription factor. |
| 427 | G2343 | gi20563 | 8.60E−45 | *Petunia* x *hybrida* | protein 1. |
| 427 | G2343 | gi19059 | 1.50E−44 | *Hordeum vulgare* | MybHv33. |
| 427 | G2343 | gi4886264 | 1.70E−43 | *Antirrhinum majus* | Myb-related transcription factor mixta- |
| 427 | G2343 | gi23476313 | 2.80E−43 | *Gossypium raimondii* | myb-like transcription factor 6. |
| 427 | G2343 | gi1732247 | 1.20E−42 | *Nicotiana tabacum* | transcription factor Myb1. |
| 429 | G2346 | BQ403570 | 8.00E−43 | *Gossypium arboreum* | GA_Ed0059F05f *Gossypium arboreum* 7-10 d |
| 429 | G2346 | AMA011622 | 8.00E−41 | *Antirrhinum majus* | mRNA for squamosa promoter binding |
| 429 | G2346 | BQ594361 | 1.00E−39 | *Beta vulgaris* | S015246-024-024-K10-SP6 MPIZ-ADIS-024-develop |
| 429 | G2346 | BZ040748 | 4.00E−39 | *Brassica oleracea* | lka41a03.g1 *B. oleracea*002 *Brassica* olerac |
| 429 | G2346 | AW691786 | 3.00E−35 | *Medicago truncatula* | NF044B06ST1F1000 Developing stem Medica |
| 429 | G2346 | BQ874863 | 1.00E−32 | *Lactuca sativa* | QGI6H22.yg.ab1 QG_ABCDI lettuce salinas Lact |
| 429 | G2346 | ZMA011618 | 7.00E−29 | *Zea mays* | mRNA for SBP-domain protein 5, partial. |
| 429 | G2346 | BJ245444 | 3.00E−27 | *Triticum aestivum* | BJ245444 Y. Ogihara unpublished cDNA libr |
| 429 | G2346 | BE596165 | 3.00E−27 | *Sorghum bicolor* | PI1_50_D04.b1_A002 Pathogen induced 1 (PI1) |
| 429 | G2346 | BG593787 | 4.00E−27 | *Solanum tuberosum* | EST492465 cSTS *Solanum tuberosum* cDNA clo |
| 429 | G2346 | gi5931641 | 1.40E−41 | *Antirrhinum majus* | squamosa promoter binding protein-homol |
| 429 | G2346 | gi5931786 | 1.70E−34 | *Zea mays* | SBP-domain protein 5. |
| 429 | G2346 | gi8468036 | 7.60E−23 | *Oryza sativa* | Similar to *Arabidopsis thaliana* chromosome 2 |
| 429 | G2346 | gi9087308 | 3.90E−09 | Mitochondrion *Beta vulgaris* var. *altissima* | orf102a. |
| 429 | G2346 | gi17425188 | 0.34 | *Triticum aestivum* | low-molecular-weight glutenin subunit g |
| 429 | G2346 | gi123462 | 0.96 | *Hordeum vulgare* | C-HORDEIN (CLONE PC-919). |
| 429 | G2346 | gi225589 | 0.96 | *Hordeum vulgare* var. *distichum* | hordein C. |
| 429 | G2346 | gi18844948 | 0.99 | *Oryza sativa* (*japonica* cultivar-group) | hypothetical prote |
| 431 | G2347 | BH969114 | 2.00E−53 | *Brassica oleracea* | odg08d11.b1 *B. oleracea*002 *Brassica* olerac |
| 431 | G2347 | BI931517 | 6.00E−33 | *Lycopersicon esculentum* | EST551406 tomato flower, 8 mm to pr |
| 431 | G2347 | BQ989469 | 2.00E−32 | *Lactuca sativa* | QGF17M03.yg.ab1 QG_EFGHJ lettuce serriola La |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 431 | G2347 | CA516258 | 3.00E−31 | *Capsicum annuum* | KS09055D03 KS09 *Capsicum annuum* cDNA, mRNA |
| 431 | G2347 | BE058432 | 5.00E−31 | *Glycine max* | sn16a06.y1 Gm-c1016 *Glycine max* cDNA clone GENO |
| 431 | G2347 | AMSPB1 | 7.00E−31 | *Antirrhinum majus* | *A. majus* mRNA for squamosa-promoter bindin |
| 431 | G2347 | BI071295 | 1.00E−30 | *Populus tremula* x *Populus tremuloides* | C054P79U *Populus* stra |
| 431 | G2347 | BG525285 | 8.00E−30 | *Stevia rebaudiana* | 48-3 *Stevia* field grown leaf cDNA *Stevia* |
| 431 | G2347 | BU824105 | 8.00E−30 | *Populus tremula* | UB60BPD08 *Populus tremula cambium* cDNA libr |
| 431 | G2347 | L38193 | 9.00E−30 | *Brassica rapa* | BNAF1025E Mustard flower buds *Brassica rapa* c |
| 431 | G2347 | gi1183864 | 5.40E−32 | *Antirrhinum majus* | squamosa-promoter binding protein 2. |
| 431 | G2347 | gi5931786 | 4.60E−27 | *Zea mays* | SBP-domain protein 5. |
| 431 | G2347 | gi8468036 | 6.90E−25 | *Oryza sativa* | Similar to *Arabidopsis thaliana* chromosome 2 |
| 431 | G2347 | gi9087308 | 1.40E−09 | Mitochondrion *Beta vulgaris* var. *altissima* | orf102a. |
| 431 | G2347 | gi24414128 | 0.47 | *Oryza sativa* (*japonica* cultivar-group) | hypothetical prote |
| 431 | G2347 | gi13926087 | 0.99 | *Pinus taeda* | alpha-tubulin. |
| 433 | G2379 | BH573917 | 7.00E−48 | *Brassica oleracea* | BOGNX03TF BOGN *Brassica oleracea* genomic |
| 433 | G2379 | AB072391 | 4.00E−45 | *Nicotiana tabacum* | NtSIP1 mRNA for 6b-interacting protein 1, |
| 433 | G2379 | BG544981 | 7.00E−43 | *Brassica rapa* subsp. *pekinensis* | E3094 Chinese cabbage etiol |
| 433 | G2379 | BU573650 | 1.00E−41 | *Prunus dulcis* | PA_Ea0004L16f Almond developing seed *Prunus* |
| 433 | G2379 | CA801229 | 3.00E−40 | *Glycine max* | sau02g07.y2 Gm-c1062 *Glycine max* cDNA clone SOY |
| 433 | G2379 | BI925592 | 4.00E−39 | *Lycopersicon esculentum* | EST545481 tomato flower, buds 0-3 m |
| 433 | G2379 | AC113333 | 5.00E−39 | *Oryza sativa* (*japonica* cultivar-group) | ( ) chromosome 5 clo |
| 433 | G2379 | AAAA01003484 | 8.00E−39 | *Oryza sativa* (*indica* cultivar-group) | ( ) scaffold003484 |
| 433 | G2379 | AP003264 | 5.00E−38 | *Oryza sativa* | chromosome 1 clone P0485G01, *** SEQUENCING IN |
| 433 | G2379 | BQ590717 | 3.00E−33 | *Beta vulgaris* | E012597-024-018-G24-SP6 MPIZ-ADIS-024-storage |
| 433 | G2379 | gi18149189 | 4.80E−50 | *Nicotiana tabacum* | 6b-interacting protein 1. |
| 433 | G2379 | gi21644624 | 2.50E−43 | *Oryza sativa* (*japonica* cultivar-group) | putative 6b-intera |
| 433 | G2379 | gi12597883 | 2.30E−21 | *Oryza sativa* | hypothetical protein. |
| 433 | G2379 | gi6741989 | 0.5 | *Zea mays* | unnamed protein product. |
| 433 | G2379 | gi12231300 | 0.77 | *Lycopersicon esculentum* | ripening regulated protein DDTFR1 |
| 433 | G2379 | gi2253092 | 0.79 | *Spinacia oleracea* | hypothetical protein. |
| 433 | G2379 | gi3288113 | 0.84 | *Beta vulgaris* | elongation factor 1-beta. |
| 433 | G2379 | gi18419641 | 0.94 | *Narcissus pseudonarcissus* | putative cysteine proteinase. |
| 433 | G2379 | gi1052956 | 0.99 | *Ipomoea nil* | high mobility group protein 2 HMG2. |
| 433 | G2379 | gi14579399 | 1 | *Glycine max* | unknown. |
| 435 | G2430 | BE214029 | 2.00E−23 | *Hordeum vulgare* | HV_CEb0001P06f *Hordeum vulgare* seedling gre |
| 435 | G2430 | BQ858556 | 8.00E−23 | *Lactuca sativa* | QGC10J07.yg.ab1 QG_ABCDI lettuce salinas Lac |
| 435 | G2430 | AU289837 | 1.00E−22 | *Zinnia elegans* | AU289837 zinnia cultured mesophyll cell equa |
| 435 | G2430 | BM326218 | 1.00E−22 | *Sorghum bicolor* | PIC1_72_C05.b1_A002 Pathogen-infected compa |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 435 | G2430 | AB060130 | 1.00E−22 | Zea mays | ZmRR8 mRNA for response regulator 8, complete cds. |
| 435 | G2430 | BG129795 | 3.00E−21 | Lycopersicon esculentum | EST475441 tomato shoot/meristem Lyc |
| 435 | G2430 | D41804 | 8.00E−21 | Oryza sativa | RICS4626A Rice shoot Oryza sativa cDNA, mRNAs |
| 435 | G2430 | BQ138699 | 8.00E−21 | Medicago truncatula | NF006C02PH1F1017 Phoma-infected Medicag |
| 435 | G2430 | BU760906 | 3.00E−19 | Glycine max | sas60c07.y1 Gm-c1023 Glycine max cDNA clone SOY |
| 435 | G2430 | BM407041 | 1.00E−18 | Solanum tuberosum | EST581368 potato roots Solanum tuberosum |
| 435 | G2430 | gi14189890 | 4.70E−34 | Zea mays | response regulator 9. |
| 435 | G2430 | gi24308616 | 3.00E−32 | Oryza sativa (japonica cultivar-group) | Putative response |
| 435 | G2430 | gi6942190 | 3.40E−09 | Mesembryanthemum crystallinum | CDPK substrate protein 1; C |
| 435 | G2430 | gi15289981 | 6.50E−09 | Oryza sativa | hypothetical protein. |
| 435 | G2430 | gi4519671 | 2.30E−08 | Nicotiana tabacum | transfactor. |
| 435 | G2430 | gi5916207 | 8.60E−07 | Chlamydomonas reinhardtii | regulatory protein of P-starvat |
| 435 | G2430 | gi13173408 | 2.00E−05 | Dianthus caryophyllus | response regulator protein. |
| 435 | G2430 | gi15131529 | 0.0024 | Fragaria x ananassa | ethylene receptor. |
| 435 | G2430 | gi22095684 | 0.0051 | Cucumis sativus | Ethylene receptor (CS-ETR1). |
| 435 | G2430 | gi11357140 | 0.0065 | Cucumis melo var. reticulatus | probable ethylene receptor |
| 437 | G2505 | BU879250 | 5.00E−72 | Populus balsamifera subsp. trichocarpa | V057G12 Populus flow |
| 437 | G2505 | BF645892 | 4.00E−70 | Medicago truncatula | NF042G10EC1F1083 Elicited cell culture |
| 437 | G2505 | AB028186 | 4.00E−66 | Oryza sativa | mRNA for OsNAC7 protein, complete cds. |
| 437 | G2505 | BF098091 | 4.00E−62 | Lycopersicon esculentum | EST428612 tomato nutrient deficient |
| 437 | G2505 | BQ483881 | 5.00E−62 | Triticum aestivum | WHE3513_F08_K15ZS Wheat unstressed root c |
| 437 | G2505 | BE060921 | 3.00E−61 | Hordeum vulgare | HVSMEg0013N15f Hordeum vulgare pre-anthesis |
| 437 | G2505 | AAAA01001925 | 9.00E−57 | Oryza sativa (indica cultivar-group) | ( ) scaffold001925 |
| 437 | G2505 | AI161918 | 1.00E−56 | Populus tremula x Populus tremuloides | A009P50U Hybrid aspen |
| 437 | G2505 | CA526032 | 6.00E−54 | Capsicum annuum | KS12064G06 KS12 Capsicum annuum cDNA, mRNA |
| 437 | G2505 | AP005450 | 2.00E−53 | Oryza sativa (japonica cultivar-group) | ( ) chromosome 6 clo |
| 437 | G2505 | gi11875152 | 1.40E−66 | Oryza sativa | putative NAM (no apical meristem) protein. |
| 437 | G2505 | gi20330750 | 4.30E−63 | Oryza sativa (japonica cultivar-group) | Putative NAM-like |
| 437 | G2505 | gi1279640 | 4.70E−48 | Petunia x hybrida | NAM. |
| 437 | G2505 | gi22597158 | 6.10E−48 | Glycine max | no apical meristem-like protein. |
| 437 | G2505 | gi15148914 | 4.90E−46 | Phaseolus vulgaris | NAC domain protein NAC2. |
| 437 | G2505 | gi4218537 | 4.40E−45 | Triticum sp. | GRAB2 protein. |
| 437 | G2505 | gi6732156 | 4.40E−45 | Triticum monococcum | unnamed protein product. |
| 437 | G2505 | gi6175246 | 1.00E−43 | Lycopersicon esculentum | jasmonic acid 2. |
| 437 | G2505 | gi14485513 | 1.80E−41 | Solanum tuberosum | putative NAC domain protein. |
| 437 | G2505 | gi7716952 | 6.20E−39 | Medicago truncatula | NAC1. |
| 439 | G2509 | BH989379 | 8.00E−66 | Brassica oleracea | oed22b05.b1 B. oleracea002 Brassica olerac |
| 439 | G2509 | BQ138607 | 4.00E−41 | Medicago truncatula | NF005C01PH1F1004 Phoma-infected Medicag |
| 439 | G2509 | BQ786702 | 4.00E−36 | Glycine max | saq72b07.y1 Gm-c1076 Glycine max cDNA clone SOY |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 439 | G2509 | OSJN00240 | 7.00E−31 | Oryza sativa | genomic DNA, chromosome 4, BAC clone: OSJNBa0 |
| 439 | G2509 | AAAA01000832 | 7.00E−31 | Oryza sativa (indica cultivar-group) | ( ) scaffold000832 |
| 439 | G2509 | BE419451 | 2.00E−29 | Triticum aestivum | WWS012.C2R000101 ITEC WWS Wheat Scutellum |
| 439 | G2509 | BM062508 | 5.00E−29 | Capsicum annuum | KS01043F09 KS01 Capsicum annuum cDNA, mRNA |
| 439 | G2509 | AI771755 | 2.00E−28 | Lycopersicon esculentum | EST252855 tomato ovary, TAMU Lycope |
| 439 | G2509 | CA015575 | 7.00E−28 | Hordeum vulgare subsp. vulgare | HT14L19r HT Hordeum vulgare |
| 439 | G2509 | BE642320 | 2.00E−27 | Ceratopteris richardii | Cri2_5_L17_SP6 Ceratopteris Spore Li |
| 439 | G2509 | gi20160854 | 2.10E−29 | Oryza sativa (japonica cultivar-group) | hypothetical prote |
| 439 | G2509 | gi3264767 | 8.40E−28 | Prunus armeniaca | AP2 domain containing protein. |
| 439 | G2509 | gi24817250 | 1.10E−25 | Cicer arietinum | transcription factor EREBP-like protein. |
| 439 | G2509 | gi15217291 | 7.10E−25 | Oryza sativa | Putative AP2 domain containing protein. |
| 439 | G2509 | gi1208498 | 1.60E−24 | Nicotiana tabacum | EREBP-2. |
| 439 | G2509 | gi8809571 | 1.60E−24 | Nicotiana sylvestris | ethylene-responsive element binding |
| 439 | G2509 | gi7528276 | 3.00E−24 | Mesembryanthemum crystallinum | AP2-related transcription f |
| 439 | G2509 | gi1688233 | 1.10E−23 | Solanum tuberosum | DNA binding protein homolog. |
| 439 | G2509 | gi4099921 | 1.60E−23 | Stylosanthes hamata | EREBP-3 homolog. |
| 439 | G2509 | gi18496063 | 2.40E−23 | Fagus sylvatica | ethylene responsive element binding prote |
| 441 | G2517 | CA784851 | 2.00E−41 | Glycine max | sat90g04.y1 Gm-c1062 Glycine max cDNA clone SOY |
| 441 | G2517 | BQ799236 | 3.00E−39 | Vitis vinifera | EST 1405 Green Grape berries Lambda Zap II L |
| 441 | G2517 | BU884581 | 2.00E−36 | Populus tremula x Populus tremuloides | R012F08 Populus root |
| 441 | G2517 | BH479877 | 5.00E−33 | Brassica oleracea | BOHNX73TR BOHN Brassica oleracea genomic |
| 441 | G2517 | AW034229 | 2.00E−32 | Lycopersicon esculentum | EST277800 tomato callus, TAMU Lycop |
| 441 | G2517 | AV408330 | 1.00E−31 | Lotus japonicus | AV408330 Lotus japonicus young plants (two- |
| 441 | G2517 | BG889690 | 2.00E−31 | Solanum tuberosum | EST515541 cSTD Solanum tuberosum cDNA clo |
| 441 | G2517 | BF645445 | 6.00E−30 | Medicago truncatula | NF040F10EC1F1090 Elicited cell culture |
| 441 | G2517 | BE445081 | 6.00E−30 | Triticum aestivum | WHE1131_B06_D11ZS Wheat etiolated seedlin |
| 441 | G2517 | BE362650 | 5.00E−28 | Sorghum bicolor | DG1_88_H02.b1_A002 Dark Grown 1 (DG1) Sorgh |
| 441 | G2517 | gi11761085 | 1.00E−36 | Oryza sativa | putative DNA-binding protein homolog. |
| 441 | G2517 | gi22830985 | 7.00E−31 | Oryza sativa (japonica cultivar-group) | WRKY transcription |
| 441 | G2517 | gi4760692 | 9.80E−25 | Nicotiana tabacum | transcription factor NtWRKY2. |
| 441 | G2517 | gi18158619 | 1.50E−23 | Retama raetam | WRKY-like drought-induced protein. |
| 441 | G2517 | gi13620227 | 2.20E−23 | Lycopersicon esculentum | hypothetical protein. |
| 441 | G2517 | gi24745606 | 3.80E−23 | Solanum tuberosum | WRKY-type DNA binding protein. |
| 441 | G2517 | gi7484759 | 1.40E−22 | Cucumis sativus | SP8 binding protein homolog-cucumber. |
| 441 | G2517 | gi1159877 | 1.60E−22 | Avena fatua | DNA-binding protein. |
| 441 | G2517 | gi1076685 | 6.00E−22 | Ipomoea batatas | SPF1 protein-sweet potato. |
| 441 | G2517 | gi11493822 | 1.50E−21 | Petroselinum crispum | transcription factor WRKY4. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 443 | G2520 | AW928317 | 2.00E−48 | *Lycopersicon esculentum* | EST307050 tomato flower buds 8 mm t |
| 443 | G2520 | BI270049 | 3.00E−47 | *Medicago truncatula* | NF004D04FL1F1042 Developing flower Medi |
| 443 | G2520 | BU832739 | 8.00E−46 | *Populus tremula* x *Populus tremuloides* | T037F09 *Populus* apica |
| 443 | G2520 | BU009829 | 2.00E−45 | *Lactuca sativa* | QGJ11L06.yg.ab1 QG_EFGHJ lettuce serriola La |
| 443 | G2520 | BF271147 | 6.00E−43 | *Gossypium arboreum* | GA_Eb0010K15f *Gossypium arboreum* 7-10 d |
| 443 | G2520 | BG725974 | 4.00E−42 | *Glycine max* | sae11d10.y1 Gm-c1067 *Glycine max* cDNA clone GEN |
| 443 | G2520 | BQ509930 | 2.00E−41 | *Solanum tuberosum* | EST617345 Generation of a set of potato c |
| 443 | G2520 | CA522636 | 6.00E−41 | *Capsicum annuum* | KS12008F12 KS12 *Capsicum annuum* cDNA, mRNA |
| 443 | G2520 | BH248832 | 5.00E−40 | *Brassica oleracea* | BOGAN13TR BOGA *Brassica oleracea* genomic |
| 443 | G2520 | BQ105890 | 1.00E−39 | *Rosa* hybrid cultivar | fc1141.e Rose Petals (Fragrant Cloud) |
| 443 | G2520 | gi20804997 | 5.10E−35 | *Oryza sativa* (*japonica* cultivar-group) | DNA-binding protei |
| 443 | G2520 | gi11862964 | 2.10E−34 | *Oryza sativa* | hypothetical protein. |
| 443 | G2520 | gi5923912 | 6.10E−32 | *Tulipa gesneriana* | bHLH transcription factor GBOF-1. |
| 443 | G2520 | gi6166283 | 3.30E−10 | *Pinus taeda* | helix-loop-helix protein 1A. |
| 443 | G2520 | gi527655 | 1.10E−07 | *Pennisetum glaucum* | myc-like regulatory R gene product. |
| 443 | G2520 | gi527665 | 4.00E−07 | *Sorghum bicolor* | myc-like regulatory R gene product. |
| 443 | G2520 | gi527661 | 1.10E−06 | *Phyllostachys acuta* | myc-like regulatory R gene product. |
| 443 | G2520 | gi13346180 | 1.90E−06 | *Gossypium hirsutum* | GHDEL61. |
| 443 | G2520 | gi3399777 | 2.60E−06 | *Glycine max* | symbiotic ammonium transporter; nodulin. |
| 443 | G2520 | gi1086534 | 4.90E−06 | *Oryza officinalis* | transcriptional activator Ra homolog. |
| 445 | G2555 | BF096555 | 4.00E−42 | *Lycopersicon esculentum* | EST360582 tomato nutrient deficient |
| 445 | G2555 | BH509718 | 2.00E−40 | *Brassica oleracea* | BOHGV18TF BOHG *Brassica oleracea* genomic |
| 445 | G2555 | BF005956 | 3.00E−40 | *Medicago truncatula* | EST434454 DSLC *Medicago truncatula* cDNA |
| 445 | G2555 | BU091550 | 3.00E−35 | *Glycine max* | st74e07.y1 Gm-c1054 *Glycine max* cDNA clone GENO |
| 445 | G2555 | AF465824 | 1.00E−30 | *Oryza sativa* | transcription factor RAU1 (rau1) mRNA, partial |
| 445 | G2555 | BU499331 | 2.00E−30 | *Zea mays* | 946174A05.y1 946-tassel primordium prepared by S |
| 445 | G2555 | BU866761 | 6.00E−30 | *Populus tremula* x *Populus tremuloides* | S070E02 *Populus* imbib |
| 445 | G2555 | CA014136 | 2.00E−29 | *Hordeum vulgare* subsp. *vulgare* | HT10H19r HT *Hordeum vulgare* |
| 445 | G2555 | BM063750 | 5.00E−29 | *Capsicum annuum* | KS01059B06 KS01 *Capsicum annuum* cDNA, mRNA |
| 445 | G2555 | AW160239 | 6.00E−29 | *Lycopersicon pennellii* | EST290097 *L. pennellii* trichome, Cor |
| 445 | G2555 | gi6166283 | 1.70E−40 | *Pinus taeda* | helix-loop-helix protein 1A. |
| 445 | G2555 | gi19401700 | 1.70E−34 | *Oryza sativa* | transcription factor RAU1. |
| 445 | G2555 | gi20161021 | 2.40E−33 | *Oryza sativa* (*japonica* cultivar-group) | contains ESTs AU05 |
| 445 | G2555 | gi5923912 | 1.70E−11 | *Tulipa gesneriana* | bHLH transcription factor GBOF-1. |
| 445 | G2555 | gi1086538 | 4.50E−06 | *Oryza rufipogon* | transcriptional activator Rb homolog. |
| 445 | G2555 | gi3399777 | 3.90E−05 | *Glycine max* | symbiotic ammonium transporter; nodulin. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 445 | G2555 | gi527657 | 6.20E−05 | Pennisetum glaucum | myc-like regulatory R gene product. |
| 445 | G2555 | gi1142619 | 0.00059 | Phaseolus vulgaris | phaseolin G-box binding protein PG1. |
| 445 | G2555 | gi4206118 | 0.00091 | Mesembryanthemum crystallinum | transporter homolog. |
| 445 | G2555 | gi13346182 | 0.0027 | Gossypium hirsutum | GHDEL65. |
| 447 | G2557 | BH511840 | 1.00E−66 | Brassica oleracea | BOGRJ19TR BOGR Brassica oleracea genomic |
| 447 | G2557 | CA799720 | 5.00E−49 | Glycine max | sat61g07.y1 Gm-c1056 Glycine max cDNA clone SOY |
| 447 | G2557 | AP003296 | 1.00E−35 | Oryza sativa | chromosome 1 clone P0697C12, *** SEQUENCING IN |
| 447 | G2557 | AAAA01007476 | 1.00E−33 | Oryza sativa (indica cultivar-group) | ( ) scaffold007476 |
| 447 | G2557 | BF263465 | 1.00E−32 | Hordeum vulgare | HV_CEa0006N02f Hordeum vulgare seedling gre |
| 447 | G2557 | AT002234 | 3.00E−28 | Brassica rapa subsp. pekinensis | AT002234 Flower bud cDNA Br |
| 447 | G2557 | AP006057 | 1.00E−27 | Oryza sativa (japonica cultivar-group) | ( ) chromosome 9 clo |
| 447 | G2557 | CA015528 | 1.00E−27 | Hordeum vulgare subsp. vulgare | HT14J12r HT Hordeum vulgare |
| 447 | G2557 | BG557011 | 2.00E−27 | Sorghum bicolor | EM1_41_E02.g1_A002 Embryo 1 (EM1) Sorghum b |
| 447 | G2557 | BH775806 | 7.00E−27 | Zea mays | fzmb011f018c05f1 fzmb filtered library Zea mays ge |
| 447 | G2557 | gi15289790 | 5.00E−37 | Oryza sativa | contains EST C74560(E31855)~unknown protein. |
| 447 | G2557 | gi19571105 | 8.40E−35 | Oryza sativa (japonica cultivar-group) | hypothetical prote |
| 447 | G2557 | gi3399777 | 4.60E−07 | Glycine max | symbiotic ammonium transporter; nodulin. |
| 447 | G2557 | gi4206118 | 2.10E−06 | Mesembryanthemum crystallinum | transporter homolog. |
| 447 | G2557 | gi6166283 | 3.10E−06 | Pinus taeda | helix-loop-helix protein 1A. |
| 447 | G2557 | gi5923912 | 6.80E−06 | Tulipa gesneriana | bHLH transcription factor GBOF-1. |
| 447 | G2557 | gi527655 | 6.90E−06 | Pennisetum glaucum | myc-like regulatory R gene product. |
| 447 | G2557 | gi527661 | 1.50E−05 | Phyllostachys acuta | myc-like regulatory R gene product. |
| 447 | G2557 | gi527665 | 1.80E−05 | Sorghum bicolor | myc-like regulatory R gene product. |
| 447 | G2557 | gi1086538 | 1.90E−05 | Oryza rufipogon | transcriptional activator Rb homolog. |
| 449 | G2583 | BH658452 | 1.00E−59 | Brassica oleracea | BOMCP74TF BO_2_3_KB Brassica oleracea gen |
| 449 | G2583 | BE023297 | 5.00E−54 | Glycine max | sm80e10.y1 Gm-c1015 Glycine max cDNA clone GENO |
| 449 | G2583 | CA486875 | 1.00E−50 | Triticum aestivum | WHE4337_A02_A03ZS Wheat meiotic anther cD |
| 449 | G2583 | BG642554 | 8.00E−48 | Lycopersicon esculentum | EST356031 tomato flower buds, anthe |
| 449 | G2583 | BI978981 | 2.00E−47 | Rosa chinensis | zD09 Old Blush petal SMART library Rosa chin |
| 449 | G2583 | BU978490 | 4.00E−47 | Hordeum vulgare subsp. vulgare | HA13G05r HA Hordeum vulgare |
| 449 | G2583 | BQ106328 | 4.00E−46 | Rosa hybrid cultivar | gg1388.e Rose Petals (Golden Gate) Lam |
| 449 | G2583 | BI958226 | 1.00E−44 | Hordeum vulgare | HVSMEn0013P17f Hordeum vulgare rachis EST 1 |
| 449 | G2583 | AP004869 | 1.00E−43 | Oryza sativa (japonica cultivar-group) | ( ) chromosome 2 clo |
| 449 | G2583 | BU832200 | 6.00E−43 | Populus tremula x Populus tremuloides | T030G01 Populus apica |
| 449 | G2583 | gi18650662 | 2.30E−23 | Lycopersicon esculentum | ethylene response factor 1. |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 449 | G2583 | gi131754 | 7.30E−20 | *Lupinus polyphyllus* | PPLZ02 PROTEIN. |
| 449 | G2583 | gi20160854 | 2.80E−18 | *Oryza sativa* (*japonica* cultivar-group) | hypothetical prote |
| 449 | G2583 | gi10798644 | 2.80E−18 | *Nicotiana tabacum* | AP2 domain-containing transcription fac |
| 449 | G2583 | gi8571476 | 2.80E−18 | *Atriplex hortensis* | apetala2 domain-containing protein. |
| 449 | G2583 | gi14018047 | 3.30E−17 | *Oryza sativa* | Putative protein containing AP2 DNA binding |
| 449 | G2583 | gi12225884 | 1.10E−16 | *Zea mays* | unnamed protein product. |
| 449 | G2583 | gi3264767 | 1.10E−16 | *Prunus armeniaca* | AP2 domain containing protein. |
| 449 | G2583 | gi4099914 | 1.10E−16 | *Stylosanthes hamata* | ethylene-responsive element binding p |
| 449 | G2583 | gi8809573 | 1.40E−16 | *Nicotiana sylvestris* | ethylene-responsive element binding |
| 451 | G2701 | AW164275 | 3.00E−68 | *Glycine max* | se70d01.y1 Gm-c1023 *Glycine max* cDNA clone GENO |
| 451 | G2701 | AF239956 | 2.00E−58 | *Hevea brasiliensis* | unknown mRNA. |
| 451 | G2701 | BQ115848 | 3.00E−57 | *Solanum tuberosum* | EST601424 mixed potato tissues *Solanum* tu |
| 451 | G2701 | AW220831 | 8.00E−53 | *Lycopersicon esculentum* | EST297300 tomato fruit mature green |
| 451 | G2701 | BQ992139 | 4.00E−52 | *Lactuca sativa* | QGF24M24.yg.ab1 QG_EFGHJ lettuce serriola La |
| 451 | G2701 | BE319813 | 4.00E−48 | *Medicago truncatula* | NF022C09RT1F1066 Developing root Medica |
| 451 | G2701 | AAAA01017329 | 2.00E−46 | *Oryza sativa* (*indica* cultivar-group) | ( ) scaffold017329 |
| 451 | G2701 | AC130612 | 2.00E−46 | *Oryza sativa* (*japonica* cultivar-group) | ( ) chromosome 5 clo |
| 451 | G2701 | AP003279 | 3.00E−45 | *Oryza sativa* | chromosome 1 clone P0529E05, *** SEQUENCING IN |
| 451 | G2701 | BG525326 | 1.00E−42 | *Stevia rebaudiana* | 48-70 *Stevia* field grown leaf cDNA *Stevia* |
| 451 | G2701 | gi12005328 | 4.20E−56 | *Hevea brasiliensis* | unknown. |
| 451 | G2701 | gi18874263 | 3.00E−55 | *Antirrhinum majus* | MYB-like transcription factor DIVARICAT |
| 451 | G2701 | gi18461206 | 1.10E−48 | *Oryza sativa* (*japonica* cultivar-group) | contains ESTs AU10 |
| 451 | G2701 | gi10798825 | 2.00E−45 | *Oryza sativa* | putative myb-related transcription activator |
| 451 | G2701 | gi6688529 | 5.60E−45 | *Lycopersicon esculentum* | I-box binding factor. |
| 451 | G2701 | gi19911579 | 4.00E−44 | *Glycine max* | syringolide-induced protein 1-3-1B. |
| 451 | G2701 | gi15209176 | 9.20E−43 | *Solanum demissum* | putative I-box binding factor. |
| 451 | G2701 | gi12406995 | 1.20E−26 | *Hordeum vulgare* | MCB2 protein. |
| 451 | G2701 | gi7705206 | 7.60E−25 | *Solanum tuberosum* | MybSt1. |
| 451 | G2701 | gi20067661 | 7.00E−15 | *Zea mays* | one repeat myb transcriptional factor. |
| 453 | G2719 | BF097761 | 8.00E−50 | *Lycopersicon esculentum* | EST415834 tomato nutrient deficient |
| 453 | G2719 | BQ995199 | 1.00E−49 | *Lactuca sativa* | QGF9F12.yg.ab1 QG_EFGHJ lettuce serriola Lac |
| 453 | G2719 | CA785073 | 6.00E−48 | *Glycine max* | sat27b04.y1 Gm-c1056 *Glycine max* cDNA clone SOY |
| 453 | G2719 | AW689391 | 1.00E−47 | *Medicago truncatula* | NF018F11ST1F1000 Developing stem Medica |
| 453 | G2719 | BU025163 | 1.00E−45 | *Helianthus annuus* | QHF7P05.yg.ab1 QH_EFGHJ sunflower RHA280 |
| 453 | G2719 | AP004467 | 2.00E−43 | *Lotus japonicus* | genomic DNA, chromosome 1, clone: LjT06K11, |
| 453 | G2719 | BH444284 | 6.00E−43 | *Brassica oleracea* | BOGON79TF BOGO *Brassica oleracea* genomic |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 453 | G2719 | AAAA01031778 | 2.00E−41 | Oryza sativa (indica cultivar-group) | ( ) scaffold031778 |
| 453 | G2719 | BU875887 | 4.00E−41 | Populus balsamifera subsp. trichocarpa | V012F11 Populus flow |
| 453 | G2719 | AP005821 | 9.00E−41 | Oryza sativa (japonica cultivar-group) | ( ) chromosome 9 clo |
| 453 | G2719 | gi20160571 | 2.90E−64 | Oryza sativa (japonica cultivar-group) | putative MYB trans |
| 453 | G2719 | gi9954112 | 6.70E−43 | Solanum tuberosum | tuber-specific and sucrose-responsive e |
| 453 | G2719 | gi6539552 | 1.60E−33 | Oryza sativa | Similar to putative transcription factor (AF |
| 453 | G2719 | gi7677136 | 7.80E−32 | Adiantum raddianum | c-myb-like transcription factor. |
| 453 | G2719 | gi16326135 | 1.20E−31 | Nicotiana tabacum | Myb. |
| 453 | G2719 | gi7230673 | 1.60E−31 | Papaver rhoeas | putative Myb-related domain. |
| 453 | G2719 | gi1200239 | 8.50E−31 | Hordeum vulgare | GAMyb protein. |
| 453 | G2719 | gi8745321 | 8.50E−31 | Physcomitrella patens | putative c-myb-like transcription f |
| 453 | G2719 | gi20565 | 3.80E−30 | Petunia x hybrida | protein 3. |
| 453 | G2719 | gi4581969 | 2.00E−29 | Avena sativa | myb protein. |
| 455 | G2789 | BH975957 | 1.00E−77 | Brassica oleracea | odh67e11.g1 B. oleracea002 Brassica olerac |
| 455 | G2789 | AJ502190 | 4.00E−76 | Medicago truncatula | AJ502190 MTAMP Medicago truncatula cDNA |
| 455 | G2789 | AP005653 | 7.00E−68 | Oryza sativa (japonica cultivar-group) | ( ) chromosome 2 clo |
| 455 | G2789 | AAAA01009427 | 7.00E−68 | Oryza sativa (indica cultivar-group) | ( ) scaffold009427 |
| 455 | G2789 | BQ863249 | 1.00E−65 | Lactuca sativa | QGC23G02.yg.ab1 QG_ABCDI lettuce salinas Lac |
| 455 | G2789 | AP003526 | 6.00E−64 | Oryza sativa | chromosome 6 clone P0548D03, *** SEQUENCING IN |
| 455 | G2789 | BM110212 | 4.00E−62 | Solanum tuberosum | EST557748 potato roots Solanum tuberosum |
| 455 | G2789 | BZ412041 | 2.00E−59 | Zea mays | OGACG56TC ZM_0.7_1.5_KB Zea mays genomic clone ZMM |
| 455 | G2789 | BG134451 | 5.00E−59 | Lycopersicon esculentum | EST467343 tomato crown gall Lycoper |
| 455 | G2789 | AP004971 | 4.00E−57 | Lotus japonicus | genomic DNA, chromosome 5, clone: LjT45G21, |
| 455 | G2789 | gi15528814 | 5.70E−36 | Oryza sativa | hypothetical protein~similar to Arabidopsis |
| 455 | G2789 | gi24059979 | 5.50E−31 | Oryza sativa (japonica cultivar-group) | similar to DNA-bin |
| 455 | G2789 | gi4165183 | 4.50E−20 | Antirrhinum majus | SAP1 protein. |
| 455 | G2789 | gi2213534 | 8.60E−19 | Pisum sativum | DNA-binding PD1-like protein. |
| 455 | G2789 | gi14916565 | 0.98 | Malus x domestica | Flavonol synthase (FLS). |
| 455 | G2789 | gi1313924 | 0.98 | Brassica oleracea | non intermediate filament IFA binding p |
| 455 | G2789 | gi7671199 | 1 | Chlamydomonas reinhardtii | flagellar autotomy protein Fa1p |
| 455 | G2789 | gi11466352 | 1 | Mesostigma viride | photosystem II protein N. |
| 457 | G2830 | BH993354 | 7.00E−65 | Brassica oleracea | oeg99c11.g1 B. oleracea002 Brassica olerac |
| 457 | G2830 | BM177052 | 3.00E−13 | Glycine max | saj76c01.y1 Gm-c1074 Glycine max cDNA clone SOY |
| 457 | G2830 | BI137362 | 5.7 | Populus balsamifera subsp. trichocarpa | F084P95Y Populus flo |
| 457 | G2830 | AC125368 | 5.7 | Medicago truncatula | clone mth2-13h15, WORKING DRAFT SEQUENC |
| 457 | G2830 | BG269090 | 5.7 | Mesembryanthemum crystallinum | L0-3090T3 Ice plant Lambda Un |
| 457 | G2830 | BE345092 | 7.5 | Zea mays | 946031F09.y1 946-tassel primordium prepared by S |

TABLE 8-continued

Summary of representative sequences that are homologous to presently-disclosed transcription factors

| Polynucleotide SEQ ID NO: | GID | Test Sequence ID | Smallest Sum Probability | Test Sequence Species | Test Sequence GenBank Annotation |
|---|---|---|---|---|---|
| 457 | G2830 | gi8099397 | 0.97 | Nicotiana tabacum | protoporphyrinogen oxidase precursor; p |

Table 9 lists sequences discovered to be paralogous to a number of transcription factors of the present invention. The columns headings include, from left to right, the *Arabidopsis* SEQ ID NO; corresponding *Arabidopsis* Gene ID (GID) numbers; the GID numbers of the paralogs discovered in a database search; and the SEQ ID NOs of the paralogs.

TABLE 9

*Arabidopsis* Transcription Factors and Paralogs

| SEQ ID NO: | GID NO. | Paralog SEQ ID NO: | Paralog GID No. |
|---|---|---|---|
| 8 | G24 | 1952, 2090, 2104 | G12, G1277, G1379 |
| 10 | G28 | 2074 | G1006 |
| 12 | G47 | 408 | G2133 |
| 16 | G157 | 166, 350, 352 | G859, G1842, G1843 |
| 20 | G175 | 174 | G877 |
| 32 | G196 | 1962 | G182 |
| 36 | G214 | 146 | G680 |
| 38 | G226 | 148 | G682 |
| 40 | G241 | 1978 | G233 |
| 44 | G254 | 1974 | G228 |
| 46 | G256 | 2048, 2050, 2066 | G666, G668, G932 |
| 48 | G278 | 2092 | G1290 |
| 50 | G291 | 2088 | G1211 |
| 56 | G325 | 2160 | G1998 |
| 58 | G343 | 1986 | G342 |
| 60 | G353 | 62 | G354 |
| 62 | G354 | 60 | G353 |
| 64 | G361 | 66 | G362 |
| 66 | G362 | 64 | G361 |
| 70 | G390 | 72, 78 | G391, G438 |
| 72 | G391 | 70, 78 | G390, G438 |
| 76 | G427 | 1996, 1998, 2188 | G425, G426, G2545 |
| 78 | G438 | 70, 72 | G390, G391 |
| 80 | G450 | 2002, 2004, 2006 | G448, G455, G456 |
| 82 | G464 | 2008 | G463 |
| 88 | G481 | 90, 2010 | G482, G485, G2345 |
| 90 | G482 | 88, 2010 | G481, G485 |
| 92 | G484 | 2190 | G2631 |
| 94 | G489 | 2054 | G714 |
| 98 | G504 | 2108, 2110 | G1425, G1454 |
| 102 | G519 | 2012, 2014, 2060 | G501, G502, G767 |
| 104 | G545 | 1988, 1990 | G350, G351 |
| 114 | G568 | 2034 | G580 |
| 116 | G584 | 2082 | G1136 |
| 118 | G585 | 2036 | G586 |
| 122 | G594 | 294 | G1496 |
| 136 | G652 | 2096 | G1335 |
| 138 | G663 | 2094, 2174, 2176 | G1329, G2421, G2422 |
| 140 | G664 | 1964, 1984 | G197, G255 |
| 144 | G676 | 1966, 1980 | G212, G247 |
| 146 | G680 | 36 | G214 |
| 148 | G682 | 38, 1972, 2142, 2192 | G225, G226, G1816, G2718 |
| 150 | G715 | 314 | G1646 |
| 154 | G736 | 2182 | G2432 |
| 160 | G789 | 292 | G1494 |
| 164 | G849 | 2042 | G610 |
| 166 | G859 | 16, 350, 352, 2130, 2146 | G157, G1842, G1843, G1759, G1844 |
| 170 | G867 | 1950, 370 | G9, G1930 |
| 174 | G877 | 20 | G175 |
| 176 | G881 | 2068 | G986 |

TABLE 9-continued

*Arabidopsis* Transcription Factors and Paralogs

| SEQ ID NO: | GID NO. | Paralog SEQ ID NO: | Paralog GID No. |
|---|---|---|---|
| 180 | G896 | 2098 | G1349 |
| 186 | G912 | 1958, 1960, 1962 | G40, G41, G42 |
| 188 | G913 | 2162 | G2107 |
| 194 | G961 | 2186 | G2535 |
| 198 | G974 | 1948 | G5 |
| 200 | G975 | 450 | G2583 |
| 202 | G979 | 2164 | G2131 |
| 204 | G987 | 2202 | G3010 |
| 208 | G1040 | 2056, 2058 | G729, G730 |
| 210 | G1047 | 2140 | G1808 |
| 212 | G1501 | 214 | G1052 |
| 214 | G1052 | 212 | G1051 |
| 216 | G1062 | 2128 | G1664 |
| 218 | G1063 | 414 | G2143 |
| 224 | G1073 | 2078, 2166 | G1067, G2156 |
| 226 | G1075 | 2080 | G1076 |
| 232 | G1134 | 446 | G2555 |
| 234 | G1140 | 2064 | G861 |
| 238 | G1146 | 2084, 2086 | G1149, G1152 |
| 240 | G1196 | 2062 | G839 |
| 242 | G1198 | 2024, 2026, 2028, 2030, 2032, 2044, 2138 | G554, G555, G556, G558, G578, G629, G1806 |
| 250 | G1255 | 2122 | G1484 |
| 258 | G1322 | 1970, 1982 | G221, G249 |
| 260 | G1323 | 2046 | G659 |
| 262 | G1330 | 2178 | G2423 |
| 268 | G1363 | 2132 | G1782 |
| 270 | G1411 | 440 | G2509 |
| 278 | G1451 | 2070 | G990 |
| 280 | G1452 | 2016, 2100 | G512, G1357 |
| 282 | G1463 | 2114, 2116, 2118, 2120 | G1461, G1462, G1464, G1465 |
| 286 | G1478 | 2152 | G1929 |
| 288 | G1482 | 2148 | G1888 |
| 292 | G1494 | 160 | G789 |
| 294 | G1496 | 122 | G594 |
| 306 | G1634 | 452 | G2701 |
| 312 | G1645 | 2180 | G2424 |
| 316 | G1652 | 2194 | G2776 |
| 322 | G1749 | 2144 | G1839 |
| 324 | G1750 | 2000 | G440 |
| 332 | G1792 | 1954, 2134, 2136 | G30, G1791, G1795 |
| 340 | G1818 | 344 | G1836 |
| 344 | G1836 | 340 | G1818 |
| 350 | G1842 | 16, 166, 352 | G157, G859, G1843 |
| 352 | G1843 | 16, 166, 350 | G157, G859, G1842 |
| 356 | G1863 | 2170 | G2334 |
| 360 | G1895 | 364 | G1903 |
| 364 | G1903 | 360 | G1895 |
| 368 | G1927 | 2168 | G2184 |
| 370 | G1930 | 170 | G867 |
| 374 | G1944 | 2040 | G605 |
| 386 | G2007 | 1976 | G231 |
| 388 | G2010 | 432 | G2347 |
| 390 | G2053 | 2018, 2020, 2022 | G515, G516, G517 |
| 406 | G2130 | 2076 | G1008 |
| 408 | G2133 | 12 | G47 |
| 414 | G2143 | 218 | G1063 |
| 420 | G2155 | 2154 | G1945 |

TABLE 9-continued

Arabidopsis Transcription Factors and Paralogs

| SEQ ID NO: | GID NO. | Paralog SEQ ID NO: | Paralog GID No. |
|---|---|---|---|
| 426 | G2340 | 2052 | G671 |
| 432 | G2347 | 388 | G2010 |
| 440 | G2509 | 270 | G1411 |
| 446 | G2555 | 232 | G1134 |
| 450 | G2583 | 200 | G975 |
| 452 | G2701 | 306 | G1634 |
| 454 | G2719 | 1968 | G216 |
| 456 | G2789 | 2038 | G596 |
| 1948 | G5 | 198 | G974 |
| 1950 | G9 | 170, 370 | G867, G1930 |
| 1952 | G12 | 8 | G24 |
| 1954 | G30 | 332 | G1792 |
| 1956 | G40 | 1958, 1960, 186 | G41, G42, G912 |
| 1958 | G41 | 1956, 1960, 186 | G40, G42, G912 |
| 1960 | G42 | 1956, 1958, 186 | G40, G41, G912 |
| 1962 | G182 | 32 | G196 |
| 1964 | G197 | 140 | G664 |
| 1966 | G212 | 144 | G676 |
| 1968 | G216 | 454 | G2719 |
| 1970 | G221 | 258 | G1322 |
| 1972 | G225 | 38, 148 | G226, G682 |
| 1974 | G228 | 44 | G254 |
| 1976 | G231 | 386 | G2007 |
| 1978 | G233 | 40 | G241 |
| 1980 | G247 | 144 | G676 |
| 1982 | G249 | 258 | G1322 |
| 1984 | G255 | 140 | G664 |
| 1986 | G342 | 58 | G343 |
| 1988 | G350 | 104 | G545 |
| 1990 | G351 | 104 | G545 |
| 1992 | G370 | 64, 66 | G361, G362 |
| 1994 | G392 | 70, 72, 78 | G390, G391, G438 |
| 1996 | G425 | 76 | G427 |
| 1998 | G426 | 76 | G427 |
| 2000 | G440 | 324 | G1750 |
| 2002 | G448 | 80 | G450 |
| 2004 | G455 | 80 | G450 |
| 2006 | G456 | 80 | G450 |
| 2008 | G463 | 82 | G464 |
| 2010 | G485 | 88, 90 | G481, G482 |
| 2012 | G501 | 102 | G519 |
| 2014 | G502 | 102 | G519 |
| 2016 | G512 | 280 | G1452 |
| 2018 | G515 | 390 | G2053 |
| 2020 | G516 | 390 | G2053 |
| 2022 | G517 | 390 | G2053 |
| 2024 | G554 | 242 | G1198 |
| 2026 | G555 | 242 | G1198 |
| 2028 | G556 | 242 | G1198 |
| 2030 | G558 | 242 | G1198 |
| 2032 | G578 | 242 | G1198 |
| 2034 | G580 | 114 | G568 |
| 2036 | G586 | 118 | G585 |
| 2038 | G596 | 456 | G2789 |
| 2040 | G605 | 374 | G1944 |
| 2042 | G610 | 164 | G849 |
| 2044 | G629 | 242 | G1198 |
| 2046 | G659 | 260 | G1323 |
| 2048 | G666 | 46 | G256 |
| 2050 | G668 | 46 | G256 |
| 2052 | G671 | 426 | G2340 |
| 2054 | G714 | 94 | G489 |
| 2056 | G729 | 208 | G1040 |
| 2058 | G730 | 208 | G1040 |
| 2060 | G767 | 102 | G519 |
| 2062 | G839 | 240 | G1196 |
| 2064 | G861 | 234 | G1140 |
| 2066 | G932 | 46 | G256 |
| 2068 | G986 | 176 | G881 |
| 2070 | G990 | 278 | G1451 |
| 2072 | G993 | 170, 370 | G867, G1930 |
| 2074 | G1006 | 10 | G28 |
| 2076 | G1008 | 406 | G2130 |
| 2078 | G1067 | 224 | G1073 |
| 2080 | G1076 | 226 | G1075 |
| 2082 | G1136 | 116 | G584 |
| 2084 | G1149 | 238 | G1146 |
| 2086 | G1152 | 238 | G1146 |
| 2088 | G1211 | 50 | G291 |
| 2090 | G1277 | 8 | G24 |
| 2092 | G1290 | 48 | G278 |
| 2094 | G1329 | 138 | G663 |
| 2096 | G1335 | 136 | G652 |
| 2098 | G1349 | 180 | G896 |
| 2100 | G1357 | 280 | G1452 |
| 2102 | G1364 | 88, 90 | G481, G482 |
| 2104 | G1379 | 8 | G24 |
| 2106 | G1387 | 200, 450 | G975, G2583 |
| 2108 | G1425 | 98 | G504 |
| 2110 | G1454 | 98 | G504 |
| 2114 | G1461 | 282 | G1463 |
| 2116 | G1462 | 282 | G1463 |
| 2118 | G1464 | 282 | G1463 |
| 2120 | G1465 | 282 | G1463 |
| 2122 | G1484 | 250 | G1255 |
| 2124 | G1548 | 70, 72, 78 | G390, G391, G438 |
| 2126 | G1646 | 150 | G715 |
| 2128 | G1664 | 216 | G1062 |
| 2130 | G1759 | 16, 172, 350, 352 | G157, G859, G1842, G1843 |
| 2132 | G1782 | 268 | G1363 |
| 2134 | G1791 | 332 | G1792 |
| 2136 | G1795 | 332 | G1792 |
| 2138 | G1806 | 242 | G1198 |
| 2140 | G1808 | 210 | G1047 |
| 2142 | G1816 | 38, 148 | G226, G682 |
| 2144 | G1839 | 322 | G1749 |
| 2146 | G1844 | 16, 166, 350, 352 | G157, G859, G1842, G1843 |
| 2148 | G1888 | 288 | G1482 |
| 2150 | G1889 | 60, 62 | G353, G354 |
| 2152 | G1929 | 286 | G1478 |
| 2154 | G1945 | 420 | G2155 |
| 2156 | G1974 | 60, 62 | G353, G354 |
| 2158 | G1995 | 64, 66 | G361, G362 |
| 2160 | G1998 | 56 | G325 |
| 2162 | G2107 | 186, 188 | G912, G913 |
| 2164 | G2131 | 202 | G979 |
| 2166 | G2156 | 224 | G1073 |
| 2168 | G2184 | 368 | G1927 |
| 2170 | G2334 | 356 | G1863 |
| 2172 | G2345 | 88, 90 | G481, G482 |
| 2174 | G2421 | 138 | G663 |
| 2176 | G2422 | 138 | G663 |
| 2178 | G2423 | 262 | G1330 |
| 2180 | G2424 | 312 | G1645 |
| 2182 | G2432 | 154 | G736 |
| 2184 | G2513 | 1956, 1958, 1960, 186 | G40, G41, G42, G912 |
| 2186 | G2535 | 194 | G961 |
| 2188 | G2545 | 76 | G427 |
| 2190 | G2631 | 92 | G484 |
| 2192 | G2718 | 38, 148 | G226, G682 |
| 2194 | G2776 | 316 | G1652 |
| 2196 | G2826 | 64, 66 | G361, G362, G1995 |
| 2198 | G2838 | 64, 66 | G361, G362, G1995 |
| 2200 | G2839 | 60, 62 | G353, G354 |
| 2202 | G3010 | 204 | G987 |

Table 10 lists the gene identification number (GID) and homologous relationships found using analyses according to Example IX for the sequences of the Sequence Listing.

TABLE 10

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 459 | | DNA | Glycine max | Predicted polypeptide sequence is orthologous to G8 |
| 460 | | DNA | Glycine max | Predicted polypeptide sequence is orthologous to G8 |
| 461 | | DNA | Glycine max | Predicted polypeptide sequence is orthologous to G8 |
| 462 | | DNA | Glycine max | Predicted polypeptide sequence is orthologous to G8 |
| 463 | | DNA | Oryza sativa | Predicted polypeptide sequence is orthologous to G8 |
| 464 | | DNA | Zea mays | Predicted polypeptide sequence is orthologous to G8 |
| 465 | | DNA | Zea mays | Predicted polypeptide sequence is orthologous to G8 |
| 466 | | DNA | Zea mays | Predicted polypeptide sequence is orthologous to G8 |
| 467 | | PRT | Oryza sativa | Orthologous to G8 |
| 468 | | DNA | Glycine max | Predicted polypeptide sequence is orthologous to G19 |
| 469 | | DNA | Glycine max | Predicted polypeptide sequence is orthologous to G19 |
| 470 | | DNA | Glycine max | Predicted polypeptide sequence is orthologous to G19 |
| 471 | | DNA | Glycine max | Predicted polypeptide sequence is orthologous to G19 |
| 472 | | DNA | Oryza sativa | Predicted polypeptide sequence is orthologous to G19 |
| 473 | | DNA | Oryza sativa | Predicted polypeptide sequence is orthologous to G19 |
| 474 | | DNA | Oryza sativa | Predicted polypeptide sequence is orthologous to G19 |
| 475 | | DNA | Zea mays | Predicted polypeptide sequence is orthologous to G19 |
| 476 | | DNA | Zea mays | Predicted polypeptide sequence is orthologous to G19 |
| 477 | | DNA | Glycine max | Predicted polypeptide sequence is orthologous to G22 |
| 478 | | DNA | Glycine max | Predicted polypeptide sequence is orthologous to G22 |
| 479 | | DNA | Glycine max | Predicted polypeptide sequence is orthologous to G24 |
| 480 | | DNA | Glycine max | Predicted polypeptide sequence is orthologous to G24 |
| 481 | | DNA | Glycine max | Predicted polypeptide sequence is orthologous to G24 |
| 482 | | DNA | Glycine max | Predicted polypeptide sequence is orthologous to G24 |
| 483 | | DNA | Glycine max | Predicted polypeptide sequence is orthologous to G24 |
| 484 | | DNA | Glycine max | Predicted polypeptide sequence is orthologous to G24 |
| 485 | | DNA | Glycine max | Predicted polypeptide sequence is orthologous to G24 |
| 486 | | DNA | Oryza sativa | Predicted polypeptide sequence is orthologous to G24 |
| 487 | | DNA | Zea mays | Predicted polypeptide sequence is orthologous to G24 |
| 488 | | PRT | Oryza sativa | Orthologous to G24 |
| 489 | | PRT | Oryza sativa | Orthologous to G24 |
| 490 | | PRT | Oryza sativa | Orthologous to G24 |
| 491 | | DNA | Glycine max | Predicted polypeptide sequence is orthologous to G28 |
| 492 | | DNA | Glycine max | Predicted polypeptide sequence is orthologous to G28 |
| 493 | | DNA | Glycine max | Predicted polypeptide sequence is orthologous to G28 |
| 494 | | DNA | Glycine max | Predicted polypeptide sequence is orthologous to G28 |
| 495 | | DNA | Glycine max | Predicted polypeptide sequence is orthologous to G28 |
| 496 | | DNA | Glycine max | Predicted polypeptide sequence is orthologous to G28 |
| 497 | | DNA | Glycine max | Predicted polypeptide sequence is orthologous to G28 |
| 498 | | DNA | Glycine max | Predicted polypeptide sequence is orthologous to G28 |
| 499 | | DNA | Oryza sativa | Predicted polypeptide sequence is orthologous to G28 |
| 500 | | DNA | Zea mays | Predicted polypeptide sequence is orthologous to G28 |
| 501 | | PRT | Oryza sativa | Orthologous to G28 |
| 502 | | PRT | Oryza sativa | Orthologous to G28 |
| 503 | | PRT | Mesembryanthemum crystallinum | Orthologous to G28 |
| 504 | | DNA | Glycine max | Predicted polypeptide sequence is orthologous to G47, G2133 |
| 505 | | PRT | Oryza sativa | Orthologous to G47, G2133 |
| 506 | | DNA | Glycine max | Predicted polypeptide sequence is orthologous to G157, G859, G1842, G1843 |
| 507 | | DNA | Glycine max | Predicted polypeptide sequence is orthologous to G175, G877 |
| 508 | | DNA | Oryza sativa | Predicted polypeptide sequence is orthologous to G175, G877 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 509 | | DNA | Zea mays | Predicted polypeptide sequence is orthologous to G175, G877 |
| 510 | | DNA | Zea mays | Predicted polypeptide sequence is orthologous to G175, G877 |
| 511 | | DNA | Zea mays | Predicted polypeptide sequence is orthologous to G175, G877 |
| 512 | | PRT | Oryza sativa | Orthologous to G175, G877 |
| 513 | | PRT | Oryza sativa | Orthologous to G175, G877 |
| 514 | | PRT | Oryza sativa | Orthologous to G175, G877 |
| 515 | | PRT | Nicotiana tabacum | Orthologous to G175, G877 |
| 516 | | DNA | Glycine max | Predicted polypeptide sequence is orthologous to G180 |
| 517 | | DNA | Glycine max | Predicted polypeptide sequence is orthologous to G180 |
| 518 | | DNA | Oryza sativa | Predicted polypeptide sequence is orthologous to G180 |
| 519 | | DNA | Zea mays | Predicted polypeptide sequence is orthologous to G180 |
| 520 | | DNA | Solanum tuberosum | Predicted polypeptide sequence is orthologous to G180 |
| 521 | | PRT | Oryza sativa | Orthologous to G180 |
| 522 | | PRT | Capsella rubella | Orthologous to G183 |
| 523 | | DNA | Glycine max | Predicted polypeptide sequence is orthologous to G188 |
| 524 | | DNA | Zea mays | Predicted polypeptide sequence is orthologous to G188 |
| 525 | | PRT | Oryza sativa | Orthologous to G188 |
| 526 | | PRT | Oryza sativa | Orthologous to G188 |
| 527 | | DNA | Glycine max | Predicted polypeptide sequence is orthologous to G189 |
| 528 | | PRT | Nicotiana tabacum | Orthologous to G189 |
| 529 | | DNA | Glycine max | Predicted polypeptide sequence is orthologous to G192 |
| 530 | | PRT | Oryza sativa | Orthologous to G192 |
| 531 | | DNA | Glycine max | Predicted polypeptide sequence is orthologous to G196 |
| 532 | | DNA | Zea mays | Predicted polypeptide sequence is orthologous to G196 |
| 533 | | DNA | Zea mays | Predicted polypeptide sequence is orthologous to G196 |
| 534 | | PRT | Oryza sativa | Orthologous to G196 |
| 535 | | PRT | Oryza sativa | Orthologous to G196 |
| 536 | | PRT | Oryza sativa | Orthologous to G196 |
| 537 | | PRT | Oryza sativa | Orthologous to G196 |
| 538 | | DNA | Glycine max | Predicted polypeptide sequence is orthologous to G211 |
| 539 | | DNA | Oryza sativa | Predicted polypeptide sequence is orthologous to G211 |
| 540 | | PRT | Oryza sativa | Orthologous to G211 |
| 541 | | DNA | Glycine max | Predicted polypeptide sequence is orthologous to G214, G680 |
| 542 | | DNA | Glycine max | Predicted polypeptide sequence is orthologous to G214, G680 |
| 543 | | DNA | Glycine max | Predicted polypeptide sequence is orthologous to G214, G680 |
| 544 | | DNA | Glycine max | Predicted polypeptide sequence is orthologous to G214, G680 |
| 545 | | DNA | Oryza sativa | Predicted polypeptide sequence is orthologous to G214, G680 |
| 546 | | DNA | Oryza sativa | Predicted polypeptide sequence is orthologous to G214, G680 |
| 547 | | DNA | Zea mays | Predicted polypeptide sequence is orthologous to G214, G680 |
| 548 | | DNA | Zea mays | Predicted polypeptide sequence is orthologous to G214, G680 |
| 549 | | DNA | Zea mays | Predicted polypeptide sequence is orthologous to G214, G680 |
| 550 | | DNA | Glycine max | Predicted polypeptide sequence is orthologous to G226, G682 |
| 551 | | DNA | Glycine max | Predicted polypeptide sequence is orthologous to G226 |
| 552 | | DNA | Glycine max | Predicted polypeptide sequence is orthologous to G226, G682 |
| 553 | | DNA | Glycine max | Predicted polypeptide sequence is orthologous to G226, G682 |
| 554 | | DNA | Glycine max | Predicted polypeptide sequence is orthologous to G226, G682 |
| 555 | | DNA | Oryza sativa | Predicted polypeptide sequence is orthologous to G226, G682 |
| 556 | | DNA | Zea mays | Predicted polypeptide sequence is orthologous to G226, G682 |
| 557 | | DNA | Zea mays | Predicted polypeptide sequence is orthologous to G226, G682 |
| 558 | | PRT | Oryza sativa | Orthologous to G226, G682 |
| 559 | | PRT | Oryza sativa | Orthologous to G226, G682 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 560 | | DNA | Glycine max | Predicted polypeptide sequence is orthologous to G241 |
| 561 | | DNA | Glycine max | Predicted polypeptide sequence is orthologous to G241 |
| 562 | | DNA | Glycine max | Predicted polypeptide sequence is orthologous to G241 |
| 563 | | DNA | Oryza sativa | Predicted polypeptide sequence is orthologous to G241 |
| 564 | | DNA | Zea mays | Predicted polypeptide sequence is orthologous to G241 |
| 565 | | DNA | Zea mays | Predicted polypeptide sequence is orthologous to G241 |
| 566 | | DNA | Zea mays | Predicted polypeptide sequence is orthologous to G241 |
| 567 | | DNA | Zea mays | Predicted polypeptide sequence is orthologous to G241 |
| 568 | | DNA | Zea mays | Predicted polypeptide sequence is orthologous to G241 |
| 569 | | PRT | Nicotiana tabacum | Orthologous to G241 |
| 570 | | DNA | Glycine max | Predicted polypeptide sequence is orthologous to G254 |
| 571 | | DNA | Glycine max | Predicted polypeptide sequence is orthologous to G256 |
| 572 | | DNA | Glycine max | Predicted polypeptide sequence is orthologous to G256 |
| 573 | | DNA | Glycine max | Predicted polypeptide sequence is orthologous to G256 |
| 574 | | DNA | Glycine max | Predicted polypeptide sequence is orthologous to G256 |
| 575 | | DNA | Glycine max | Predicted polypeptide sequence is orthologous to G256 |
| 576 | | DNA | Glycine max | Predicted polypeptide sequence is orthologous to G256 |
| 577 | | DNA | Glycine max | Predicted polypeptide sequence is orthologous to G256 |
| 578 | | DNA | Oryza sativa | Predicted polypeptide sequence is orthologous to G256 |
| 579 | | DNA | Zea mays | Predicted polypeptide sequence is orthologous to G256 |
| 580 | | DNA | Zea mays | Predicted polypeptide sequence is orthologous to G256 |
| 581 | | DNA | Zea mays | Predicted polypeptide sequence is orthologous to G256 |
| 582 | | DNA | Zea mays | Predicted polypeptide sequence is orthologous to G256 |
| 583 | | DNA | Zea mays | Predicted polypeptide sequence is orthologous to G256 |
| 584 | | DNA | Zea mays | Predicted polypeptide sequence is orthologous to G256 |
| 585 | G3500 | DNA | Lycopersicon esculentum | Predicted polypeptide sequence is orthologous to G256 |
| 586 | G3501 | DNA | Lycopersicon esculentum | Predicted polypeptide sequence is orthologous to G256 |
| 587 | G3385 | PRT | Oryza sativa | Orthologous to G256 |
| 588 | G3386 | PRT | Oryza sativa | Orthologous to G256 |
| 589 | | PRT | Oryza sativa | Orthologous to G256 |
| 590 | G3384 | PRT | Oryza sativa | Orthologous to G256 |
| 591 | | PRT | Oryza sativa | Orthologous to G256 |
| 592 | G3502 | PRT | Oryza sativa japonica | Orthologous to G256 |
| 593 | G3500 | PRT | Lycopersicon esculentum | Orthologous to G256 |
| 594 | G3501 | PRT | Lycopersicon esculentum | Orthologous to G256 |
| 595 | | DNA | Oryza sativa | Predicted polypeptide sequence is orthologous to G278 |
| 596 | | DNA | Zea mays | Predicted polypeptide sequence is orthologous to G278 |
| 597 | | PRT | Oryza sativa | Orthologous to G278 |
| 598 | | DNA | Glycine max | Predicted polypeptide sequence is orthologous to G312 |
| 599 | | DNA | Zea mays | Predicted polypeptide sequence is orthologous to G312 |
| 600 | | DNA | Euphorbia esula | Predicted polypeptide sequence is orthologous to G312 |
| 601 | | DNA | Glycine max | Predicted polypeptide sequence is orthologous to G325 |
| 602 | | DNA | Glycine max | Predicted polypeptide sequence is orthologous to G343 |
| 603 | | DNA | Glycine max | Predicted polypeptide sequence is orthologous to G343 |
| 604 | | DNA | Glycine max | Predicted polypeptide sequence is orthologous to G343 |
| 605 | | DNA | Oryza sativa | Predicted polypeptide sequence is orthologous to G343 |
| 606 | | DNA | Oryza sativa | Predicted polypeptide sequence is orthologous to G343 |
| 607 | | PRT | Oryza sativa | Orthologous to G343 |
| 608 | | PRT | Oryza sativa | Orthologous to G343 |
| 609 | | PRT | Oryza sativa | Orthologous to G343 |
| 610 | | DNA | Glycine max | Predicted polypeptide sequence is orthologous to G353, G354 |
| 611 | | DNA | Glycine max | Predicted polypeptide sequence is orthologous to G353, G354 |
| 612 | | DNA | Glycine max | Predicted polypeptide sequence is orthologous to G353, G354 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 613 | | DNA | Oryza sativa | Predicted polypeptide sequence is orthologous to G353, G354 |
| 614 | | DNA | Zea mays | Predicted polypeptide sequence is orthologous to G353, G354 |
| 615 | | DNA | Zea mays | Predicted polypeptide sequence is orthologous to G353, G354 |
| 616 | | DNA | Zea mays | Predicted polypeptide sequence is orthologous to G353, G354 |
| 617 | | DNA | Zea mays | Predicted polypeptide sequence is orthologous to G353, G354 |
| 618 | | DNA | Zea mays | Predicted polypeptide sequence is orthologous to G353, G354 |
| 619 | | DNA | Zea mays | Predicted polypeptide sequence is orthologous to G353, G354 |
| 620 | | DNA | Zea mays | Predicted polypeptide sequence is orthologous to G353, G354 |
| 621 | | PRT | Oryza sativa | Orthologous to G353, G354 |
| 622 | | PRT | Oryza sativa | Orthologous to G353, G354 |
| 623 | | PRT | Oryza sativa | Orthologous to G353, G354 |
| 624 | | PRT | Oryza sativa | Orthologous to G353, G354 |
| 625 | | PRT | Oryza sativa | Orthologous to G353, G354 |
| 626 | | PRT | Oryza sativa | Orthologous to G353, G354 |
| 627 | | DNA | Glycine max | Predicted polypeptide sequence is orthologous to G361, G362 |
| 628 | | DNA | Glycine max | Predicted polypeptide sequence is orthologous to G361, G362 |
| 629 | | DNA | Glycine max | Predicted polypeptide sequence is orthologous to G361 |
| 630 | | DNA | Glycine max | Predicted polypeptide sequence is orthologous to G361, G362 |
| 631 | | DNA | Glycine max | Predicted polypeptide sequence is orthologous to G361, G362 |
| 632 | | DNA | Oryza sativa | Predicted polypeptide sequence is orthologous to G361, G362 |
| 633 | | DNA | Zea mays | Predicted polypeptide sequence is orthologous to G361, G362 |
| 634 | | DNA | Zea mays | Predicted polypeptide sequence is orthologous to G361, G362 |
| 635 | | PRT | Oryza sativa | Orthologous to G361, G362 |
| 636 | | PRT | Oryza sativa | Orthologous to G361, G362 |
| 637 | | PRT | Oryza sativa | Orthologous to G361, G362 |
| 638 | | PRT | Oryza sativa | Orthologous to G361, G362 |
| 639 | | PRT | Oryza sativa | Orthologous to G361, G362 |
| 640 | | DNA | Glycine max | Predicted polypeptide sequence is orthologous to G390, G391, G438 |
| 641 | | DNA | Glycine max | Predicted polypeptide sequence is orthologous to G390, G391, G438 |
| 642 | | DNA | Glycine max | Predicted polypeptide sequence is orthologous to G390, G391, G438 |
| 643 | | DNA | Glycine max | Predicted polypeptide sequence is orthologous to G390, G391, G438 |
| 644 | | DNA | Glycine max | Predicted polypeptide sequence is orthologous to G390, G391, G438 |
| 645 | | DNA | Glycine max | Predicted polypeptide sequence is orthologous to G390, G391, G438 |
| 646 | | DNA | Glycine max | Predicted polypeptide sequence is orthologous to G390, G391, G438 |
| 647 | | DNA | Glycine max | Predicted polypeptide sequence is orthologous to G390, G391 |
| 648 | | DNA | Glycine max | Predicted polypeptide sequence is orthologous to G390, G391, G438 |
| 649 | | DNA | Glycine max | Predicted polypeptide sequence is orthologous to G390, G391, G438 |
| 650 | | DNA | Oryza sativa | Predicted polypeptide sequence is orthologous to G390 |
| 651 | | DNA | Oryza sativa | Predicted polypeptide sequence is orthologous to G390, G438 |
| 652 | | DNA | Zea mays | Predicted polypeptide sequence is orthologous to G390, G391, G438 |
| 653 | | DNA | Zea mays | Predicted polypeptide sequence is orthologous to G390, G391, G438 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 654 | | DNA | Zea mays | Predicted polypeptide sequence is orthologous to G390, G391, G438 |
| 655 | | DNA | Zea mays | Predicted polypeptide sequence is orthologous to G390, G391 |
| 656 | | DNA | Zea mays | Predicted polypeptide sequence is orthologous to G390, G391, G438 |
| 657 | | DNA | Zea mays | Predicted polypeptide sequence is orthologous to G390, G391, G438 |
| 658 | | DNA | Zea mays | Predicted polypeptide sequence is orthologous to G390, G391, G438 |
| 659 | | DNA | Zea mays | Predicted polypeptide sequence is orthologous to G390, G391, G438 |
| 660 | | DNA | Zea mays | Predicted polypeptide sequence is orthologous to G390, G391, G438 |
| 661 | | DNA | Zea mays | Predicted polypeptide sequence is orthologous to G390, G391, G438 |
| 662 | | DNA | Zea mays | Predicted polypeptide sequence is orthologous to G390, G391, G438 |
| 663 | | DNA | Lycopersicon esculentum | Predicted polypeptide sequence is orthologous to G390, G391, G438 |
| 664 | | DNA | Oryza sativa | Predicted polypeptide sequence is orthologous to G391, G438 |
| 665 | | PRT | Oryza sativa | Orthologous to G390, G391, G438 |
| 666 | | PRT | Oryza sativa | Orthologous to G390, G391, G438 |
| 667 | | PRT | Oryza sativa | Orthologous to G390, G391, G438 |
| 668 | | PRT | Oryza sativa | Orthologous to G390, G391, G438 |
| 669 | | PRT | Physcomitrella patens | Orthologous to G391 |
| 670 | | DNA | Glycine max | Predicted polypeptide sequence is orthologous to G409 |
| 671 | | DNA | Glycine max | Predicted polypeptide sequence is orthologous to G409 |
| 672 | | DNA | Glycine max | Predicted polypeptide sequence is orthologous to G409 |
| 673 | | DNA | Glycine max | Predicted polypeptide sequence is orthologous to G409 |
| 674 | | DNA | Glycine max | Predicted polypeptide sequence is orthologous to G409 |
| 675 | | DNA | Glycine max | Predicted polypeptide sequence is orthologous to G409 |
| 676 | | DNA | Glycine max | Predicted polypeptide sequence is orthologous to G409 |
| 677 | | DNA | Glycine max | Predicted polypeptide sequence is orthologous to G409 |
| 678 | | DNA | Oryza sativa | Predicted polypeptide sequence is orthologous to G409 |
| 679 | | DNA | Oryza sativa | Predicted polypeptide sequence is orthologous to G409 |
| 680 | | DNA | Oryza sativa | Predicted polypeptide sequence is orthologous to G409 |
| 681 | | DNA | Zea mays | Predicted polypeptide sequence is orthologous to G409 |
| 682 | | DNA | Zea mays | Predicted polypeptide sequence is orthologous to G409 |
| 683 | | DNA | Zea mays | Predicted polypeptide sequence is orthologous to G409 |
| 684 | | DNA | Zea mays | Predicted polypeptide sequence is orthologous to G409 |
| 685 | | DNA | Zea mays | Predicted polypeptide sequence is orthologous to G409 |
| 686 | | DNA | Zea mays | Predicted polypeptide sequence is orthologous to G409 |
| 687 | | DNA | Zea mays | Predicted polypeptide sequence is orthologous to G409 |
| 688 | | DNA | Glycine max | Predicted polypeptide sequence is orthologous to G427 |
| 689 | | DNA | Glycine max | Predicted polypeptide sequence is orthologous to G427 |
| 690 | | DNA | Glycine max | Predicted polypeptide sequence is orthologous to G427 |
| 691 | | DNA | Glycine max | Predicted polypeptide sequence is orthologous to G427 |
| 692 | | DNA | Glycine max | Predicted polypeptide sequence is orthologous to G427 |
| 693 | | DNA | Glycine max | Predicted polypeptide sequence is orthologous to G427 |
| 694 | | DNA | Glycine max | Predicted polypeptide sequence is orthologous to G427 |
| 695 | | DNA | Glycine max | Predicted polypeptide sequence is orthologous to G427 |
| 696 | | DNA | Glycine max | Predicted polypeptide sequence is orthologous to G427 |
| 697 | | DNA | Glycine max | Predicted polypeptide sequence is orthologous to G427 |
| 698 | | DNA | Oryza sativa | Predicted polypeptide sequence is orthologous to G427 |
| 699 | | DNA | Zea mays | Predicted polypeptide sequence is orthologous to G427 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 700 | | DNA | Zea mays | Predicted polypeptide sequence is orthologous to G427 |
| 701 | | DNA | Zea mays | Predicted polypeptide sequence is orthologous to G427 |
| 702 | | DNA | Zea mays | Predicted polypeptide sequence is orthologous to G427 |
| 703 | | DNA | Zea mays | Predicted polypeptide sequence is orthologous to G427 |
| 704 | | DNA | Zea mays | Predicted polypeptide sequence is orthologous to G427 |
| 705 | | DNA | Zea mays | Predicted polypeptide sequence is orthologous to G427 |
| 706 | | DNA | Zea mays | Predicted polypeptide sequence is orthologous to G427 |
| 707 | | DNA | Zea mays | Predicted polypeptide sequence is orthologous to G427 |
| 708 | | PRT | Oryza sativa | Orthologous to G427 |
| 709 | | PRT | Oryza sativa | Orthologous to G427 |
| 710 | | PRT | Oryza sativa | Orthologous to G427 |
| 711 | | PRT | Malus x domestica | Orthologous to G427 |
| 712 | | PRT | Nicotiana tabacum | Orthologous to G427 |
| 713 | | PRT | Lycopersicon esculentum | Orthologous to G427 |
| 714 | | DNA | Glycine max | Predicted polypeptide sequence is orthologous to G438 |
| 715 | | DNA | Oryza sativa | Predicted polypeptide sequence is orthologous to G438 |
| 716 | | DNA | Oryza sativa | Predicted polypeptide sequence is orthologous to G438 |
| 717 | | DNA | Oryza sativa | Predicted polypeptide sequence is orthologous to G438 |
| 718 | | DNA | Oryza sativa | Predicted polypeptide sequence is orthologous to G438 |
| 719 | | DNA | Zea mays | Predicted polypeptide sequence is orthologous to G438 |
| 720 | | PRT | Physcomitrella patens | Orthologous to G438 |
| 721 | | PRT | Oryza sativa | Orthologous to G438 |
| 722 | | DNA | Glycine max | Predicted polypeptide sequence is orthologous to G450 |
| 723 | | DNA | Glycine max | Predicted polypeptide sequence is orthologous to G450 |
| 724 | | DNA | Glycine max | Predicted polypeptide sequence is orthologous to G450 |
| 725 | | DNA | Glycine max | Predicted polypeptide sequence is orthologous to G450 |
| 726 | | DNA | Glycine max | Predicted polypeptide sequence is orthologous to G450 |
| 727 | | DNA | Glycine max | Predicted polypeptide sequence is orthologous to G450 |
| 728 | | DNA | Glycine max | Predicted polypeptide sequence is orthologous to G450 |
| 729 | | DNA | Glycine max | Predicted polypeptide sequence is orthologous to G450 |
| 730 | | DNA | Glycine max | Predicted polypeptide sequence is orthologous to G450 |
| 731 | | DNA | Oryza sativa | Predicted polypeptide sequence is orthologous to G450 |
| 732 | | DNA | Oryza sativa | Predicted polypeptide sequence is orthologous to G450 |
| 733 | | DNA | Zea mays | Predicted polypeptide sequence is orthologous to G450 |
| 734 | | DNA | Zea mays | Predicted polypeptide sequence is orthologous to G450 |
| 735 | | DNA | Zea mays | Predicted polypeptide sequence is orthologous to G450 |
| 736 | | PRT | Oryza sativa | Orthologous to G450 |
| 737 | | PRT | Oryza sativa | Orthologous to G450 |
| 738 | | PRT | Oryza sativa | Orthologous to G450 |
| 739 | | PRT | Oryza sativa | Orthologous to G450 |
| 740 | | DNA | Oryza sativa | Predicted polypeptide sequence is orthologous to G464 |
| 741 | | DNA | Zea mays | Predicted polypeptide sequence is orthologous to G464 |
| 742 | | PRT | Oryza sativa | Orthologous to G464 |
| 743 | | DNA | Glycine max | Predicted polypeptide sequence is orthologous to G470 |
| 744 | | DNA | Oryza sativa | Predicted polypeptide sequence is orthologous to G470 |
| 745 | | DNA | Oryza sativa | Predicted polypeptide sequence is orthologous to G470 |
| 746 | | DNA | Glycine max | Predicted polypeptide sequence is orthologous to G481, G482 |
| 747 | | DNA | Glycine max | Predicted polypeptide sequence is orthologous to G481, G482 |
| 748 | | DNA | Glycine max | Predicted polypeptide sequence is orthologous to G481, G482 |
| 749 | | DNA | Glycine max | Predicted polypeptide sequence is orthologous to G481, G482 |
| 750 | | DNA | Glycine max | Predicted polypeptide sequence is orthologous to G481, G482 |
| 751 | | DNA | Glycine max | Predicted polypeptide sequence is orthologous to G481, G482 |
| 752 | | DNA | Glycine max | Predicted polypeptide sequence is orthologous to G481, G482 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 753 | | DNA | Glycine max | Predicted polypeptide sequence is orthologous to G481, G482 |
| 754 | | DNA | Glycine max | Predicted polypeptide sequence is orthologous to G481 |
| 755 | | DNA | Glycine max | Predicted polypeptide sequence is orthologous to G481 |
| 756 | | DNA | Oryza sativa | Predicted polypeptide sequence is orthologous to G481 |
| 757 | | DNA | Oryza sativa | Predicted polypeptide sequence is orthologous to G481, G482 |
| 758 | | DNA | Zea mays | Predicted polypeptide sequence is orthologous to G481 |
| 759 | | DNA | Zea mays | Predicted polypeptide sequence is orthologous to G481, G482 |
| 760 | | DNA | Zea mays | Predicted polypeptide sequence is orthologous to G481, G482 |
| 761 | | DNA | Zea mays | Predicted polypeptide sequence is orthologous to G481, G482 |
| 762 | | DNA | Zea mays | Predicted polypeptide sequence is orthologous to G481, G482 |
| 763 | | DNA | Zea mays | Predicted polypeptide sequence is orthologous to G481, G482 |
| 764 | | DNA | Zea mays | Predicted polypeptide sequence is orthologous to G481, G482 |
| 765 | | DNA | Zea mays | Predicted polypeptide sequence is orthologous to G481, G482 |
| 766 | | DNA | Zea mays | Predicted polypeptide sequence is orthologous to G481, G482 |
| 767 | | DNA | Zea mays | Predicted polypeptide sequence is orthologous to G481, G482 |
| 768 | | DNA | Gossypium arboreum | Predicted polypeptide sequence is orthologous to G481, G482 |
| 769 | | DNA | Glycine max | Predicted polypeptide sequence is orthologous to G481, G482 |
| 770 | | DNA | Gossypium hirsutum | Predicted polypeptide sequence is orthologous to G481, G482 |
| 771 | | DNA | Lycopersicon esculentum | Predicted polypeptide sequence is orthologous to G481, G482 |
| 772 | | DNA | Lycopersicon esculentum | Predicted polypeptide sequence is orthologous to G481, G482 |
| 773 | | DNA | Medicago truncatula | Predicted polypeptide sequence is orthologous to G481, G482 |
| 774 | | DNA | Lycopersicon esculentum | Predicted polypeptide sequence is orthologous to G481, G482 |
| 775 | | DNA | Solanum tuberosum | Predicted polypeptide sequence is orthologous to G481, G482 |
| 776 | | DNA | Triticum aestivum | Predicted polypeptide sequence is orthologous to G481, G482 |
| 777 | | DNA | Hordeum vulgare | Predicted polypeptide sequence is orthologous to G481, G482 |
| 778 | | DNA | Triticum monococcum | Predicted polypeptide sequence is orthologous to G481, G482 |
| 779 | | DNA | Glycine max | Predicted polypeptide sequence is orthologous to G482 |
| 780 | | PRT | Oryza sativa | Orthologous to G481, G482 |
| 781 | | PRT | Oryza sativa | Orthologous to G481, G482 |
| 782 | | PRT | Oryza sativa | Orthologous to G481, G482 |
| 783 | | PRT | Oryza sativa | Orthologous to G481, G482 |
| 784 | | PRT | Oryza sativa | Orthologous to G481, G482 |
| 785 | | PRT | Zea mays | Orthologous to G481, G482 |
| 786 | | PRT | Zea mays | Orthologous to G481, G482 |
| 787 | | PRT | Oryza sativa | Orthologous to G481, G482 |
| 788 | | PRT | Oryza sativa | Orthologous to G481, G482 |
| 789 | | PRT | Oryza sativa | Orthologous to G481, G482 |
| 790 | | PRT | Oryza sativa | Orthologous to G481, G482 |
| 791 | | PRT | Oryza sativa | Orthologous to G481, G482 |
| 792 | | PRT | Oryza sativa | Orthologous to G481, G482 |
| 793 | | PRT | Oryza sativa | Orthologous to G481, G482 |
| 794 | | PRT | Oryza sativa | Orthologous to G481, G482 |
| 795 | | PRT | Oryza sativa | Orthologous to G481, G482 |
| 796 | | PRT | Oryza sativa | Orthologous to G481, G482 |
| 797 | | PRT | Glycine max | Orthologous to G481, G482 |
| 798 | | PRT | Glycine max | Orthologous to G481, G482 |
| 799 | | PRT | Glycine max | Orthologous to G481, G482 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 800 | | PRT | Glycine max | Orthologous to G481, G482 |
| 801 | | PRT | Glycine max | Orthologous to G481, G482 |
| 802 | | PRT | Glycine max | Orthologous to G481, G482 |
| 803 | | PRT | Glycine max | Orthologous to G481, G482 |
| 804 | | PRT | Zea mays | Orthologous to G481, G482 |
| 805 | | PRT | Zea mays | Orthologous to G481, G482 |
| 806 | | PRT | Zea mays | Orthologous to G481, G482 |
| 807 | | PRT | Zea mays | Orthologous to G481, G482 |
| 808 | | DNA | Glycine max | Predicted polypeptide sequence is orthologous to G484 |
| 809 | | DNA | Glycine max | Predicted polypeptide sequence is orthologous to G484 |
| 810 | | DNA | Glycine max | Predicted polypeptide sequence is orthologous to G484 |
| 811 | | DNA | Glycine max | Predicted polypeptide sequence is orthologous to G484 |
| 812 | | DNA | Glycine max | Predicted polypeptide sequence is orthologous to G484 |
| 813 | | DNA | Glycine max | Predicted polypeptide sequence is orthologous to G484 |
| 814 | | DNA | Glycine max | Predicted polypeptide sequence is orthologous to G484 |
| 815 | | DNA | Glycine max | Predicted polypeptide sequence is orthologous to G484 |
| 816 | | DNA | Glycine max | Predicted polypeptide sequence is orthologous to G484 |
| 817 | | DNA | Glycine max | Predicted polypeptide sequence is orthologous to G484 |
| 818 | | DNA | Oryza sativa | Predicted polypeptide sequence is orthologous to G484 |
| 819 | | DNA | Zea mays | Predicted polypeptide sequence is orthologous to G484 |
| 820 | | DNA | Zea mays | Predicted polypeptide sequence is orthologous to G484 |
| 821 | | DNA | Zea mays | Predicted polypeptide sequence is orthologous to G484 |
| 822 | | DNA | Zea mays | Predicted polypeptide sequence is orthologous to G484 |
| 823 | | DNA | Zea mays | Predicted polypeptide sequence is orthologous to G484 |
| 824 | | PRT | Oryza sativa | Orthologous to G484 |
| 825 | | DNA | Glycine max | Predicted polypeptide sequence is orthologous to G489 |
| 826 | | DNA | Glycine max | Predicted polypeptide sequence is orthologous to G489 |
| 827 | | DNA | Glycine max | Predicted polypeptide sequence is orthologous to G489 |
| 828 | | DNA | Glycine max | Predicted polypeptide sequence is orthologous to G489 |
| 829 | | DNA | Glycine max | Predicted polypeptide sequence is orthologous to G489 |
| 830 | | DNA | Glycine max | Predicted polypeptide sequence is orthologous to G489 |
| 831 | | DNA | Glycine max | Predicted polypeptide sequence is orthologous to G489 |
| 832 | | DNA | Oryza sativa | Predicted polypeptide sequence is orthologous to G489 |
| 833 | | DNA | Oryza sativa | Predicted polypeptide sequence is orthologous to G489 |
| 834 | | DNA | Zea mays | Predicted polypeptide sequence is orthologous to G489 |
| 835 | | PRT | Oryza sativa | Orthologous to G489 |
| 836 | | PRT | Oryza sativa | Orthologous to G489 |
| 837 | | PRT | Oryza sativa | Orthologous to G489 |
| 838 | | DNA | Glycine max | Predicted polypeptide sequence is orthologous to G504 |
| 839 | | DNA | Glycine max | Predicted polypeptide sequence is orthologous to G504 |
| 840 | | DNA | Glycine max | Predicted polypeptide sequence is orthologous to G504 |
| 841 | | DNA | Glycine max | Predicted polypeptide sequence is orthologous to G504 |
| 842 | | DNA | Glycine max | Predicted polypeptide sequence is orthologous to G504 |
| 843 | | DNA | Glycine max | Predicted polypeptide sequence is orthologous to G504 |
| 844 | | DNA | Glycine max | Predicted polypeptide sequence is orthologous to G504 |
| 845 | | DNA | Oryza sativa | Predicted polypeptide sequence is orthologous to G504 |
| 846 | | DNA | Oryza sativa | Predicted polypeptide sequence is orthologous to G504 |
| 847 | | DNA | Zea mays | Predicted polypeptide sequence is orthologous to G504 |
| 848 | | DNA | Zea mays | Predicted polypeptide sequence is orthologous to G504 |
| 849 | | DNA | Zea mays | Predicted polypeptide sequence is orthologous to G504 |
| 850 | | DNA | Zea mays | Predicted polypeptide sequence is orthologous to G504 |
| 851 | | PRT | Oryza sativa | Orthologous to G504 |
| 852 | | PRT | Oryza sativa | Orthologous to G504 |
| 853 | | PRT | Oryza sativa | Orthologous to G504 |
| 854 | | PRT | Oryza sativa | Orthologous to G504 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 855 | | DNA | Lycopersicon esculentum | Predicted polypeptide sequence is orthologous to G509 |
| 856 | | DNA | Glycine max | Predicted polypeptide sequence is orthologous to G509 |
| 857 | | DNA | Glycine max | Predicted polypeptide sequence is orthologous to G509 |
| 858 | | DNA | Glycine max | Predicted polypeptide sequence is orthologous to G509 |
| 859 | | DNA | Oryza sativa | Predicted polypeptide sequence is orthologous to G509 |
| 860 | | DNA | Oryza sativa | Predicted polypeptide sequence is orthologous to G509 |
| 861 | | DNA | Zea mays | Predicted polypeptide sequence is orthologous to G509 |
| 862 | | DNA | Zea mays | Predicted polypeptide sequence is orthologous to G509 |
| 863 | | DNA | Zea mays | Predicted polypeptide sequence is orthologous to G509 |
| 864 | | DNA | Zea mays | Predicted polypeptide sequence is orthologous to G509 |
| 865 | | PRT | Oryza sativa | Orthologous to G509 |
| 866 | | PRT | Oryza sativa | Orthologous to G509 |
| 867 | | PRT | Oryza sativa | Orthologous to G509 |
| 868 | | DNA | Glycine max | Predicted polypeptide sequence is orthologous to G519 |
| 869 | | DNA | Glycine max | Predicted polypeptide sequence is orthologous to G519 |
| 870 | | DNA | Glycine max | Predicted polypeptide sequence is orthologous to G519 |
| 871 | | DNA | Glycine max | Predicted polypeptide sequence is orthologous to G519 |
| 872 | | DNA | Glycine max | Predicted polypeptide sequence is orthologous to G519 |
| 873 | | DNA | Glycine max | Predicted polypeptide sequence is orthologous to G519 |
| 874 | | DNA | Glycine max | Predicted polypeptide sequence is orthologous to G519 |
| 875 | | DNA | Glycine max | Predicted polypeptide sequence is orthologous to G519 |
| 876 | | DNA | Glycine max | Predicted polypeptide sequence is orthologous to G519 |
| 877 | | DNA | Oryza sativa | Predicted polypeptide sequence is orthologous to G519 |
| 878 | | DNA | Oryza sativa | Predicted polypeptide sequence is orthologous to G519 |
| 879 | | DNA | Oryza sativa | Predicted polypeptide sequence is orthologous to G519 |
| 880 | | DNA | Zea mays | Predicted polypeptide sequence is orthologous to G519 |
| 881 | | DNA | Zea mays | Predicted polypeptide sequence is orthologous to G519 |
| 882 | | DNA | Zea mays | Predicted polypeptide sequence is orthologous to G519 |
| 883 | | DNA | Zea mays | Predicted polypeptide sequence is orthologous to G519 |
| 884 | | DNA | Zea mays | Predicted polypeptide sequence is orthologous to G519 |
| 885 | | DNA | Zea mays | Predicted polypeptide sequence is orthologous to G519 |
| 886 | | DNA | Zea mays | Predicted polypeptide sequence is orthologous to G519 |
| 887 | | DNA | Zea mays | Predicted polypeptide sequence is orthologous to G519 |
| 888 | | DNA | Zea mays | Predicted polypeptide sequence is orthologous to G519 |
| 889 | | DNA | Zea mays | Predicted polypeptide sequence is orthologous to G519 |
| 890 | | PRT | Oryza sativa | Orthologous to G519 |
| 891 | | PRT | Oryza sativa | Orthologous to G519 |
| 892 | | DNA | Glycine max | Predicted polypeptide sequence is orthologous to G545 |
| 893 | | DNA | Glycine max | Predicted polypeptide sequence is orthologous to G545 |
| 894 | | DNA | Glycine max | Predicted polypeptide sequence is orthologous to G545 |
| 895 | | DNA | Glycine max | Predicted polypeptide sequence is orthologous to G545 |
| 896 | | DNA | Glycine max | Predicted polypeptide sequence is orthologous to G545 |
| 897 | | DNA | Glycine max | Predicted polypeptide sequence is orthologous to G545 |
| 898 | | DNA | Glycine max | Predicted polypeptide sequence is orthologous to G545 |
| 899 | | DNA | Oryza sativa | Predicted polypeptide sequence is orthologous to G545 |
| 900 | | DNA | Zea mays | Predicted polypeptide sequence is orthologous to G545 |
| 901 | | DNA | Zea mays | Predicted polypeptide sequence is orthologous to G545 |
| 902 | | DNA | Zea mays | Predicted polypeptide sequence is orthologous to G545 |
| 903 | | PRT | Oryza sativa | Orthologous to G545 |
| 904 | | PRT | Oryza sativa | Orthologous to G545 |
| 905 | | PRT | Oryza sativa | Orthologous to G545 |
| 906 | | PRT | Oryza sativa | Orthologous to G545 |
| 907 | | PRT | Datisca glomerata | Orthologous to G545 |
| 908 | | DNA | Oryza sativa | Predicted polypeptide sequence is orthologous to G546 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 909 | | DNA | Zea mays | Predicted polypeptide sequence is orthologous to G561 |
| 910 | | PRT | Sinapis alba | Orthologous to G561 |
| 911 | | PRT | Raphanus sativus | Orthologous to G561 |
| 912 | | PRT | Brassica napus | Orthologous to G561 |
| 913 | | PRT | Brassica napus | Orthologous to G561 |
| 914 | | DNA | Glycine max | Predicted polypeptide sequence is orthologous to G562 |
| 915 | | DNA | Glycine max | Predicted polypeptide sequence is orthologous to G562 |
| 916 | | DNA | Glycine max | Predicted polypeptide sequence is orthologous to G562 |
| 917 | | DNA | Glycine max | Predicted polypeptide sequence is orthologous to G562 |
| 918 | | DNA | Glycine max | Predicted polypeptide sequence is orthologous to G562 |
| 919 | | DNA | Zea mays | Predicted polypeptide sequence is orthologous to G562 |
| 920 | | DNA | Zea mays | Predicted polypeptide sequence is orthologous to G562 |
| 921 | | DNA | Zea mays | Predicted polypeptide sequence is orthologous to G562 |
| 922 | | PRT | Oryza sativa | Orthologous to G562 |
| 923 | | PRT | Oryza sativa | Orthologous to G562 |
| 924 | | DNA | Glycine max | Predicted polypeptide sequence is orthologous to G567 |
| 925 | | DNA | Oryza sativa | Predicted polypeptide sequence is orthologous to G567 |
| 926 | | PRT | Oryza sativa | Orthologous to G567 |
| 927 | | DNA | Glycine max | Predicted polypeptide sequence is orthologous to G568 |
| 928 | | DNA | Glycine max | Predicted polypeptide sequence is orthologous to G568 |
| 929 | | DNA | Oryza sativa | Predicted polypeptide sequence is orthologous to G568 |
| 930 | | DNA | Oryza sativa | Predicted polypeptide sequence is orthologous to G568 |
| 931 | | DNA | Oryza sativa | Predicted polypeptide sequence is orthologous to G568 |
| 932 | | DNA | Zea mays | Predicted polypeptide sequence is orthologous to G568 |
| 933 | | PRT | Oryza sativa | Orthologous to G568 |
| 934 | | PRT | Populus balsamifera subsp. trichocarpa x Populus deltoides | Orthologous to G568 |
| 935 | | DNA | Glycine max | Predicted polypeptide sequence is orthologous to G584 |
| 936 | | DNA | Glycine max | Predicted polypeptide sequence is orthologous to G584 |
| 937 | | DNA | Glycine max | Predicted polypeptide sequence is orthologous to G584 |
| 938 | | DNA | Glycine max | Predicted polypeptide sequence is orthologous to G584 |
| 939 | | DNA | Glycine max | Predicted polypeptide sequence is orthologous to G584 |
| 940 | | DNA | Zea mays | Predicted polypeptide sequence is orthologous to G584 |
| 941 | | DNA | Zea mays | Predicted polypeptide sequence is orthologous to G584 |
| 942 | | DNA | Zea mays | Predicted polypeptide sequence is orthologous to G584 |
| 943 | | PRT | Oryza sativa | Orthologous to G584 |
| 944 | | DNA | Glycine max | Predicted polypeptide sequence is orthologous to G585 |
| 945 | | DNA | Glycine max | Predicted polypeptide sequence is orthologous to G585 |
| 946 | | DNA | Glycine max | Predicted polypeptide sequence is orthologous to G585 |
| 947 | | DNA | Glycine max | Predicted polypeptide sequence is orthologous to G585 |
| 948 | | DNA | Oryza sativa | Predicted polypeptide sequence is orthologous to G585 |
| 949 | | DNA | Zea mays | Predicted polypeptide sequence is orthologous to G585 |
| 950 | | DNA | Zea mays | Predicted polypeptide sequence is orthologous to G585 |
| 951 | | DNA | Zea mays | Predicted polypeptide sequence is orthologous to G585 |
| 952 | | DNA | Zea mays | Predicted polypeptide sequence is orthologous to G585 |
| 953 | | PRT | Oryza sativa | Orthologous to G585 |
| 954 | | PRT | Oryza sativa | Orthologous to G585 |
| 955 | | PRT | Oryza sativa | Orthologous to G585 |
| 956 | | PRT | Oryza sativa | Orthologous to G585 |
| 957 | | PRT | Oryza sativa | Orthologous to G585 |
| 958 | | PRT | Oryza sativa | Orthologous to G585 |
| 959 | | PRT | Gossypium hirsutum | Orthologous to G585 |
| 960 | | PRT | Antirrhinum majus | Orthologous to G585 |
| 961 | | DNA | Glycine max | Predicted polypeptide sequence is orthologous to G590 |
| 962 | | DNA | Glycine max | Predicted polypeptide sequence is orthologous to G590 |
| 963 | | DNA | Glycine max | Predicted polypeptide sequence is orthologous to G590 |
| 964 | | DNA | Oryza sativa | Predicted polypeptide sequence is orthologous to G590 |
| 965 | | DNA | Zea mays | Predicted polypeptide sequence is orthologous to G590 |
| 966 | | PRT | Oryza sativa | Orthologous to G590 |
| 967 | | PRT | Oryza sativa | Orthologous to G590 |
| 968 | | DNA | Oryza sativa | Predicted polypeptide sequence is orthologous to G597 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 969 | | DNA | Oryza sativa | Predicted polypeptide sequence is orthologous to G597 |
| 970 | | DNA | Oryza sativa | Predicted polypeptide sequence is orthologous to G597 |
| 971 | | DNA | Zea mays | Predicted polypeptide sequence is orthologous to G597 |
| 972 | | DNA | Zea mays | Predicted polypeptide sequence is orthologous to G597 |
| 973 | | DNA | Zea mays | Predicted polypeptide sequence is orthologous to G597 |
| 974 | | DNA | Zea mays | Predicted polypeptide sequence is orthologous to G597 |
| 975 | | DNA | Zea mays | Predicted polypeptide sequence is orthologous to G597 |
| 976 | | DNA | Zea mays | Predicted polypeptide sequence is orthologous to G597 |
| 977 | | DNA | Zea mays | Predicted polypeptide sequence is orthologous to G597 |
| 978 | | DNA | Zea mays | Predicted polypeptide sequence is orthologous to G597 |
| 979 | | DNA | Zea mays | Predicted polypeptide sequence is orthologous to G597 |
| 980 | | DNA | Zea mays | Predicted polypeptide sequence is orthologous to G597 |
| 981 | | DNA | Oryza sativa | Predicted polypeptide sequence is orthologous to G634 |
| 982 | | DNA | Oryza sativa | Predicted polypeptide sequence is orthologous to G634 |
| 983 | | DNA | Oryza sativa | Predicted polypeptide sequence is orthologous to G634 |
| 984 | | DNA | Zea mays | Predicted polypeptide sequence is orthologous to G634 |
| 985 | | DNA | Zea mays | Predicted polypeptide sequence is orthologous to G634 |
| 986 | | DNA | Zea mays | Predicted polypeptide sequence is orthologous to G634 |
| 987 | | PRT | Oryza sativa | Orthologous to G634 |
| 988 | | PRT | Oryza sativa | Orthologous to G634 |
| 989 | | DNA | Glycine max | Predicted polypeptide sequence is orthologous to G635 |
| 990 | | DNA | Glycine max | Predicted polypeptide sequence is orthologous to G635 |
| 991 | | DNA | Oryza sativa | Predicted polypeptide sequence is orthologous to G635 |
| 992 | | DNA | Oryza sativa | Predicted polypeptide sequence is orthologous to G635 |
| 993 | | DNA | Zea mays | Predicted polypeptide sequence is orthologous to G635 |
| 994 | | PRT | Oryza sativa | Orthologous to G635 |
| 995 | | DNA | Glycine max | Predicted polypeptide sequence is orthologous to G636 |
| 996 | | DNA | Glycine max | Predicted polypeptide sequence is orthologous to G636 |
| 997 | | DNA | Glycine max | Predicted polypeptide sequence is orthologous to G636 |
| 998 | | DNA | Glycine max | Predicted polypeptide sequence is orthologous to G636 |
| 999 | | DNA | Glycine max | Predicted polypeptide sequence is orthologous to G636 |
| 1000 | | DNA | Glycine max | Predicted polypeptide sequence is orthologous to G636 |
| 1001 | | DNA | Glycine max | Predicted polypeptide sequence is orthologous to G636 |
| 1002 | | DNA | Glycine max | Predicted polypeptide sequence is orthologous to G636 |
| 1003 | | DNA | Oryza sativa | Predicted polypeptide sequence is orthologous to G636 |
| 1004 | | DNA | Oryza sativa | Predicted polypeptide sequence is orthologous to G636 |
| 1005 | | DNA | Oryza sativa | Predicted polypeptide sequence is orthologous to G636 |
| 1006 | | DNA | Oryza sativa | Predicted polypeptide sequence is orthologous to G636 |
| 1007 | | DNA | Zea mays | Predicted polypeptide sequence is orthologous to G636 |
| 1008 | | DNA | Zea mays | Predicted polypeptide sequence is orthologous to G636 |
| 1009 | | DNA | Zea mays | Predicted polypeptide sequence is orthologous to G636 |
| 1010 | | DNA | Zea mays | Predicted polypeptide sequence is orthologous to G636 |
| 1011 | | PRT | Pisum sativum | Orthologous to G636 |
| 1012 | | DNA | Glycine max | Predicted polypeptide sequence is orthologous to G638 |
| 1013 | | DNA | Glycine max | Predicted polypeptide sequence is orthologous to G638 |
| 1014 | | DNA | Glycine max | Predicted polypeptide sequence is orthologous to G638 |
| 1015 | | DNA | Glycine max | Predicted polypeptide sequence is orthologous to G638 |
| 1016 | | DNA | Medicago truncatula | Predicted polypeptide sequence is orthologous to G638 |
| 1017 | | DNA | Glycine max | Predicted polypeptide sequence is orthologous to G652 |
| 1018 | | DNA | Glycine max | Predicted polypeptide sequence is orthologous to G652 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1019 | | DNA | Glycine max | Predicted polypeptide sequence is orthologous to G652 |
| 1020 | | DNA | Glycine max | Predicted polypeptide sequence is orthologous to G652 |
| 1021 | | DNA | Glycine max | Predicted polypeptide sequence is orthologous to G652 |
| 1022 | | DNA | Glycine max | Predicted polypeptide sequence is orthologous to G652 |
| 1023 | | DNA | Glycine max | Predicted polypeptide sequence is orthologous to G652 |
| 1024 | | DNA | Glycine max | Predicted polypeptide sequence is orthologous to G652 |
| 1025 | | DNA | Oryza sativa | Predicted polypeptide sequence is orthologous to G652 |
| 1026 | | DNA | Oryza sativa | Predicted polypeptide sequence is orthologous to G652 |
| 1027 | | DNA | Oryza sativa | Predicted polypeptide sequence is orthologous to G652 |
| 1028 | | DNA | Zea mays | Predicted polypeptide sequence is orthologous to G652 |
| 1029 | | DNA | Zea mays | Predicted polypeptide sequence is orthologous to G652 |
| 1030 | | DNA | Zea mays | Predicted polypeptide sequence is orthologous to G652 |
| 1031 | | DNA | Zea mays | Predicted polypeptide sequence is orthologous to G652 |
| 1032 | | DNA | Zea mays | Predicted polypeptide sequence is orthologous to G652 |
| 1033 | | DNA | Zea mays | Predicted polypeptide sequence is orthologous to G652 |
| 1034 | | DNA | Zea mays | Predicted polypeptide sequence is orthologous to G652 |
| 1035 | | PRT | Oryza sativa | Orthologous to G652 |
| 1036 | | PRT | Oryza sativa | Orthologous to G652 |
| 1037 | | PRT | Oryza sativa | Orthologous to G652 |
| 1038 | | PRT | Oryza sativa | Orthologous to G652 |
| 1039 | | PRT | Oryza sativa | Orthologous to G652 |
| 1040 | | PRT | Oryza sativa | Orthologous to G652 |
| 1041 | | PRT | Oryza sativa | Orthologous to G652 |
| 1042 | | PRT | Oryza sativa | Orthologous to G652 |
| 1043 | | DNA | Glycine max | Predicted polypeptide sequence is orthologous to G663 |
| 1044 | | DNA | Glycine max | Predicted polypeptide sequence is orthologous to G664 |
| 1045 | | DNA | Glycine max | Predicted polypeptide sequence is orthologous to G664 |
| 1046 | | DNA | Glycine max | Predicted polypeptide sequence is orthologous to G664 |
| 1047 | | DNA | Glycine max | Predicted polypeptide sequence is orthologous to G664 |
| 1048 | | DNA | Glycine max | Predicted polypeptide sequence is orthologous to G664 |
| 1049 | | DNA | Glycine max | Predicted polypeptide sequence is orthologous to G664 |
| 1050 | | DNA | Glycine max | Predicted polypeptide sequence is orthologous to G664 |
| 1051 | | DNA | Oryza sativa | Predicted polypeptide sequence is orthologous to G664 |
| 1052 | | DNA | Oryza sativa | Predicted polypeptide sequence is orthologous to G664 |
| 1053 | | DNA | Oryza sativa | Predicted polypeptide sequence is orthologous to G664 |
| 1054 | | DNA | Oryza sativa | Predicted polypeptide sequence is orthologous to G664 |
| 1055 | | DNA | Zea mays | Predicted polypeptide sequence is orthologous to G664 |
| 1056 | | DNA | Zea mays | Predicted polypeptide sequence is orthologous to G664 |
| 1057 | | DNA | Zea mays | Predicted polypeptide sequence is orthologous to G664 |
| 1058 | | DNA | Zea mays | Predicted polypeptide sequence is orthologous to G664 |
| 1059 | | DNA | Zea mays | Predicted polypeptide sequence is orthologous to G664 |
| 1060 | | DNA | Zea mays | Predicted polypeptide sequence is orthologous to G664 |
| 1061 | | DNA | Zea mays | Predicted polypeptide sequence is orthologous to G664 |
| 1062 | | DNA | Zea mays | Predicted polypeptide sequence is orthologous to G664 |
| 1063 | G3509 | DNA | Lycopersicon esculentum | Predicted polypeptide sequence is orthologous to G664 |
| 1064 | G3506 | PRT | Oryza sativa | Orthologous to G664 |
| 1065 | G3504 | PRT | Oryza sativa | Orthologous to G664 |
| 1066 | | PRT | Oryza sativa | Orthologous to G664 |
| 1067 | | PRT | Oryza sativa | Orthologous to G664 |
| 1068 | G3503 | PRT | Oryza sativa indica | Orthologous to G664 |
| 1069 | G3505 | PRT | Oryza sativa japonica | Orthologous to G664 |
| 1070 | G3507 | PRT | Oryza sativa japonica | Orthologous to G664 |
| 1071 | G3508 | PRT | Oryza sativa japonica | Orthologous to G664 |
| 1072 | G3509 | PRT | Lycopersicon esculentum | Orthologous to G664 |
| 1073 | | PRT | Hordeum vulgare subsp. vulgare | Orthologous to G664 |
| 1074 | | DNA | Oryza sativa | Predicted polypeptide sequence is orthologous to G680 |
| 1075 | | DNA | Zea mays | Predicted polypeptide sequence is orthologous to G680 |
| 1076 | | DNA | Glycine max | Predicted polypeptide sequence is orthologous to G682 |
| 1077 | | DNA | Hordeum vulgare subsp. vulgare | Predicted polypeptide sequence is orthologous to G682 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1078 | | DNA | Populus tremula x Populus tremuloides | Predicted polypeptide sequence is orthologous to G682 |
| 1079 | | DNA | Triticum aestivum | Predicted polypeptide sequence is orthologous to G682 |
| 1080 | | DNA | Gossypium arboreum | Predicted polypeptide sequence is orthologous to G682 |
| 1081 | | PRT | Oryza sativa | Orthologous to G682 |
| 1082 | | PRT | Oryza sativa | Orthologous to G682 |
| 1083 | | PRT | Glycine max | Orthologous to G682 |
| 1084 | | PRT | Glycine max | Orthologous to G682 |
| 1085 | | PRT | Glycine max | Orthologous to G682 |
| 1086 | | PRT | Glycine max | Orthologous to G682 |
| 1087 | | PRT | Glycine max | Orthologous to G682 |
| 1088 | | PRT | Glycine max | Orthologous to G682 |
| 1089 | | PRT | Zea mays | Orthologous to G682 |
| 1090 | | PRT | Zea mays | Orthologous to G682 |
| 1091 | | DNA | Glycine max | Predicted polypeptide sequence is orthologous to G715, G1646 |
| 1092 | | DNA | Glycine max | Predicted polypeptide sequence is orthologous to G715, G1646 |
| 1093 | | DNA | Glycine max | Predicted polypeptide sequence is orthologous to G715, G1646 |
| 1094 | | DNA | Oryza sativa | Predicted polypeptide sequence is orthologous to G715, G1646 |
| 1095 | | DNA | Oryza sativa | Predicted polypeptide sequence is orthologous to G715, G1646 |
| 1096 | | DNA | Zea mays | Predicted polypeptide sequence is orthologous to G715, G1646 |
| 1097 | | DNA | Zea mays | Predicted polypeptide sequence is orthologous to G715, G1646 |
| 1098 | | DNA | Zea mays | Predicted polypeptide sequence is orthologous to G715, G1646 |
| 1099 | | DNA | Zea mays | Predicted polypeptide sequence is orthologous to G715, G1646 |
| 1100 | | DNA | Zea mays | Predicted polypeptide sequence is orthologous to G715, G1646 |
| 1101 | | DNA | Zea mays | Predicted polypeptide sequence is orthologous to G715, G1646 |
| 1102 | | DNA | Zea mays | Predicted polypeptide sequence is orthologous to G715, G1646 |
| 1103 | | DNA | Zea mays | Predicted polypeptide sequence is orthologous to G715, G1646 |
| 1104 | | DNA | Zea mays | Predicted polypeptide sequence is orthologous to G715, G1646 |
| 1105 | | PRT | Oryza sativa | Orthologous to G715, G1646 |
| 1106 | | PRT | Oryza sativa | Orthologous to G715, G1646 |
| 1107 | | PRT | Oryza sativa | Orthologous to G715, G1646 |
| 1108 | | PRT | Oryza sativa | Orthologous to G715, G1646 |
| 1109 | | PRT | Oryza sativa | Orthologous to G715, G1646 |
| 1110 | | PRT | Oryza sativa | Orthologous to G715, G1646 |
| 1111 | | DNA | Glycine max | Predicted polypeptide sequence is orthologous to G720 |
| 1112 | | DNA | Glycine max | Predicted polypeptide sequence is orthologous to G720 |
| 1113 | | DNA | Glycine max | Predicted polypeptide sequence is orthologous to G720 |
| 1114 | | DNA | Glycine max | Predicted polypeptide sequence is orthologous to G720 |
| 1115 | | DNA | Medicago truncatula | Predicted polypeptide sequence is orthologous to G720 |
| 1116 | | DNA | Lycopersicon esculentum | Predicted polypeptide sequence is orthologous to G720 |
| 1117 | | DNA | Lycopersicon esculentum | Predicted polypeptide sequence is orthologous to G720 |
| 1118 | | DNA | Lycopersicon esculentum | Predicted polypeptide sequence is orthologous to G720 |
| 1119 | | DNA | Solanum tuberosum | Predicted polypeptide sequence is orthologous to G720 |
| 1120 | | DNA | Glycine max | Predicted polypeptide sequence is orthologous to G736 |
| 1121 | | DNA | Glycine max | Predicted polypeptide sequence is orthologous to G736 |
| 1122 | | PRT | Oryza sativa | Orthologous to G736 |
| 1123 | | DNA | Glycine max | Predicted polypeptide sequence is orthologous to G748 |
| 1124 | | DNA | Glycine max | Predicted polypeptide sequence is orthologous to G748 |
| 1125 | | DNA | Glycine max | Predicted polypeptide sequence is orthologous to G748 |
| 1126 | | DNA | Oryza sativa | Predicted polypeptide sequence is orthologous to G748 |
| 1127 | | DNA | Oryza sativa | Predicted polypeptide sequence is orthologous to G748 |
| 1128 | | DNA | Zea mays | Predicted polypeptide sequence is orthologous to G748 |
| 1129 | | PRT | Oryza sativa | Orthologous to G748 |
| 1130 | | PRT | Oryza sativa | Orthologous to G748 |
| 1131 | | PRT | Oryza sativa | Orthologous to G748 |
| 1132 | | PRT | Oryza sativa | Orthologous to G748 |

TABLE 10-continued
Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1133 | | PRT | Cucurbita maxima | Orthologous to G748 |
| 1134 | | DNA | Glycine max | Predicted polypeptide sequence is orthologous to G789, G1494 |
| 1135 | | DNA | Glycine max | Predicted polypeptide sequence is orthologous to G789, G1494 |
| 1136 | | DNA | Oryza sativa | Predicted polypeptide sequence is orthologous to G789 |
| 1137 | | DNA | Oryza sativa | Predicted polypeptide sequence is orthologous to G789, G1494 |
| 1138 | | DNA | Zea mays | Predicted polypeptide sequence is orthologous to G789, G1494 |
| 1139 | | PRT | Oryza sativa | Orthologous to G789, G1494 |
| 1140 | | PRT | Oryza sativa | Orthologous to G789, G1494 |
| 1141 | | PRT | Oryza sativa | Orthologous to G789, G1494 |
| 1142 | | DNA | Glycine max | Predicted polypeptide sequence is orthologous to G801 |
| 1143 | | DNA | Glycine max | Predicted polypeptide sequence is orthologous to G801 |
| 1144 | | DNA | Zea mays | Predicted polypeptide sequence is orthologous to G801 |
| 1145 | | DNA | Glycine max | Predicted polypeptide sequence is orthologous to G849 |
| 1146 | | DNA | Glycine max | Predicted polypeptide sequence is orthologous to G849 |
| 1147 | | DNA | Glycine max | Predicted polypeptide sequence is orthologous to G849 |
| 1148 | | DNA | Glycine max | Predicted polypeptide sequence is orthologous to G849 |
| 1149 | | DNA | Glycine max | Predicted polypeptide sequence is orthologous to G849 |
| 1150 | | DNA | Glycine max | Predicted polypeptide sequence is orthologous to G849 |
| 1151 | | DNA | Zea mays | Predicted polypeptide sequence is orthologous to G849 |
| 1152 | | DNA | Zea mays | Predicted polypeptide sequence is orthologous to G849 |
| 1153 | | DNA | Zea mays | Predicted polypeptide sequence is orthologous to G849 |
| 1154 | | DNA | Glycine max | Predicted polypeptide sequence is orthologous to G864 |
| 1155 | | DNA | Glycine max | Predicted polypeptide sequence is orthologous to G864 |
| 1156 | | DNA | Zea mays | Predicted polypeptide sequence is orthologous to G864 |
| 1157 | | PRT | Oryza sativa | Orthologous to G864 |
| 1158 | | PRT | Oryza sativa | Orthologous to G864 |
| 1159 | | DNA | Glycine max | Predicted polypeptide sequence is orthologous to G867, G1930 |
| 1160 | | DNA | Glycine max | Predicted polypeptide sequence is orthologous to G867, G1930 |
| 1161 | | DNA | Glycine max | Predicted polypeptide sequence is orthologous to G867, G1930 |
| 1162 | | DNA | Glycine max | Predicted polypeptide sequence is orthologous to G867, G1930 |
| 1163 | | DNA | Glycine max | Predicted polypeptide sequence is orthologous to G867, G1930 |
| 1164 | | DNA | Glycine max | Predicted polypeptide sequence is orthologous to G867 |
| 1165 | | DNA | Oryza sativa | Predicted polypeptide sequence is orthologous to G867 |
| 1166 | | DNA | Oryza sativa | Predicted polypeptide sequence is orthologous to G867, G1930 |
| 1167 | | DNA | Zea mays | Predicted polypeptide sequence is orthologous to G867, G1930 |
| 1168 | | DNA | Zea mays | Predicted polypeptide sequence is orthologous to G867, G1930 |
| 1169 | | DNA | Zea mays | Predicted polypeptide sequence is orthologous to G867, G1930 |
| 1170 | | DNA | Zea mays | Predicted polypeptide sequence is orthologous to G867, G1930 |
| 1171 | | DNA | Glycine max | Predicted polypeptide sequence is orthologous to G867, G1930 |
| 1172 | | DNA | Mesembryanthemum crystallinum | Predicted polypeptide sequence is orthologous to G867, G1930 |
| 1173 | | DNA | Lycopersicon esculentum | Predicted polypeptide sequence is orthologous to G867, G1930 |
| 1174 | | DNA | Solanum tuberosum | Predicted polypeptide sequence is orthologous to G867, G1930 |
| 1175 | | DNA | Hordeum vulgare | Predicted polypeptide sequence is orthologous to G867, G1930 |
| 1176 | | PRT | Oryza sativa | Orthologous to G867, G1930 |
| 1177 | | PRT | Oryza sativa | Orthologous to G867, G1930 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1178 | | PRT | Oryza sativa | Orthologous to G867, G1930 |
| 1179 | | PRT | Oryza sativa | Orthologous to G867, G1930 |
| 1180 | | PRT | Oryza sativa | Orthologous to G867, G1930 |
| 1181 | | PRT | Oryza sativa | Orthologous to G867, G1930 |
| 1182 | | PRT | Glycine max | Orthologous to G867, G1930 |
| 1183 | | PRT | Glycine max | Orthologous to G867, G1930 |
| 1184 | | PRT | Glycine max | Orthologous to G867, G1930 |
| 1185 | | PRT | Zea mays | Orthologous to G867, G1930 |
| 1186 | | PRT | Zea mays | Orthologous to G867, G1930 |
| 1187 | | DNA | Glycine max | Predicted polypeptide sequence is orthologous to G869 |
| 1188 | | DNA | Glycine max | Predicted polypeptide sequence is orthologous to G869 |
| 1189 | | DNA | Oryza sativa | Predicted polypeptide sequence is orthologous to G869 |
| 1190 | | DNA | Zea mays | Predicted polypeptide sequence is orthologous to G869 |
| 1191 | | PRT | Oryza sativa | Orthologous to G869 |
| 1192 | | DNA | Oryza sativa | Predicted polypeptide sequence is orthologous to G877 |
| 1193 | | DNA | Glycine max | Predicted polypeptide sequence is orthologous to G881 |
| 1194 | | DNA | Oryza sativa | Predicted polypeptide sequence is orthologous to G881 |
| 1195 | | DNA | Oryza sativa | Predicted polypeptide sequence is orthologous to G881 |
| 1196 | | DNA | Zea mays | Predicted polypeptide sequence is orthologous to G881 |
| 1197 | | DNA | Zea mays | Predicted polypeptide sequence is orthologous to G881 |
| 1198 | | DNA | Zea mays | Predicted polypeptide sequence is orthologous to G881 |
| 1199 | | DNA | Zea mays | Predicted polypeptide sequence is orthologous to G881 |
| 1200 | | PRT | Oryza sativa | Orthologous to G881 |
| 1201 | | PRT | Oryza sativa | Orthologous to G892 |
| 1202 | | DNA | Mentha x piperita | Predicted polypeptide sequence is orthologous to G896 |
| 1203 | | DNA | Glycine max | Predicted polypeptide sequence is orthologous to G910 |
| 1204 | | DNA | Glycine max | Predicted polypeptide sequence is orthologous to G912 |
| 1205 | | DNA | Glycine max | Predicted polypeptide sequence is orthologous to G912 |
| 1206 | | DNA | Glycine max | Predicted polypeptide sequence is orthologous to G912 |
| 1207 | | DNA | Glycine max | Predicted polypeptide sequence is orthologous to G912 |
| 1208 | | DNA | Glycine max | Predicted polypeptide sequence is orthologous to G912 |
| 1209 | | DNA | Glycine max | Predicted polypeptide sequence is orthologous to G912 |
| 1210 | | DNA | Glycine max | Predicted polypeptide sequence is orthologous to G912 |
| 1211 | | DNA | Oryza sativa | Predicted polypeptide sequence is orthologous to G912 |
| 1212 | | DNA | Oryza sativa | Predicted polypeptide sequence is orthologous to G912, G913 |
| 1213 | | DNA | Zea mays | Predicted polypeptide sequence is orthologous to G912 |
| 1214 | | DNA | Zea mays | Predicted polypeptide sequence is orthologous to G912 |
| 1215 | | DNA | Zea mays | Predicted polypeptide sequence is orthologous to G912, G913 |
| 1216 | | DNA | Zea mays | Predicted polypeptide sequence is orthologous to G912 |
| 1217 | | DNA | Zea mays | Predicted polypeptide sequence is orthologous to G912 |
| 1218 | | DNA | Brassica napus | Predicted polypeptide sequence is orthologous to G912, G913 |
| 1219 | | DNA | Solanum tuberosum | Predicted polypeptide sequence is orthologous to G912 |
| 1220 | | DNA | Descurainia sophia | Predicted polypeptide sequence is orthologous to G912 |
| 1221 | | PRT | Oryza sativa | Orthologous to G912 |
| 1222 | | PRT | Oryza sativa | Orthologous to G912, G913 |
| 1223 | | PRT | Oryza sativa | Orthologous to G912, G913 |
| 1224 | | PRT | Oryza sativa | Orthologous to G912 |
| 1225 | | PRT | Brassica napus | Orthologous to G912 |
| 1226 | | PRT | Nicotiana tabacum | Orthologous to G912 |
| 1227 | | PRT | Oryza sativa | Orthologous to G912 |
| 1228 | | PRT | Oryza sativa | Orthologous to G912 |
| 1229 | | PRT | Oryza sativa | Orthologous to G912 |
| 1230 | | PRT | Oryza sativa | Orthologous to G912 |
| 1231 | | PRT | Oryza sativa | Orthologous to G912 |
| 1232 | | PRT | Oryza sativa | Orthologous to G912 |
| 1233 | | PRT | Oryza sativa | Orthologous to G912 |
| 1234 | | PRT | Oryza sativa | Orthologous to G912 |
| 1235 | | PRT | Oryza sativa | Orthologous to G912 |
| 1236 | | PRT | Oryza sativa | Orthologous to G912 |
| 1237 | | PRT | Glycine max | Orthologous to G912 |
| 1238 | | PRT | Glycine max | Orthologous to G912 |
| 1239 | | PRT | Glycine max | Orthologous to G912 |
| 1240 | | PRT | Glycine max | Orthologous to G912 |
| 1241 | | PRT | Glycine max | Orthologous to G912 |
| 1242 | | PRT | Glycine max | Orthologous to G912 |
| 1243 | | PRT | Glycine max | Orthologous to G912 |
| 1244 | | PRT | Zea mays | Orthologous to G912 |
| 1245 | | PRT | Zea mays | Orthologous to G912 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1246 | | PRT | Zea mays | Orthologous to G912 |
| 1247 | | PRT | Zea mays | Orthologous to G912 |
| 1248 | | PRT | Zea mays | Orthologous to G912 |
| 1249 | | DNA | Glycine max | Predicted polypeptide sequence is orthologous to G922 |
| 1250 | | DNA | Glycine max | Predicted polypeptide sequence is orthologous to G922 |
| 1251 | | DNA | Glycine max | Predicted polypeptide sequence is orthologous to G922 |
| 1252 | | DNA | Oryza sativa | Predicted polypeptide sequence is orthologous to G922 |
| 1253 | | DNA | Oryza sativa | Predicted polypeptide sequence is orthologous to G922 |
| 1254 | | PRT | Oryza sativa | Orthologous to G922 |
| 1255 | | PRT | Oryza sativa | Orthologous to G922 |
| 1256 | | PRT | Oryza sativa | Orthologous to G922 |
| 1257 | | PRT | Oryza sativa | Orthologous to G922 |
| 1258 | | DNA | Glycine max | Predicted polypeptide sequence is orthologous to G926 |
| 1259 | | DNA | Glycine max | Predicted polypeptide sequence is orthologous to G926 |
| 1260 | | DNA | Oryza sativa | Predicted polypeptide sequence is orthologous to G926 |
| 1261 | | DNA | Oryza sativa | Predicted polypeptide sequence is orthologous to G926 |
| 1262 | | DNA | Zea mays | Predicted polypeptide sequence is orthologous to G926 |
| 1263 | | PRT | Brassica napus | Orthologous to G926 |
| 1264 | | DNA | Glycine max | Predicted polypeptide sequence is orthologous to G961 |
| 1265 | | DNA | Glycine max | Predicted polypeptide sequence is orthologous to G961 |
| 1266 | | DNA | Oryza sativa | Predicted polypeptide sequence is orthologous to G961 |
| 1267 | | DNA | Zea mays | Predicted polypeptide sequence is orthologous to G961 |
| 1268 | | DNA | Zea mays | Predicted polypeptide sequence is orthologous to G961 |
| 1269 | | DNA | Zea mays | Predicted polypeptide sequence is orthologous to G961 |
| 1270 | | PRT | Oryza sativa | Orthologous to G961 |
| 1271 | | DNA | Glycine max | Predicted polypeptide sequence is orthologous to G974 |
| 1272 | | DNA | Glycine max | Predicted polypeptide sequence is orthologous to G974 |
| 1273 | | DNA | Glycine max | Predicted polypeptide sequence is orthologous to G974 |
| 1274 | | DNA | Glycine max | Predicted polypeptide sequence is orthologous to G974 |
| 1275 | | DNA | Glycine max | Predicted polypeptide sequence is orthologous to G974 |
| 1276 | | DNA | Glycine max | Predicted polypeptide sequence is orthologous to G974 |
| 1277 | | DNA | Oryza sativa | Predicted polypeptide sequence is orthologous to G974 |
| 1278 | | DNA | Zea mays | Predicted polypeptide sequence is orthologous to G974 |
| 1279 | | DNA | Zea mays | Predicted polypeptide sequence is orthologous to G974 |
| 1280 | | DNA | Zea mays | Predicted polypeptide sequence is orthologous to G974 |
| 1281 | | DNA | Zea mays | Predicted polypeptide sequence is orthologous to G974 |
| 1282 | | DNA | Lycopersicon esculentum | Predicted polypeptide sequence is orthologous to G974 |
| 1283 | | DNA | Glycine max | Predicted polypeptide sequence is orthologous to G974 |
| 1284 | | DNA | Solanum tuberosum | Predicted polypeptide sequence is orthologous to G974 |
| 1285 | | DNA | Poplar xylem | Predicted polypeptide sequence is orthologous to G974 |
| 1286 | | DNA | Medicago truncatula | Predicted polypeptide sequence is orthologous to G974 |
| 1287 | | DNA | Sorghum bicolor | Predicted polypeptide sequence is orthologous to G974 |
| 1288 | | PRT | Oryza sativa | Orthologous to G974 |
| 1289 | | PRT | Oryza sativa | Orthologous to G974 |
| 1290 | | PRT | Oryza sativa | Orthologous to G974 |
| 1291 | | PRT | Atriplex hortensis | Orthologous to G974 |
| 1292 | | DNA | Glycine max | Predicted polypeptide sequence is orthologous to G975, G2583 |
| 1293 | | DNA | Glycine max | Predicted polypeptide sequence is orthologous to G975, G2583 |
| 1294 | | DNA | Glycine max | Predicted polypeptide sequence is orthologous to G975, G2583 |
| 1295 | | DNA | Glycine max | Predicted polypeptide sequence is orthologous to G975, G2583 |
| 1296 | | DNA | Glycine max | Predicted polypeptide sequence is orthologous to G975, G2583 |
| 1297 | | DNA | Oryza sativa | Predicted polypeptide sequence is orthologous to G975 |
| 1298 | | DNA | Oryza sativa | Predicted polypeptide sequence is orthologous to G975, G2583 |
| 1299 | | DNA | Zea mays | Predicted polypeptide sequence is orthologous to G975, G2583 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1300 | | DNA | Zea mays | Predicted polypeptide sequence is orthologous to G975, G2583 |
| 1301 | | DNA | Brassica rapa | Predicted polypeptide sequence is orthologous to G975, G2583 |
| 1302 | | PRT | Oryza sativa | Orthologous to G975, G2583 |
| 1303 | | DNA | Glycine max | Predicted polypeptide sequence is orthologous to G979 |
| 1304 | | DNA | Glycine max | Predicted polypeptide sequence is orthologous to G979 |
| 1305 | | DNA | Glycine max | Predicted polypeptide sequence is orthologous to G979 |
| 1306 | | DNA | Oryza sativa | Predicted polypeptide sequence is orthologous to G979 |
| 1307 | | DNA | Zea mays | Predicted polypeptide sequence is orthologous to G979 |
| 1308 | | DNA | Zea mays | Predicted polypeptide sequence is orthologous to G979 |
| 1309 | | DNA | Zea mays | Predicted polypeptide sequence is orthologous to G979 |
| 1310 | | PRT | Oryza sativa | Orthologous to G979 |
| 1311 | | PRT | Oryza sativa | Orthologous to G979 |
| 1312 | | PRT | Oryza sativa | Orthologous to G979 |
| 1313 | | PRT | Oryza sativa | Orthologous to G979 |
| 1314 | | PRT | Oryza sativa | Orthologous to G979 |
| 1315 | | DNA | Glycine max | Predicted polypeptide sequence is orthologous to G987 |
| 1316 | | DNA | Glycine max | Predicted polypeptide sequence is orthologous to G987 |
| 1317 | | DNA | Glycine max | Predicted polypeptide sequence is orthologous to G987 |
| 1318 | | DNA | Glycine max | Predicted polypeptide sequence is orthologous to G987 |
| 1319 | | DNA | Glycine max | Predicted polypeptide sequence is orthologous to G987 |
| 1320 | | DNA | Glycine max | Predicted polypeptide sequence is orthologous to G987 |
| 1321 | | DNA | Oryza sativa | Predicted polypeptide sequence is orthologous to G987 |
| 1322 | | DNA | Oryza sativa | Predicted polypeptide sequence is orthologous to G987 |
| 1323 | | DNA | Zea mays | Predicted polypeptide sequence is orthologous to G987 |
| 1324 | | PRT | Oryza sativa | Orthologous to G987 |
| 1325 | | PRT | Oryza sativa | Orthologous to G988 |
| 1326 | | PRT | Oryza sativa | Orthologous to G988 |
| 1327 | | PRT | Capsella rubella | Orthologous to G988 |
| 1328 | | DNA | Glycine max | Predicted polypeptide sequence is orthologous to G1040 |
| 1329 | | DNA | Glycine max | Predicted polypeptide sequence is orthologous to G1040 |
| 1330 | | DNA | Glycine max | Predicted polypeptide sequence is orthologous to G1040 |
| 1331 | | DNA | Glycine max | Predicted polypeptide sequence is orthologous to G1040 |
| 1332 | | DNA | Glycine max | Predicted polypeptide sequence is orthologous to G1040 |
| 1333 | | DNA | Zea mays | Predicted polypeptide sequence is orthologous to G1040 |
| 1334 | | DNA | Zea mays | Predicted polypeptide sequence is orthologous to G1040 |
| 1335 | | DNA | Zea mays | Predicted polypeptide sequence is orthologous to G1040 |
| 1336 | | DNA | Zea mays | Predicted polypeptide sequence is orthologous to G1040 |
| 1337 | | DNA | Zea mays | Predicted polypeptide sequence is orthologous to G1040 |
| 1338 | | PRT | Oryza sativa | Orthologous to G1040 |
| 1339 | | PRT | Oryza sativa | Orthologous to G1040 |
| 1340 | | DNA | Glycine max | Predicted polypeptide sequence is orthologous to G1047 |
| 1341 | | DNA | Zea mays | Predicted polypeptide sequence is orthologous to G1047 |
| 1342 | | PRT | Oryza sativa | Orthologous to G1047 |
| 1343 | | PRT | Oryza sativa | Orthologous to G1047 |
| 1344 | | DNA | Glycine max | Predicted polypeptide sequence is orthologous to G1051, G1052 |
| 1345 | | DNA | Glycine max | Predicted polypeptide sequence is orthologous to G1051, G1052 |
| 1346 | | DNA | Glycine max | Predicted polypeptide sequence is orthologous to G1051, G1052 |
| 1347 | | DNA | Glycine max | Predicted polypeptide sequence is orthologous to G1051, G1052 |
| 1348 | | DNA | Glycine max | Predicted polypeptide sequence is orthologous to G1051, G1052 |
| 1349 | | DNA | Glycine max | Predicted polypeptide sequence is orthologous to G1051, G1052 |
| 1350 | | DNA | Glycine max | Predicted polypeptide sequence is orthologous to G1051, G1052 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1351 | | DNA | Oryza sativa | Predicted polypeptide sequence is orthologous to G1051, G1052 |
| 1352 | | DNA | Zea mays | Predicted polypeptide sequence is orthologous to G1051, G1052 |
| 1353 | | DNA | Zea mays | Predicted polypeptide sequence is orthologous to G1051, G1052 |
| 1354 | | DNA | Zea mays | Predicted polypeptide sequence is orthologous to G1051, G1052 |
| 1355 | | DNA | Zea mays | Predicted polypeptide sequence is orthologous to G1051, G1052 |
| 1356 | | DNA | Zea mays | Predicted polypeptide sequence is orthologous to G1051, G1052 |
| 1357 | | DNA | Zea mays | Predicted polypeptide sequence is orthologous to G1051, G1052 |
| 1358 | | DNA | Zea mays | Predicted polypeptide sequence is orthologous to G1051, G1052 |
| 1359 | | DNA | Oryza sativa | Predicted polypeptide sequence is orthologous to G1052 |
| 1360 | | DNA | Zea mays | Predicted polypeptide sequence is orthologous to G1052 |
| 1361 | | DNA | Zea mays | Predicted polypeptide sequence is orthologous to G1052 |
| 1362 | | PRT | Oryza sativa | Orthologous to G1051, G1052 |
| 1363 | | PRT | Oryza sativa | Orthologous to G1051, G1052 |
| 1364 | | PRT | Oryza sativa | Orthologous to G1051, G1052 |
| 1365 | | DNA | Glycine max | Predicted polypeptide sequence is orthologous to G1062 |
| 1366 | | DNA | Glycine max | Predicted polypeptide sequence is orthologous to G1062 |
| 1367 | | DNA | Glycine max | Predicted polypeptide sequence is orthologous to G1062 |
| 1368 | | DNA | Glycine max | Predicted polypeptide sequence is orthologous to G1062 |
| 1369 | | DNA | Oryza sativa | Predicted polypeptide sequence is orthologous to G1062 |
| 1370 | | DNA | Oryza sativa | Predicted polypeptide sequence is orthologous to G1062 |
| 1371 | | DNA | Zea mays | Predicted polypeptide sequence is orthologous to G1062 |
| 1372 | | DNA | Zea mays | Predicted polypeptide sequence is orthologous to G1062 |
| 1373 | | DNA | Zea mays | Predicted polypeptide sequence is orthologous to G1062 |
| 1374 | | DNA | Zea mays | Predicted polypeptide sequence is orthologous to G1062 |
| 1375 | | DNA | Zea mays | Predicted polypeptide sequence is orthologous to G1062 |
| 1376 | | DNA | Medicago truncatula | Predicted polypeptide sequence is orthologous to G1062 |
| 1377 | | DNA | Lycopersicon esculentum | Predicted polypeptide sequence is orthologous to G1062 |
| 1378 | | PRT | Oryza sativa | Orthologous to G1062 |
| 1379 | | DNA | Glycine max | Predicted polypeptide sequence is orthologous to G1063, G2143 |
| 1380 | | DNA | Glycine max | Predicted polypeptide sequence is orthologous to G1063, G2143 |
| 1381 | | DNA | Glycine max | Predicted polypeptide sequence is orthologous to G1063, G2143 |
| 1382 | | DNA | Glycine max | Predicted polypeptide sequence is orthologous to G1063, G2143 |
| 1383 | | DNA | Glycine max | Predicted polypeptide sequence is orthologous to G1063, G2143 |
| 1384 | | DNA | Lycopersicon esculentum | Predicted polypeptide sequence is orthologous to G1063, G2143 |
| 1385 | | DNA | Glycine max | Predicted polypeptide sequence is orthologous to G1064 |
| 1386 | | DNA | Glycine max | Predicted polypeptide sequence is orthologous to G1064 |
| 1387 | | DNA | Glycine max | Predicted polypeptide sequence is orthologous to G1064 |
| 1388 | | DNA | Zea mays | Predicted polypeptide sequence is orthologous to G1064 |
| 1389 | | DNA | Zea mays | Predicted polypeptide sequence is orthologous to G1064 |
| 1390 | | DNA | Lycopersicon esculentum | Predicted polypeptide sequence is orthologous to G1064 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1391 | | PRT | *Oryza sativa* | Orthologous to G1064 |
| 1392 | | PRT | *Gossypium hirsutum* | Orthologous to G1064 |
| 1393 | | DNA | *Glycine max* | Predicted polypeptide sequence is orthologous to G1069 |
| 1394 | | DNA | *Glycine max* | Predicted polypeptide sequence is orthologous to G1069 |
| 1395 | | PRT | *Oryza sativa* | Orthologous to G1069, G1073 |
| 1396 | | DNA | *Zea mays* | Predicted polypeptide sequence is orthologous to G1069 |
| 1397 | | DNA | *Lotus japonicus* | Predicted polypeptide sequence is orthologous to G1069 |
| 1398 | | DNA | *Lycopersicon esculentum* | Predicted polypeptide sequence is orthologous to G1073 |
| 1399 | | PRT | *Oryza sativa* | Orthologous to G1073 |
| 1400 | | PRT | *Oryza sativa* | Orthologous to G1073 |
| 1401 | | PRT | *Oryza sativa* | Orthologous to G1073 |
| 1402 | | PRT | *Oryza sativa* | Orthologous to G1073 |
| 1403 | | PRT | *Oryza sativa* | Orthologous to G1073 |
| 1404 | | PRT | *Oryza sativa* | Orthologous to G1073 |
| 1405 | | PRT | *Oryza sativa* | Orthologous to G1073 |
| 1406 | | PRT | *Oryza sativa* | Orthologous to G1073 |
| 1407 | | PRT | *Oryza sativa* | Orthologous to G1073 |
| 1408 | | PRT | *Oryza sativa* | Orthologous to G1073 |
| 1409 | | PRT | *Oryza sativa* | Orthologous to G1073 |
| 1410 | | PRT | *Oryza sativa* | Orthologous to G1073 |
| 1411 | | PRT | *Glycine max* | Orthologous to G1073 |
| 1412 | | PRT | *Glycine max* | Orthologous to G1073 |
| 1413 | | PRT | *Glycine max* | Orthologous to G1073 |
| 1414 | | PRT | *Glycine max* | Orthologous to G1073 |
| 1415 | | PRT | *Glycine max* | Orthologous to G1073 |
| 1416 | | PRT | *Glycine max* | Orthologous to G1073 |
| 1417 | | PRT | *Glycine max* | Orthologous to G1073 |
| 1418 | | PRT | *Zea mays* | Orthologous to G1073 |
| 1419 | | DNA | *Glycine max* | Predicted polypeptide sequence is orthologous to G1075 |
| 1420 | | DNA | *Glycine max* | Predicted polypeptide sequence is orthologous to G1075 |
| 1421 | | DNA | *Glycine max* | Predicted polypeptide sequence is orthologous to G1075 |
| 1422 | | DNA | *Glycine max* | Predicted polypeptide sequence is orthologous to G1075 |
| 1423 | | DNA | *Glycine max* | Predicted polypeptide sequence is orthologous to G1075 |
| 1424 | | DNA | *Oryza sativa* | Predicted polypeptide sequence is orthologous to G1075 |
| 1425 | | DNA | *Oryza sativa* | Predicted polypeptide sequence is orthologous to G1075 |
| 1426 | | DNA | *Oryza sativa* | Predicted polypeptide sequence is orthologous to G1075 |
| 1427 | | DNA | *Oryza sativa* | Predicted polypeptide sequence is orthologous to G1075 |
| 1428 | | DNA | *Zea mays* | Predicted polypeptide sequence is orthologous to G1089 |
| 1429 | | DNA | *Zea mays* | Predicted polypeptide sequence is orthologous to G1089 |
| 1430 | | DNA | *Zea mays* | Predicted polypeptide sequence is orthologous to G1089 |
| 1431 | | DNA | *Zea mays* | Predicted polypeptide sequence is orthologous to G1089 |
| 1432 | | DNA | *Zea mays* | Predicted polypeptide sequence is orthologous to G1089 |
| 1433 | | PRT | *Oryza sativa* | Orthologous to G1089 |
| 1434 | | DNA | *Glycine max* | Predicted polypeptide sequence is orthologous to G1134, G2555 |
| 1435 | | DNA | *Glycine max* | Predicted polypeptide sequence is orthologous to G1134, G2555 |
| 1436 | | DNA | *Oryza sativa* | Predicted polypeptide sequence is orthologous to G1134, G2555 |
| 1437 | | DNA | *Glycine max* | Predicted polypeptide sequence is orthologous to G1140 |
| 1438 | | DNA | *Glycine max* | Predicted polypeptide sequence is orthologous to G1140 |
| 1439 | | DNA | *Glycine max* | Predicted polypeptide sequence is orthologous to G1140 |
| 1440 | | DNA | *Glycine max* | Predicted polypeptide sequence is orthologous to G1140 |
| 1441 | | DNA | *Glycine max* | Predicted polypeptide sequence is orthologous to G1140 |
| 1442 | | DNA | *Glycine max* | Predicted polypeptide sequence is orthologous to G1140 |
| 1443 | | DNA | *Oryza sativa* | Predicted polypeptide sequence is orthologous to G1140 |
| 1444 | | DNA | *Zea mays* | Predicted polypeptide sequence is orthologous to G1140 |
| 1445 | | DNA | *Zea mays* | Predicted polypeptide sequence is orthologous to G1140 |
| 1446 | | DNA | *Zea mays* | Predicted polypeptide sequence is orthologous to G1140 |
| 1447 | | DNA | *Zea mays* | Predicted polypeptide sequence is orthologous to G1140 |
| 1448 | | DNA | *Zea mays* | Predicted polypeptide sequence is orthologous to G1140 |
| 1449 | | DNA | *Zea mays* | Predicted polypeptide sequence is orthologous to G1140 |
| 1450 | | DNA | *Zea mays* | Predicted polypeptide sequence is orthologous to G1140 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1451 | | DNA | Zea mays | Predicted polypeptide sequence is orthologous to G1140 |
| 1452 | | DNA | Zea mays | Predicted polypeptide sequence is orthologous to G1140 |
| 1453 | | PRT | Oryza sativa | Orthologous to G1140 |
| 1454 | | PRT | Ipomoea batatas | Orthologous to G1140 |
| 1455 | | DNA | Zea mays | Predicted polypeptide sequence is orthologous to G1146 |
| 1456 | | DNA | Zea mays | Predicted polypeptide sequence is orthologous to G1146 |
| 1457 | | PRT | Oryza sativa | Orthologous to G1146 |
| 1458 | | PRT | Oryza sativa | Orthologous to G1146 |
| 1459 | | PRT | Oryza sativa | Orthologous to G1146 |
| 1460 | | DNA | Glycine max | Predicted polypeptide sequence is orthologous to G1196 |
| 1461 | | DNA | Glycine max | Predicted polypeptide sequence is orthologous to G1196 |
| 1462 | | DNA | Glycine max | Predicted polypeptide sequence is orthologous to G1196 |
| 1463 | | DNA | Oryza sativa | Predicted polypeptide sequence is orthologous to G1196 |
| 1464 | | DNA | Zea mays | Predicted polypeptide sequence is orthologous to G1196 |
| 1465 | | DNA | Zea mays | Predicted polypeptide sequence is orthologous to G1196 |
| 1466 | | PRT | Oryza sativa | Orthologous to G1196 |
| 1467 | | PRT | Oryza sativa | Orthologous to G1196 |
| 1468 | | DNA | Glycine max | Predicted polypeptide sequence is orthologous to G1198 |
| 1469 | | DNA | Glycine max | Predicted polypeptide sequence is orthologous to G1198 |
| 1470 | | DNA | Glycine max | Predicted polypeptide sequence is orthologous to G1198 |
| 1471 | | DNA | Glycine max | Predicted polypeptide sequence is orthologous to G1198 |
| 1472 | | DNA | Glycine max | Predicted polypeptide sequence is orthologous to G1198 |
| 1473 | | DNA | Glycine max | Predicted polypeptide sequence is orthologous to G1198 |
| 1474 | | DNA | Glycine max | Predicted polypeptide sequence is orthologous to G1198 |
| 1475 | | DNA | Glycine max | Predicted polypeptide sequence is orthologous to G1198 |
| 1476 | | DNA | Oryza sativa | Predicted polypeptide sequence is orthologous to G1198 |
| 1477 | | DNA | Oryza sativa | Predicted polypeptide sequence is orthologous to G1198 |
| 1478 | | DNA | Oryza sativa | Predicted polypeptide sequence is orthologous to G1198 |
| 1479 | | DNA | Oryza sativa | Predicted polypeptide sequence is orthologous to G1198 |
| 1480 | | DNA | Oryza sativa | Predicted polypeptide sequence is orthologous to G1198 |
| 1481 | | DNA | Zea mays | Predicted polypeptide sequence is orthologous to G1198 |
| 1482 | | DNA | Zea mays | Predicted polypeptide sequence is orthologous to G1198 |
| 1483 | | DNA | Zea mays | Predicted polypeptide sequence is orthologous to G1198 |
| 1484 | | DNA | Zea mays | Predicted polypeptide sequence is orthologous to G1198 |
| 1485 | | DNA | Zea mays | Predicted polypeptide sequence is orthologous to G1198 |
| 1486 | | DNA | Zea mays | Predicted polypeptide sequence is orthologous to G1198 |
| 1487 | | DNA | Zea mays | Predicted polypeptide sequence is orthologous to G1198 |
| 1488 | | DNA | Zea mays | Predicted polypeptide sequence is orthologous to G1198 |
| 1489 | | DNA | Zea mays | Predicted polypeptide sequence is orthologous to G1198 |
| 1490 | | DNA | Zea mays | Predicted polypeptide sequence is orthologous to G1198 |
| 1491 | | DNA | Nicotiana tabacum | Predicted polypeptide sequence is orthologous to G1198 |
| 1492 | | PRT | Oryza sativa | Orthologous to G1198 |
| 1493 | | PRT | Oryza sativa | Orthologous to G1198 |
| 1494 | | PRT | Oryza sativa | Orthologous to G1198 |
| 1495 | | PRT | Oryza sativa | Orthologous to G1198 |
| 1496 | | PRT | Oryza sativa | Orthologous to G1198 |
| 1497 | | PRT | Oryza sativa | Orthologous to G1198 |
| 1498 | | PRT | Oryza sativa | Orthologous to G1198 |
| 1499 | | DNA | Zea mays | Predicted polypeptide sequence is orthologous to G1225 |
| 1500 | | PRT | Oryza sativa | Orthologous to G1225 |
| 1501 | | PRT | Oryza sativa | Orthologous to G1226 |
| 1502 | | DNA | Glycine max | Predicted polypeptide sequence is orthologous to G1229 |
| 1503 | | PRT | Oryza sativa | Orthologous to G1229 |
| 1504 | | PRT | Oryza sativa | Orthologous to G1229 |
| 1505 | | DNA | Glycine max | Predicted polypeptide sequence is orthologous to G1255 |
| 1506 | | DNA | Glycine max | Predicted polypeptide sequence is orthologous to G1255 |
| 1507 | | DNA | Glycine max | Predicted polypeptide sequence is orthologous to G1255 |
| 1508 | | DNA | Glycine max | Predicted polypeptide sequence is orthologous to G1255 |
| 1509 | | DNA | Glycine max | Predicted polypeptide sequence is orthologous to G1255 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1510 | | DNA | Glycine max | Predicted polypeptide sequence is orthologous to G1255 |
| 1511 | | DNA | Glycine max | Predicted polypeptide sequence is orthologous to G1255 |
| 1512 | | DNA | Oryza sativa | Predicted polypeptide sequence is orthologous to G1255 |
| 1513 | | DNA | Oryza sativa | Predicted polypeptide sequence is orthologous to G1255 |
| 1514 | | DNA | Oryza sativa | Predicted polypeptide sequence is orthologous to G1255 |
| 1515 | | DNA | Oryza sativa | Predicted polypeptide sequence is orthologous to G1255 |
| 1516 | | DNA | Zea mays | Predicted polypeptide sequence is orthologous to G1255 |
| 1517 | | DNA | Zea mays | Predicted polypeptide sequence is orthologous to G1255 |
| 1518 | | DNA | Zea mays | Predicted polypeptide sequence is orthologous to G1255 |
| 1519 | | DNA | Zea mays | Predicted polypeptide sequence is orthologous to G1255 |
| 1520 | | DNA | Zea mays | Predicted polypeptide sequence is orthologous to G1255 |
| 1521 | | DNA | Zea mays | Predicted polypeptide sequence is orthologous to G1255 |
| 1522 | | PRT | Oryza sativa | Orthologous to G1255 |
| 1523 | | DNA | Glycine max | Predicted polypeptide sequence is orthologous to G1266 |
| 1524 | | DNA | Glycine max | Predicted polypeptide sequence is orthologous to G1266 |
| 1525 | | DNA | Glycine max | Predicted polypeptide sequence is orthologous to G1266 |
| 1526 | | DNA | Glycine max | Predicted polypeptide sequence is orthologous to G1266 |
| 1527 | | DNA | Oryza sativa | Predicted polypeptide sequence is orthologous to G1266 |
| 1528 | | PRT | Nicotiana tabacum | Orthologous to G1266 |
| 1529 | | DNA | Oryza sativa | Predicted polypeptide sequence is orthologous to G1275 |
| 1530 | | DNA | Zea mays | Predicted polypeptide sequence is orthologous to G1275 |
| 1531 | | DNA | Zea mays | Predicted polypeptide sequence is orthologous to G1275 |
| 1532 | | DNA | Zea mays | Predicted polypeptide sequence is orthologous to G1275 |
| 1533 | | PRT | Oryza sativa | Orthologous to G1275 |
| 1534 | | PRT | Oryza sativa | Orthologous to G1275 |
| 1535 | | PRT | Oryza sativa | Orthologous to G1275 |
| 1536 | | DNA | Glycine max | Predicted polypeptide sequence is orthologous to G1322 |
| 1537 | | DNA | Glycine max | Predicted polypeptide sequence is orthologous to G1322 |
| 1538 | | DNA | Glycine max | Predicted polypeptide sequence is orthologous to G1322 |
| 1539 | | DNA | Oryza sativa | Predicted polypeptide sequence is orthologous to G1322 |
| 1540 | | PRT | Oryza sativa | Orthologous to G1322 |
| 1541 | | PRT | Oryza sativa | Orthologous to G1322 |
| 1542 | | DNA | Zea mays | Predicted polypeptide sequence is orthologous to G1323 |
| 1543 | | DNA | Zea mays | Predicted polypeptide sequence is orthologous to G1323 |
| 1544 | | DNA | Glycine max | Predicted polypeptide sequence is orthologous to G1330 |
| 1545 | | DNA | Glycine max | Predicted polypeptide sequence is orthologous to G1330 |
| 1546 | | DNA | Glycine max | Predicted polypeptide sequence is orthologous to G1330 |
| 1547 | | DNA | Glycine max | Predicted polypeptide sequence is orthologous to G1330 |
| 1548 | | DNA | Glycine max | Predicted polypeptide sequence is orthologous to G1330 |
| 1549 | | DNA | Glycine max | Predicted polypeptide sequence is orthologous to G1330 |
| 1550 | | DNA | Glycine max | Predicted polypeptide sequence is orthologous to G1330 |
| 1551 | | DNA | Oryza sativa | Predicted polypeptide sequence is orthologous to G1330 |
| 1552 | | DNA | Oryza sativa | Predicted polypeptide sequence is orthologous to G1330 |
| 1553 | | DNA | Oryza sativa | Predicted polypeptide sequence is orthologous to G1330 |
| 1554 | | DNA | Oryza sativa | Predicted polypeptide sequence is orthologous to G1330 |
| 1555 | | DNA | Zea mays | Predicted polypeptide sequence is orthologous to G1330 |
| 1556 | | DNA | Zea mays | Predicted polypeptide sequence is orthologous to G1330 |
| 1557 | | DNA | Zea mays | Predicted polypeptide sequence is orthologous to G1330 |
| 1558 | | DNA | Zea mays | Predicted polypeptide sequence is orthologous to G1330 |
| 1559 | | DNA | Zea mays | Predicted polypeptide sequence is orthologous to G1330 |
| 1560 | | DNA | Zea mays | Predicted polypeptide sequence is orthologous to G1330 |
| 1561 | | DNA | Zea mays | Predicted polypeptide sequence is orthologous to G1330 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1562 | | DNA | Lycopersicon esculentum | Predicted polypeptide sequence is orthologous to G1330 |
| 1563 | | PRT | Oryza sativa | Orthologous to G1330 |
| 1564 | | PRT | Oryza sativa | Orthologous to G1330 |
| 1565 | | PRT | Oryza sativa | Orthologous to G1330 |
| 1566 | | PRT | Oryza sativa | Orthologous to G1330 |
| 1567 | | DNA | Glycine max | Predicted polypeptide sequence is orthologous to G1331 |
| 1568 | | DNA | Glycine max | Predicted polypeptide sequence is orthologous to G1331 |
| 1569 | | DNA | Oryza sativa | Predicted polypeptide sequence is orthologous to G1331 |
| 1570 | | DNA | Zea mays | Predicted polypeptide sequence is orthologous to G1331 |
| 1571 | | DNA | Zea mays | Predicted polypeptide sequence is orthologous to G1331 |
| 1572 | | PRT | Oryza sativa | Orthologous to G1331 |
| 1573 | | DNA | Glycine max | Predicted polypeptide sequence is orthologous to G1363 |
| 1574 | | DNA | Oryza sativa | Predicted polypeptide sequence is orthologous to G1363 |
| 1575 | | DNA | Oryza sativa | Predicted polypeptide sequence is orthologous to G1363 |
| 1576 | | DNA | Oryza sativa | Predicted polypeptide sequence is orthologous to G1363 |
| 1577 | | DNA | Oryza sativa | Predicted polypeptide sequence is orthologous to G1363 |
| 1578 | | DNA | Zea mays | Predicted polypeptide sequence is orthologous to G1363 |
| 1579 | | DNA | Zea mays | Predicted polypeptide sequence is orthologous to G1363 |
| 1580 | | DNA | Zea mays | Predicted polypeptide sequence is orthologous to G1363 |
| 1581 | | DNA | Zea mays | Predicted polypeptide sequence is orthologous to G1363 |
| 1582 | | DNA | Zea mays | Predicted polypeptide sequence is orthologous to G1363 |
| 1583 | | PRT | Oryza sativa | Orthologous to G1363 |
| 1584 | | PRT | Oryza sativa | Orthologous to G1363 |
| 1585 | | PRT | Oryza sativa | Orthologous to G1363 |
| 1586 | | PRT | Oryza sativa | Orthologous to G1363 |
| 1587 | | DNA | Glycine max | Predicted polypeptide sequence is orthologous to G1411, G2509 |
| 1588 | | DNA | Glycine max | Predicted polypeptide sequence is orthologous to G1411, G2509 |
| 1589 | | DNA | Glycine max | Predicted polypeptide sequence is orthologous to G1411, G2509 |
| 1590 | | DNA | Glycine max | Predicted polypeptide sequence is orthologous to G1411, G2509 |
| 1591 | | DNA | Zea mays | Predicted polypeptide sequence is orthologous to G1411, G2509 |
| 1592 | | DNA | Glycine max | Predicted polypeptide sequence is orthologous to G1417 |
| 1593 | | PRT | Oryza sativa | Orthologous to G1417 |
| 1594 | | PRT | Oryza sativa | Orthologous to G1417 |
| 1595 | | DNA | Glycine max | Predicted polypeptide sequence is orthologous to G1419 |
| 1596 | | DNA | Glycine max | Predicted polypeptide sequence is orthologous to G1449 |
| 1597 | | DNA | Glycine max | Predicted polypeptide sequence is orthologous to G1449 |
| 1598 | | DNA | Oryza sativa | Predicted polypeptide sequence is orthologous to G1449 |
| 1599 | | DNA | Oryza sativa | Predicted polypeptide sequence is orthologous to G1449 |
| 1600 | | DNA | Zea mays | Predicted polypeptide sequence is orthologous to G1449 |
| 1601 | | DNA | Zea mays | Predicted polypeptide sequence is orthologous to G1449 |
| 1602 | | DNA | Zea mays | Predicted polypeptide sequence is orthologous to G1449 |
| 1603 | | DNA | Zea mays | Predicted polypeptide sequence is orthologous to G1449 |
| 1604 | | DNA | Glycine max | Predicted polypeptide sequence is orthologous to G1451 |
| 1605 | | DNA | Glycine max | Predicted polypeptide sequence is orthologous to G1451 |
| 1606 | | DNA | Oryza sativa | Predicted polypeptide sequence is orthologous to G1451 |
| 1607 | | DNA | Oryza sativa | Predicted polypeptide sequence is orthologous to G1451 |
| 1608 | | DNA | Oryza sativa | Predicted polypeptide sequence is orthologous to G1451 |
| 1609 | | DNA | Zea mays | Predicted polypeptide sequence is orthologous to G1451 |
| 1610 | | DNA | Zea mays | Predicted polypeptide sequence is orthologous to G1451 |
| 1611 | | DNA | Zea mays | Predicted polypeptide sequence is orthologous to G1451 |
| 1612 | | DNA | Zea mays | Predicted polypeptide sequence is orthologous to G1451 |
| 1613 | | DNA | Medicago truncatula | Predicted polypeptide sequence is orthologous to G1451 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1614 | | DNA | Solanum tuberosum | Predicted polypeptide sequence is orthologous to G1451 |
| 1615 | | DNA | Zea mays | Predicted polypeptide sequence is orthologous to G1451 |
| 1616 | | DNA | Sorghum propinquum | Predicted polypeptide sequence is orthologous to G1451 |
| 1617 | | DNA | Glycine max | Predicted polypeptide sequence is orthologous to G1451 |
| 1618 | | DNA | Sorghum bicolor | Predicted polypeptide sequence is orthologous to G1451 |
| 1619 | | DNA | Hordeum vulgare | Predicted polypeptide sequence is orthologous to G1451 |
| 1620 | | DNA | Lycopersicon esculentum | Predicted polypeptide sequence is orthologous to G1451 |
| 1621 | | PRT | Oryza sativa | Orthologous to G1451 |
| 1622 | | PRT | Oryza sativa | Orthologous to G1451 |
| 1623 | | PRT | Oryza sativa | Orthologous to G1451 |
| 1624 | | PRT | Oryza sativa | Orthologous to G1451 |
| 1625 | | DNA | Glycine max | Predicted polypeptide sequence is orthologous to G1452 |
| 1626 | | DNA | Glycine max | Predicted polypeptide sequence is orthologous to G1478 |
| 1627 | | DNA | Glycine max | Predicted polypeptide sequence is orthologous to G1478 |
| 1628 | | DNA | Glycine max | Predicted polypeptide sequence is orthologous to G1478 |
| 1629 | | DNA | Zea mays | Predicted polypeptide sequence is orthologous to G1478 |
| 1630 | | DNA | Glycine max | Predicted polypeptide sequence is orthologous to G1482 |
| 1631 | | DNA | Glycine max | Predicted polypeptide sequence is orthologous to G1482 |
| 1632 | | DNA | Glycine max | Predicted polypeptide sequence is orthologous to G1482 |
| 1633 | | DNA | Glycine max | Predicted polypeptide sequence is orthologous to G1482 |
| 1634 | | DNA | Glycine max | Predicted polypeptide sequence is orthologous to G1482 |
| 1635 | | DNA | Oryza sativa | Predicted polypeptide sequence is orthologous to G1482 |
| 1636 | | DNA | Oryza sativa | Predicted polypeptide sequence is orthologous to G1482 |
| 1637 | | DNA | Oryza sativa | Predicted polypeptide sequence is orthologous to G1482 |
| 1638 | | DNA | Oryza sativa | Predicted polypeptide sequence is orthologous to G1482 |
| 1639 | | DNA | Zea mays | Predicted polypeptide sequence is orthologous to G1482 |
| 1640 | | DNA | Zea mays | Predicted polypeptide sequence is orthologous to G1482 |
| 1641 | | DNA | Zea mays | Predicted polypeptide sequence is orthologous to G1482 |
| 1642 | | DNA | Zea mays | Predicted polypeptide sequence is orthologous to G1482 |
| 1643 | | DNA | Zea mays | Predicted polypeptide sequence is orthologous to G1482 |
| 1644 | | DNA | Zea mays | Predicted polypeptide sequence is orthologous to G1482 |
| 1645 | | PRT | Oryza sativa | Orthologous to G1482 |
| 1646 | | PRT | Oryza sativa | Orthologous to G1482 |
| 1647 | | DNA | Glycine max | Predicted polypeptide sequence is orthologous to G1488 |
| 1648 | | DNA | Glycine max | Predicted polypeptide sequence is orthologous to G1488 |
| 1649 | | DNA | Glycine max | Predicted polypeptide sequence is orthologous to G1488 |
| 1650 | | DNA | Oryza sativa | Predicted polypeptide sequence is orthologous to G1488 |
| 1651 | | DNA | Oryza sativa | Predicted polypeptide sequence is orthologous to G1488 |
| 1652 | | DNA | Zea mays | Predicted polypeptide sequence is orthologous to G1488 |
| 1653 | | DNA | Zea mays | Predicted polypeptide sequence is orthologous to G1488 |
| 1654 | | DNA | Zea mays | Predicted polypeptide sequence is orthologous to G1488 |
| 1655 | | PRT | Oryza sativa | Orthologous to G1488 |
| 1656 | | PRT | Oryza sativa | Orthologous to G1488 |
| 1657 | | PRT | Oryza sativa | Orthologous to G1488 |
| 1658 | | PRT | Oryza sativa | Orthologous to G1499 |
| 1659 | | DNA | Brassica rapa subsp. pekinensis | Predicted polypeptide sequence is orthologous to G1499 |
| 1660 | | DNA | Glycine max | Predicted polypeptide sequence is orthologous to G1519 |
| 1661 | | DNA | Oryza sativa | Predicted polypeptide sequence is orthologous to G1519 |
| 1662 | | DNA | Zea mays | Predicted polypeptide sequence is orthologous to G1519 |
| 1663 | | DNA | Zea mays | Predicted polypeptide sequence is orthologous to G1519 |
| 1664 | | DNA | Lycopersicon esculentum | Predicted polypeptide sequence is orthologous to G1519 |
| 1665 | | DNA | Glycine max | Predicted polypeptide sequence is orthologous to G1526 |
| 1666 | | DNA | Oryza sativa | Predicted polypeptide sequence is orthologous to G1526 |
| 1667 | | DNA | Oryza sativa | Predicted polypeptide sequence is orthologous to G1526 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1668 | | DNA | Zea mays | Predicted polypeptide sequence is orthologous to G1526 |
| 1669 | | DNA | Glycine max | Predicted polypeptide sequence is orthologous to G1540 |
| 1670 | | PRT | Oryza sativa | Orthologous to G1540 |
| 1671 | | DNA | Glycine max | Predicted polypeptide sequence is orthologous to G1543 |
| 1672 | | DNA | Oryza sativa | Predicted polypeptide sequence is orthologous to G1543 |
| 1673 | | DNA | Zea mays | Predicted polypeptide sequence is orthologous to G1543 |
| 1674 | | PRT | Oryza sativa | Orthologous to G1543 |
| 1675 | | DNA | Zea mays | Predicted polypeptide sequence is orthologous to G1637 |
| 1676 | | DNA | Zea mays | Predicted polypeptide sequence is orthologous to G1637 |
| 1677 | | DNA | Zea mays | Predicted polypeptide sequence is orthologous to G1637 |
| 1678 | | DNA | Glycine max | Predicted polypeptide sequence is orthologous to G1640 |
| 1679 | | DNA | Glycine max | Predicted polypeptide sequence is orthologous to G1640 |
| 1680 | | DNA | Glycine max | Predicted polypeptide sequence is orthologous to G1640 |
| 1681 | | PRT | Oryza sativa | Orthologous to G1640 |
| 1682 | | DNA | Zea mays | Predicted polypeptide sequence is orthologous to G1645 |
| 1683 | | DNA | Zea mays | Predicted polypeptide sequence is orthologous to G1645 |
| 1684 | | DNA | Zea mays | Predicted polypeptide sequence is orthologous to G1645 |
| 1685 | | DNA | Lycopersicon esculentum | Predicted polypeptide sequence is orthologous to G1645 |
| 1686 | | DNA | Medicago truncatula | Predicted polypeptide sequence is orthologous to G1645 |
| 1687 | | PRT | Oryza sativa | Orthologous to G1645 |
| 1688 | | DNA | Oryza sativa | Predicted polypeptide sequence is orthologous to G1646 |
| 1689 | | DNA | Oryza sativa | Predicted polypeptide sequence is orthologous to G1646 |
| 1690 | | DNA | Glycine max | Predicted polypeptide sequence is orthologous to G1652 |
| 1691 | | DNA | Glycine max | Predicted polypeptide sequence is orthologous to G1652 |
| 1692 | | DNA | Glycine max | Predicted polypeptide sequence is orthologous to G1652 |
| 1693 | | DNA | Glycine max | Predicted polypeptide sequence is orthologous to G1652 |
| 1694 | | DNA | Glycine max | Predicted polypeptide sequence is orthologous to G1652 |
| 1695 | | DNA | Glycine max | Predicted polypeptide sequence is orthologous to G1652 |
| 1696 | | DNA | Glycine max | Predicted polypeptide sequence is orthologous to G1652 |
| 1697 | | DNA | Glycine max | Predicted polypeptide sequence is orthologous to G1652 |
| 1698 | | DNA | Oryza sativa | Predicted polypeptide sequence is orthologous to G1652 |
| 1699 | | DNA | Zea mays | Predicted polypeptide sequence is orthologous to G1652 |
| 1700 | | DNA | Zea mays | Predicted polypeptide sequence is orthologous to G1652 |
| 1701 | | PRT | Oryza sativa | Orthologous to G1652 |
| 1702 | | PRT | Oryza sativa | Orthologous to G1652 |
| 1703 | | PRT | Oryza sativa | Orthologous to G1652 |
| 1704 | | PRT | Oryza sativa | Orthologous to G1652 |
| 1705 | | PRT | Oryza sativa | Orthologous to G1652 |
| 1706 | | DNA | Glycine max | Predicted polypeptide sequence is orthologous to G1672 |
| 1707 | | DNA | Oryza sativa | Predicted polypeptide sequence is orthologous to G1672 |
| 1708 | | DNA | Zea mays | Predicted polypeptide sequence is orthologous to G1672 |
| 1709 | | DNA | Zea mays | Predicted polypeptide sequence is orthologous to G1672 |
| 1710 | | PRT | Oryza sativa | Orthologous to G1672 |
| 1711 | | PRT | Oryza sativa | Orthologous to G1672 |
| 1712 | | PRT | Oryza sativa | Orthologous to G1672 |
| 1713 | | PRT | Oryza sativa | Orthologous to G1672 |
| 1714 | | DNA | Glycine max | Predicted polypeptide sequence is orthologous to G1750 |
| 1715 | | DNA | Glycine max | Predicted polypeptide sequence is orthologous to G1750 |
| 1716 | | DNA | Glycine max | Predicted polypeptide sequence is orthologous to G1750 |
| 1717 | | DNA | Glycine max | Predicted polypeptide sequence is orthologous to G1750 |
| 1718 | | DNA | Oryza sativa | Predicted polypeptide sequence is orthologous to G1750 |
| 1719 | | DNA | Zea mays | Predicted polypeptide sequence is orthologous to G1750 |
| 1720 | | DNA | Zea mays | Predicted polypeptide sequence is orthologous to G1750 |
| 1721 | | DNA | Glycine max | Predicted polypeptide sequence is orthologous to G1756 |
| 1722 | | DNA | Medicago truncatula | Predicted polypeptide sequence is orthologous to G1765 |
| 1723 | | DNA | Glycine max | Predicted polypeptide sequence is orthologous to G1777 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1724 | | DNA | Oryza sativa | Predicted polypeptide sequence is orthologous to G1777 |
| 1725 | | DNA | Zea mays | Predicted polypeptide sequence is orthologous to G1777 |
| 1726 | | DNA | Zea mays | Predicted polypeptide sequence is orthologous to G1777 |
| 1727 | | PRT | Oryza sativa | Orthologous to G1777 |
| 1728 | | DNA | Glycine max | Predicted polypeptide sequence is orthologous to G1792 |
| 1729 | | DNA | Glycine max | Predicted polypeptide sequence is orthologous to G1792 |
| 1730 | | DNA | Glycine max | Predicted polypeptide sequence is orthologous to G1792 |
| 1731 | | DNA | Glycine max | Predicted polypeptide sequence is orthologous to G1792 |
| 1732 | | DNA | Glycine max | Predicted polypeptide sequence is orthologous to G1792 |
| 1733 | | DNA | Zea mays | Predicted polypeptide sequence is orthologous to G1792 |
| 1734 | | DNA | Lycopersicon esculentum | Predicted polypeptide sequence is orthologous to G1792 |
| 1735 | G3380 | PRT | Oryza sativa | Orthologous to G1792 |
| 1736 | G3381 | PRT | Oryza sativa indica | Orthologous to G1792 |
| 1737 | G3383 | PRT | Oryza sativa japonica | Orthologous to G1792 |
| 1738 | | DNA | Glycine max | Predicted polypeptide sequence is orthologous to G1793 |
| 1739 | | DNA | Oryza sativa | Predicted polypeptide sequence is orthologous to G1793 |
| 1740 | | DNA | Zea mays | Predicted polypeptide sequence is orthologous to G1793 |
| 1741 | | DNA | Zea mays | Predicted polypeptide sequence is orthologous to G1793 |
| 1742 | | DNA | Zea mays | Predicted polypeptide sequence is orthologous to G1793 |
| 1743 | | PRT | Oryza sativa | Orthologous to G1793 |
| 1744 | | DNA | Glycine max | Predicted polypeptide sequence is orthologous to G1794 |
| 1745 | | DNA | Glycine max | Predicted polypeptide sequence is orthologous to G1794 |
| 1746 | | DNA | Glycine max | Predicted polypeptide sequence is orthologous to G1794 |
| 1747 | | DNA | Glycine max | Predicted polypeptide sequence is orthologous to G1794 |
| 1748 | | DNA | Glycine max | Predicted polypeptide sequence is orthologous to G1794 |
| 1749 | | DNA | Glycine max | Predicted polypeptide sequence is orthologous to G1794 |
| 1750 | | DNA | Glycine max | Predicted polypeptide sequence is orthologous to G1794 |
| 1751 | | DNA | Zea mays | Predicted polypeptide sequence is orthologous to G1794 |
| 1752 | | DNA | Zea mays | Predicted polypeptide sequence is orthologous to G1794 |
| 1753 | | DNA | Zea mays | Predicted polypeptide sequence is orthologous to G1794 |
| 1754 | | PRT | Oryza sativa | Orthologous to G1794 |
| 1755 | | PRT | Oryza sativa | Orthologous to G1794 |
| 1756 | | PRT | Oryza sativa | Orthologous to G1794 |
| 1757 | | DNA | Glycine max | Predicted polypeptide sequence is orthologous to G1804 |
| 1758 | | DNA | Glycine max | Predicted polypeptide sequence is orthologous to G1804 |
| 1759 | | DNA | Glycine max | Predicted polypeptide sequence is orthologous to G1804 |
| 1760 | | DNA | Oryza sativa | Predicted polypeptide sequence is orthologous to G1804 |
| 1761 | | PRT | Oryza sativa | Orthologous to G1804 |
| 1762 | | PRT | Helianthus annuus | Orthologous to G1804 |
| 1763 | | DNA | Glycine max | Predicted polypeptide sequence is orthologous to G1838 |
| 1764 | | DNA | Glycine max | Predicted polypeptide sequence is orthologous to G1838 |
| 1765 | | PRT | Oryza sativa | Orthologous to G1838 |
| 1766 | | DNA | Glycine max | Predicted polypeptide sequence is orthologous to G1841 |
| 1767 | | DNA | Glycine max | Predicted polypeptide sequence is orthologous to G1841 |
| 1768 | | DNA | Oryza sativa | Predicted polypeptide sequence is orthologous to G1841 |
| 1769 | | PRT | Oryza sativa | Orthologous to G1841 |
| 1770 | | DNA | Solanum tuberosum | Predicted polypeptide sequence is orthologous to G1852 |
| 1771 | | DNA | Gossypium arboreum | Predicted polypeptide sequence is orthologous to G1852 |
| 1772 | | DNA | Medicago truncatula | Predicted polypeptide sequence is orthologous to G1852 |
| 1773 | | DNA | Glycine max | Predicted polypeptide sequence is orthologous to G1852 |
| 1774 | | DNA | Lycopersicon esculentum | Predicted polypeptide sequence is orthologous to G1852 |
| 1775 | | DNA | Pinus taeda | Predicted polypeptide sequence is orthologous to G1852 |
| 1776 | | DNA | Lotus japonicus | Predicted polypeptide sequence is orthologous to G1852 |
| 1777 | | DNA | Gossypium hirsutum | Predicted polypeptide sequence is orthologous to G1852 |
| 1778 | | DNA | Solanum tuberosum | Predicted polypeptide sequence is orthologous to G1863 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1779 | | DNA | Medicago truncatula | Predicted polypeptide sequence is orthologous to G1863 |
| 1780 | | DNA | Lycopersicon esculentum | Predicted polypeptide sequence is orthologous to G1863 |
| 1781 | | PRT | Oryza sativa | Orthologous to G1863 |
| 1782 | | DNA | Glycine max | Predicted polypeptide sequence is orthologous to G1880 |
| 1783 | | DNA | Glycine max | Predicted polypeptide sequence is orthologous to G1880 |
| 1784 | | DNA | Medicago truncatula | Predicted polypeptide sequence is orthologous to G1880 |
| 1785 | | PRT | Oryza sativa | Orthologous to G1880 |
| 1786 | | DNA | Glycine max | Predicted polypeptide sequence is orthologous to G1902 |
| 1787 | | DNA | Glycine max | Predicted polypeptide sequence is orthologous to G1902 |
| 1788 | | DNA | Glycine max | Predicted polypeptide sequence is orthologous to G1902 |
| 1789 | | DNA | Zea mays | Predicted polypeptide sequence is orthologous to G1902 |
| 1790 | | PRT | Oryza sativa | Orthologous to G1902 |
| 1791 | | DNA | Glycine max | Predicted polypeptide sequence is orthologous to G1927 |
| 1792 | | DNA | Oryza sativa | Predicted polypeptide sequence is orthologous to G1927 |
| 1793 | | DNA | Zea mays | Predicted polypeptide sequence is orthologous to G1927 |
| 1794 | | DNA | Lycopersicon esculentum | Predicted polypeptide sequence is orthologous to G1927 |
| 1795 | | DNA | Oryza sativa | Predicted polypeptide sequence is orthologous to G1930 |
| 1796 | | DNA | Glycine max | Predicted polypeptide sequence is orthologous to G1944 |
| 1797 | | DNA | Glycine max | Predicted polypeptide sequence is orthologous to G1944 |
| 1798 | | DNA | Zea mays | Predicted polypeptide sequence is orthologous to G1944 |
| 1799 | | DNA | Glycine max | Predicted polypeptide sequence is orthologous to G1944 |
| 1800 | | DNA | Glycine max | Predicted polypeptide sequence is orthologous to G1944 |
| 1801 | | DNA | Glycine max | Predicted polypeptide sequence is orthologous to G1946 |
| 1802 | | DNA | Glycine max | Predicted polypeptide sequence is orthologous to G1946 |
| 1803 | | DNA | Zea mays | Predicted polypeptide sequence is orthologous to G1946 |
| 1804 | | DNA | Zea mays | Predicted polypeptide sequence is orthologous to G1946 |
| 1805 | | PRT | Oryza sativa | Orthologous to G1946 |
| 1806 | | DNA | Glycine max | Predicted polypeptide sequence is orthologous to G1948 |
| 1807 | | DNA | Glycine max | Predicted polypeptide sequence is orthologous to G1948 |
| 1808 | | DNA | Oryza sativa | Predicted polypeptide sequence is orthologous to G1948 |
| 1809 | | DNA | Oryza sativa | Predicted polypeptide sequence is orthologous to G1948 |
| 1810 | | DNA | Zea mays | Predicted polypeptide sequence is orthologous to G1948 |
| 1811 | | DNA | Zea mays | Predicted polypeptide sequence is orthologous to G1948 |
| 1812 | | DNA | Zea mays | Predicted polypeptide sequence is orthologous to G1948 |
| 1813 | | PRT | Oryza sativa | Orthologous to G1948 |
| 1814 | | DNA | Glycine max | Predicted polypeptide sequence is orthologous to G1950 |
| 1815 | | DNA | Glycine max | Predicted polypeptide sequence is orthologous to G1950 |
| 1816 | | DNA | Glycine max | Predicted polypeptide sequence is orthologous to G1950 |
| 1817 | | DNA | Glycine max | Predicted polypeptide sequence is orthologous to G1950 |
| 1818 | | DNA | Glycine max | Predicted polypeptide sequence is orthologous to G1950 |
| 1819 | | DNA | Glycine max | Predicted polypeptide sequence is orthologous to G1950 |
| 1820 | | DNA | Oryza sativa | Predicted polypeptide sequence is orthologous to G1950 |
| 1821 | | DNA | Oryza sativa | Predicted polypeptide sequence is orthologous to G1950 |
| 1822 | | DNA | Oryza sativa | Predicted polypeptide sequence is orthologous to G1950 |
| 1823 | | DNA | Oryza sativa | Predicted polypeptide sequence is orthologous to G1950 |
| 1824 | | DNA | Oryza sativa | Predicted polypeptide sequence is orthologous to G1950 |
| 1825 | | DNA | Oryza sativa | Predicted polypeptide sequence is orthologous to G1950 |
| 1826 | | DNA | Oryza sativa | Predicted polypeptide sequence is orthologous to G1950 |
| 1827 | | DNA | Oryza sativa | Predicted polypeptide sequence is orthologous to G1950 |
| 1828 | | DNA | Oryza sativa | Predicted polypeptide sequence is orthologous to G1950 |
| 1829 | | DNA | Zea mays | Predicted polypeptide sequence is orthologous to G1950 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1830 | | DNA | Zea mays | Predicted polypeptide sequence is orthologous to G1950 |
| 1831 | | DNA | Zea mays | Predicted polypeptide sequence is orthologous to G1950 |
| 1832 | | DNA | Zea mays | Predicted polypeptide sequence is orthologous to G1950 |
| 1833 | | DNA | Zea mays | Predicted polypeptide sequence is orthologous to G1950 |
| 1834 | | DNA | Zea mays | Predicted polypeptide sequence is orthologous to G1950 |
| 1835 | | DNA | Zea mays | Predicted polypeptide sequence is orthologous to G1950 |
| 1836 | | DNA | Zea mays | Predicted polypeptide sequence is orthologous to G1950 |
| 1837 | | DNA | Zea mays | Predicted polypeptide sequence is orthologous to G1950 |
| 1838 | | PRT | Oryza sativa | Orthologous to G1950 |
| 1839 | | PRT | Oryza sativa | Orthologous to G1950 |
| 1840 | | PRT | Oryza sativa | Orthologous to G1950 |
| 1841 | | PRT | Oryza sativa | Orthologous to G1950 |
| 1842 | | PRT | Oryza sativa | Orthologous to G1950 |
| 1843 | | PRT | Oryza sativa | Orthologous to G1950 |
| 1844 | | PRT | Oryza sativa | Orthologous to G1950 |
| 1845 | | PRT | Oryza sativa | Orthologous to G1950 |
| 1846 | | PRT | Oryza sativa | Orthologous to G1950 |
| 1847 | | DNA | Glycine max | Predicted polypeptide sequence is orthologous to G1958 |
| 1848 | | DNA | Glycine max | Predicted polypeptide sequence is orthologous to G1958 |
| 1849 | | DNA | Glycine max | Predicted polypeptide sequence is orthologous to G1958 |
| 1850 | | DNA | Glycine max | Predicted polypeptide sequence is orthologous to G1958 |
| 1851 | | DNA | Glycine max | Predicted polypeptide sequence is orthologous to G1958 |
| 1852 | | DNA | Oryza sativa | Predicted polypeptide sequence is orthologous to G1958 |
| 1853 | | DNA | Oryza sativa | Predicted polypeptide sequence is orthologous to G1958 |
| 1854 | | DNA | Zea mays | Predicted polypeptide sequence is orthologous to G1958 |
| 1855 | | DNA | Zea mays | Predicted polypeptide sequence is orthologous to G1958 |
| 1856 | | DNA | Zea mays | Predicted polypeptide sequence is orthologous to G1958 |
| 1857 | | PRT | Nicotiana tabacum | Orthologous to G1958 |
| 1858 | | DNA | Glycine max | Predicted polypeptide sequence is orthologous to G2007 |
| 1859 | | DNA | Glycine max | Predicted polypeptide sequence is orthologous to G2007 |
| 1860 | | DNA | Zea mays | Predicted polypeptide sequence is orthologous to G2007 |
| 1861 | | DNA | Zea mays | Predicted polypeptide sequence is orthologous to G2007 |
| 1862 | | DNA | Zea mays | Predicted polypeptide sequence is orthologous to G2007 |
| 1863 | | PRT | Oryza sativa | Orthologous to G2007 |
| 1864 | | DNA | Glycine max | Predicted polypeptide sequence is orthologous to G2010, G2347 |
| 1865 | | DNA | Oryza sativa | Predicted polypeptide sequence is orthologous to G2010, G2347 |
| 1866 | | DNA | Zea mays | Predicted polypeptide sequence is orthologous to G2010 |
| 1867 | | DNA | Zea mays | Predicted polypeptide sequence is orthologous to G2010, G2347 |
| 1868 | | DNA | Glycine max | Predicted polypeptide sequence is orthologous to G2059 |
| 1869 | | DNA | Glycine max | Predicted polypeptide sequence is orthologous to G2085 |
| 1870 | | DNA | Glycine max | Predicted polypeptide sequence is orthologous to G2085 |
| 1871 | | DNA | Glycine max | Predicted polypeptide sequence is orthologous to G2085 |
| 1872 | | DNA | Glycine max | Predicted polypeptide sequence is orthologous to G2085 |
| 1873 | | DNA | Zea mays | Predicted polypeptide sequence is orthologous to G2085 |
| 1874 | | PRT | Oryza sativa | Orthologous to G2085 |
| 1875 | | PRT | Oryza sativa | Orthologous to G2105 |
| 1876 | | DNA | Glycine max | Predicted polypeptide sequence is orthologous to G2110 |
| 1877 | | DNA | Oryza sativa | Predicted polypeptide sequence is orthologous to G2114 |
| 1878 | | DNA | Oryza sativa | Predicted polypeptide sequence is orthologous to G2114 |
| 1879 | | DNA | Zea mays | Predicted polypeptide sequence is orthologous to G2114 |
| 1880 | | DNA | Zea mays | Predicted polypeptide sequence is orthologous to G2114 |
| 1881 | | DNA | Oryza sativa | Predicted polypeptide sequence is orthologous to G2117 |
| 1882 | | DNA | Medicago truncatula | Predicted polypeptide sequence is orthologous to G2130 |
| 1883 | | PRT | Oryza sativa | Orthologous to G2130 |
| 1884 | | PRT | Oryza sativa | Orthologous to G2130 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1885 | | DNA | Glycine max | Predicted polypeptide sequence is orthologous to G2140 |
| 1886 | | DNA | Glycine max | Predicted polypeptide sequence is orthologous to G2140 |
| 1887 | | DNA | Glycine max | Predicted polypeptide sequence is orthologous to G2140 |
| 1888 | | DNA | Glycine max | Predicted polypeptide sequence is orthologous to G2140 |
| 1889 | | DNA | Glycine max | Predicted polypeptide sequence is orthologous to G2140 |
| 1890 | | DNA | Glycine max | Predicted polypeptide sequence is orthologous to G2140 |
| 1891 | | DNA | Oryza sativa | Predicted polypeptide sequence is orthologous to G2140 |
| 1892 | | DNA | Oryza sativa | Predicted polypeptide sequence is orthologous to G2140 |
| 1893 | | DNA | Oryza sativa | Predicted polypeptide sequence is orthologous to G2140 |
| 1894 | | DNA | Oryza sativa | Predicted polypeptide sequence is orthologous to G2140 |
| 1895 | | DNA | Zea mays | Predicted polypeptide sequence is orthologous to G2140 |
| 1896 | | DNA | Lycopersicon esculentum | Predicted polypeptide sequence is orthologous to G2140 |
| 1897 | | PRT | Oryza sativa | Orthologous to G2140 |
| 1898 | | PRT | Oryza sativa | Orthologous to G2140 |
| 1899 | | PRT | Oryza sativa | Orthologous to G2140 |
| 1900 | | PRT | Oryza sativa | Orthologous to G2140 |
| 1901 | | PRT | Oryza sativa | Orthologous to G2140 |
| 1902 | | DNA | Glycine max | Predicted polypeptide sequence is orthologous to G2143 |
| 1903 | | DNA | Glycine max | Predicted polypeptide sequence is orthologous to G2143 |
| 1904 | | DNA | Glycine max | Predicted polypeptide sequence is orthologous to G2144 |
| 1905 | | DNA | Glycine max | Predicted polypeptide sequence is orthologous to G2144 |
| 1906 | | DNA | Zea mays | Predicted polypeptide sequence is orthologous to G2144 |
| 1907 | | DNA | Zea mays | Predicted polypeptide sequence is orthologous to G2144 |
| 1908 | | DNA | Medicago truncatula | Predicted polypeptide sequence is orthologous to G2155 |
| 1909 | | DNA | Medicago truncatula | Predicted polypeptide sequence is orthologous to G2155 |
| 1910 | | DNA | Glycine max | Predicted polypeptide sequence is orthologous to G2155 |
| 1911 | | PRT | Oryza sativa | Orthologous to G2192 |
| 1912 | | PRT | Oryza sativa | Orthologous to G2295 |
| 1913 | | DNA | Glycine max | Predicted polypeptide sequence is orthologous to G2340 |
| 1914 | | DNA | Glycine max | Predicted polypeptide sequence is orthologous to G2343 |
| 1915 | | DNA | Glycine max | Predicted polypeptide sequence is orthologous to G2343 |
| 1916 | | DNA | Glycine max | Predicted polypeptide sequence is orthologous to G2343 |
| 1917 | | PRT | Lycopersicon esculentum | Orthologous to G2343 |
| 1918 | | PRT | Oryza sativa | Orthologous to G2379 |
| 1919 | | PRT | Oryza sativa | Orthologous to G2379 |
| 1920 | | PRT | Oryza sativa | Orthologous to G2379 |
| 1921 | | DNA | Glycine max | Predicted polypeptide sequence is orthologous to G2505 |
| 1922 | | DNA | Zea mays | Predicted polypeptide sequence is orthologous to G2505 |
| 1923 | | DNA | Glycine max | Predicted polypeptide sequence is orthologous to G2520 |
| 1924 | | DNA | Glycine max | Predicted polypeptide sequence is orthologous to G2520 |
| 1925 | | DNA | Oryza sativa | Predicted polypeptide sequence is orthologous to G2520 |
| 1926 | | DNA | Zea mays | Predicted polypeptide sequence is orthologous to G2520 |
| 1927 | | DNA | Zea mays | Predicted polypeptide sequence is orthologous to G2520 |
| 1928 | | DNA | Zea mays | Predicted polypeptide sequence is orthologous to G2520 |
| 1929 | | PRT | Oryza sativa | Orthologous to G2520 |
| 1930 | | PRT | Oryza sativa | Orthologous to G2520 |
| 1931 | | DNA | Glycine max | Predicted polypeptide sequence is orthologous to G2557 |
| 1932 | | DNA | Glycine max | Predicted polypeptide sequence is orthologous to G2557 |
| 1933 | | DNA | Glycine max | Predicted polypeptide sequence is orthologous to G2557 |
| 1934 | | DNA | Zea mays | Predicted polypeptide sequence is orthologous to G2557 |
| 1935 | | DNA | Zea mays | Predicted polypeptide sequence is orthologous to G2557 |
| 1936 | | DNA | Glycine max | Orthologous to G2557 |
| 1937 | | PRT | Oryza sativa | Orthologous to G2557 |
| 1938 | | PRT | Oryza sativa | Orthologous to G2557 |
| 1939 | | PRT | Oryza sativa | Orthologous to G2557 |
| 1940 | | DNA | Glycine max | Predicted polypeptide sequence is orthologous to G2719 |
| 1941 | | DNA | Zea mays | Predicted polypeptide sequence is orthologous to G2719 |
| 1942 | | PRT | Oryza sativa | Orthologous to G2719 |
| 1943 | | PRT | Oryza sativa | Orthologous to G2719 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1944 | | DNA | Glycine max | Predicted polypeptide sequence is orthologous to G2789 |
| 1945 | | DNA | Medicago truncatula | Predicted polypeptide sequence is orthologous to G2789 |
| 1946 | | DNA | Glycine max | Predicted polypeptide sequence is orthologous to G2830 |
| 1947 | G5 | DNA | Arabidopsis thaliana | Predicted polypeptide sequence is paralogous to G974 |
| 1948 | G5 | PRT | Arabidopsis thaliana | Paralogous to G974 |
| 1949 | G9 | DNA | Arabidopsis thaliana | Predicted polypeptide sequence is paralogous to G867, G1930 |
| 1950 | G9 | PRT | Arabidopsis thaliana | Paralogous to G867, G1930 |
| 1951 | G12 | DNA | Arabidopsis thaliana | Predicted polypeptide sequence is paralogous to G24 |
| 1952 | G12 | PRT | Arabidopsis thaliana | Paralogous to G24 |
| 1953 | G30 | DNA | Arabidopsis thaliana | Predicted polypeptide sequence is paralogous to G1792 |
| 1954 | G30 | PRT | Arabidopsis thaliana | Paralogous to G1792 |
| 1955 | G40 | DNA | Arabidopsis thaliana | Predicted polypeptide sequence is paralogous to G912, G913 |
| 1956 | G40 | PRT | Arabidopsis thaliana | Paralogous to G912, G913 |
| 1957 | G41 | DNA | Arabidopsis thaliana | Predicted polypeptide sequence is paralogous to G912, G913 |
| 1958 | G41 | PRT | Arabidopsis thaliana | Paralogous to G912, G913 |
| 1959 | G42 | DNA | Arabidopsis thaliana | Predicted polypeptide sequence is paralogous to G912, G913 |
| 1960 | G42 | PRT | Arabidopsis thaliana | Paralogous to G912, G913 |
| 1961 | G182 | DNA | Arabidopsis thaliana | Predicted polypeptide sequence is paralogous to G196 |
| 1962 | G182 | PRT | Arabidopsis thaliana | Paralogous to G196 |
| 1963 | G197 | DNA | Arabidopsis thaliana | Predicted polypeptide sequence is paralogous to G664 |
| 1964 | G197 | PRT | Arabidopsis thaliana | Paralogous to G664 |
| 1965 | G212 | DNA | Arabidopsis thaliana | Predicted polypeptide sequence is paralogous to G676 |
| 1966 | G212 | PRT | Arabidopsis thaliana | Paralogous to G676 |
| 1967 | G216 | DNA | Arabidopsis thaliana | Predicted polypeptide sequence is paralogous to G2719 |
| 1968 | G216 | PRT | Arabidopsis thaliana | Paralogous to G2719 |
| 1969 | G221 | DNA | Arabidopsis thaliana | Predicted polypeptide sequence is paralogous to G1322 |
| 1970 | G221 | PRT | Arabidopsis thaliana | Paralogous to G1322 |
| 1971 | G225 | DNA | Arabidopsis thaliana | Predicted polypeptide sequence is paralogous to G226, G682 |
| 1972 | G225 | PRT | Arabidopsis thaliana | Paralogous to G226, G682 |
| 1973 | G228 | DNA | Arabidopsis thaliana | Predicted polypeptide sequence is paralogous to G254 |
| 1974 | G228 | PRT | Arabidopsis thaliana | Paralogous to G254 |
| 1975 | G231 | DNA | Arabidopsis thaliana | Predicted polypeptide sequence is paralogous to G2007 |
| 1976 | G231 | PRT | Arabidopsis thaliana | Paralogous to G2007 |
| 1977 | G233 | DNA | Arabidopsis thaliana | Predicted polypeptide sequence is paralogous to G241 |
| 1978 | G233 | PRT | Arabidopsis thaliana | Paralogous to G241 |
| 1979 | G247 | DNA | Arabidopsis thaliana | Predicted polypeptide sequence is paralogous to G676 |
| 1980 | G247 | PRT | Arabidopsis thaliana | Paralogous to G676 |
| 1981 | G249 | DNA | Arabidopsis thaliana | Predicted polypeptide sequence is paralogous to G1322 |
| 1982 | G249 | PRT | Arabidopsis thaliana | Paralogous to G1322 |
| 1983 | G255 | DNA | Arabidopsis thaliana | Predicted polypeptide sequence is paralogous to G664 |
| 1984 | G255 | PRT | Arabidopsis thaliana | Paralogous to G664 |
| 1985 | G342 | DNA | Arabidopsis thaliana | Predicted polypeptide sequence is paralogous to G343 |
| 1986 | G342 | PRT | Arabidopsis thaliana | Paralogous to G343 |
| 1987 | G350 | DNA | Arabidopsis thaliana | Predicted polypeptide sequence is paralogous to G545 |
| 1988 | G350 | PRT | Arabidopsis thaliana | Paralogous to G545 |
| 1989 | G351 | DNA | Arabidopsis thaliana | Predicted polypeptide sequence is paralogous to G545 |
| 1990 | G351 | PRT | Arabidopsis thaliana | Paralogous to G545 |
| 1991 | G370 | DNA | Arabidopsis thaliana | Predicted polypeptide sequence is paralogous to G361, G362 |
| 1992 | G370 | PRT | Arabidopsis thaliana | Paralogous to G361, G362 |
| 1993 | G392 | DNA | Arabidopsis thaliana | Predicted polypeptide sequence is paralogous to G390, G391, G438 |
| 1994 | G392 | PRT | Arabidopsis thaliana | Paralogous to G390, G391, G438 |
| 1995 | G425 | DNA | Arabidopsis thaliana | Predicted polypeptide sequence is paralogous to G427 |
| 1996 | G425 | PRT | Arabidopsis thaliana | Paralogous to G427 |
| 1997 | G426 | DNA | Arabidopsis thaliana | Predicted polypeptide sequence is paralogous to G427 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1998 | G426 | PRT | *Arabidopsis thaliana* | Paralogous to G427 |
| 1999 | G440 | DNA | *Arabidopsis thaliana* | Predicted polypeptide sequence is paralogous to G1750 |
| 2000 | G440 | PRT | *Arabidopsis thaliana* | Paralogous to G1750 |
| 2001 | G448 | DNA | *Arabidopsis thaliana* | Predicted polypeptide sequence is paralogous to G450 |
| 2002 | G448 | PRT | *Arabidopsis thaliana* | Paralogous to G450 |
| 2003 | G455 | DNA | *Arabidopsis thaliana* | Predicted polypeptide sequence is paralogous to G450 |
| 2004 | G455 | PRT | *Arabidopsis thaliana* | Paralogous to G450 |
| 2005 | G456 | DNA | *Arabidopsis thaliana* | Predicted polypeptide sequence is paralogous to G450 |
| 2006 | G456 | PRT | *Arabidopsis thaliana* | Paralogous to G450 |
| 2007 | G463 | DNA | *Arabidopsis thaliana* | Predicted polypeptide sequence is paralogous to G464 |
| 2008 | G463 | PRT | *Arabidopsis thaliana* | Paralogous to G464 |
| 2009 | G485 | DNA | *Arabidopsis thaliana* | Predicted polypeptide sequence is paralogous to G481, G482 |
| 2010 | G485 | PRT | *Arabidopsis thaliana* | Paralogous to G481, G482 |
| 2011 | G501 | DNA | *Arabidopsis thaliana* | Predicted polypeptide sequence is paralogous to G519 |
| 2012 | G501 | PRT | *Arabidopsis thaliana* | Paralogous to G519 |
| 2013 | G502 | DNA | *Arabidopsis thaliana* | Predicted polypeptide sequence is paralogous to G519 |
| 2014 | G502 | PRT | *Arabidopsis thaliana* | Paralogous to G519 |
| 2015 | G512 | DNA | *Arabidopsis thaliana* | Predicted polypeptide sequence is paralogous to G1452 |
| 2016 | G512 | PRT | *Arabidopsis thaliana* | Paralogous to G1452 |
| 2017 | G515 | DNA | *Arabidopsis thaliana* | Predicted polypeptide sequence is paralogous to G2053 |
| 2018 | G515 | PRT | *Arabidopsis thaliana* | Paralogous to G2053 |
| 2019 | G516 | DNA | *Arabidopsis thaliana* | Predicted polypeptide sequence is paralogous to G2053 |
| 2020 | G516 | PRT | *Arabidopsis thaliana* | Paralogous to G2053 |
| 2021 | G517 | DNA | *Arabidopsis thaliana* | Predicted polypeptide sequence is paralogous to G2053 |
| 2022 | G517 | PRT | *Arabidopsis thaliana* | Paralogous to G2053 |
| 2023 | G554 | DNA | *Arabidopsis thaliana* | Predicted polypeptide sequence is paralogous to G1198 |
| 2024 | G554 | PRT | *Arabidopsis thaliana* | Paralogous to G1198 |
| 2025 | G555 | DNA | *Arabidopsis thaliana* | Predicted polypeptide sequence is paralogous to G1198 |
| 2026 | G555 | PRT | *Arabidopsis thaliana* | Paralogous to G1198 |
| 2027 | G556 | DNA | *Arabidopsis thaliana* | Predicted polypeptide sequence is paralogous to G1198 |
| 2028 | G556 | PRT | *Arabidopsis thaliana* | Paralogous to G1198 |
| 2029 | G558 | DNA | *Arabidopsis thaliana* | Predicted polypeptide sequence is paralogous to G1198 |
| 2030 | G558 | PRT | *Arabidopsis thaliana* | Paralogous to G1198 |
| 2031 | G578 | DNA | *Arabidopsis thaliana* | Predicted polypeptide sequence is paralogous to G1198 |
| 2032 | G578 | PRT | *Arabidopsis thaliana* | Paralogous to G1198 |
| 2033 | G580 | DNA | *Arabidopsis thaliana* | Predicted polypeptide sequence is paralogous to G568 |
| 2034 | G580 | PRT | *Arabidopsis thaliana* | Paralogous to G568 |
| 2035 | G586 | DNA | *Arabidopsis thaliana* | Predicted polypeptide sequence is paralogous to G585 |
| 2036 | G586 | PRT | *Arabidopsis thaliana* | Paralogous to G585 |
| 2037 | G596 | DNA | *Arabidopsis thaliana* | Predicted polypeptide sequence is paralogous to G2789 |
| 2038 | G596 | PRT | *Arabidopsis thaliana* | Paralogous to G2789 |
| 2039 | G605 | DNA | *Arabidopsis thaliana* | Predicted polypeptide sequence is paralogous to G1944 |
| 2040 | G605 | PRT | *Arabidopsis thaliana* | Paralogous to G1944 |
| 2041 | G610 | DNA | *Arabidopsis thaliana* | Predicted polypeptide sequence is paralogous to G849 |
| 2042 | G610 | PRT | *Arabidopsis thaliana* | Paralogous to G849 |
| 2043 | G629 | DNA | *Arabidopsis thaliana* | Predicted polypeptide sequence is paralogous to G1198 |
| 2044 | G629 | PRT | *Arabidopsis thaliana* | Paralogous to G1198 |
| 2045 | G659 | DNA | *Arabidopsis thaliana* | Predicted polypeptide sequence is paralogous to G1323 |
| 2046 | G659 | PRT | *Arabidopsis thaliana* | Paralogous to G1323 |
| 2047 | G666 | DNA | *Arabidopsis thaliana* | Predicted polypeptide sequence is paralogous to G256 |
| 2048 | G666 | PRT | *Arabidopsis thaliana* | Paralogous to G256 |
| 2049 | G668 | DNA | *Arabidopsis thaliana* | Predicted polypeptide sequence is paralogous to G256 |
| 2050 | G668 | PRT | *Arabidopsis thaliana* | Paralogous to G256 |
| 2051 | G671 | DNA | *Arabidopsis thaliana* | Predicted polypeptide sequence is paralogous to G2340 |
| 2052 | G671 | PRT | *Arabidopsis thaliana* | Paralogous to G2340 |
| 2053 | G714 | DNA | *Arabidopsis thaliana* | Predicted polypeptide sequence is paralogous to G489 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 2054 | G714 | PRT | Arabidopsis thaliana | Paralogous to G489 |
| 2055 | G729 | DNA | Arabidopsis thaliana | Predicted polypeptide sequence is paralogous to G1040 |
| 2056 | G729 | PRT | Arabidopsis thaliana | Paralogous to G1040 |
| 2057 | G730 | DNA | Arabidopsis thaliana | Predicted polypeptide sequence is paralogous to G1040 |
| 2058 | G730 | PRT | Arabidopsis thaliana | Paralogous to G1040 |
| 2059 | G767 | DNA | Arabidopsis thaliana | Predicted polypeptide sequence is paralogous to G519 |
| 2060 | G767 | PRT | Arabidopsis thaliana | Paralogous to G519 |
| 2061 | G839 | DNA | Arabidopsis thaliana | Predicted polypeptide sequence is paralogous to G1196 |
| 2062 | G839 | PRT | Arabidopsis thaliana | Paralogous to G1196 |
| 2063 | G861 | DNA | Arabidopsis thaliana | Predicted polypeptide sequence is paralogous to G1140 |
| 2064 | G861 | PRT | Arabidopsis thaliana | Paralogous to G1140 |
| 2065 | G932 | DNA | Arabidopsis thaliana | Predicted polypeptide sequence is paralogous to G256 |
| 2066 | G932 | PRT | Arabidopsis thaliana | Paralogous to G256 |
| 2067 | G986 | DNA | Arabidopsis thaliana | Predicted polypeptide sequence is paralogous to G881 |
| 2068 | G986 | PRT | Arabidopsis thaliana | Paralogous to G881 |
| 2069 | G990 | DNA | Arabidopsis thaliana | Predicted polypeptide sequence is paralogous to G1451 |
| 2070 | G990 | PRT | Arabidopsis thaliana | Paralogous to G1451 |
| 2071 | G993 | DNA | Arabidopsis thaliana | Predicted polypeptide sequence is paralogous to G867, G1930 |
| 2072 | G993 | PRT | Arabidopsis thaliana | Paralogous to G867, G1930 |
| 2073 | G1006 | DNA | Arabidopsis thaliana | Predicted polypeptide sequence is paralogous to G28 |
| 2074 | G1006 | PRT | Arabidopsis thaliana | Paralogous to G28 |
| 2075 | G1008 | DNA | Arabidopsis thaliana | Predicted polypeptide sequence is paralogous to G2130 |
| 2076 | G1008 | PRT | Arabidopsis thaliana | Paralogous to G2130 |
| 2077 | G1067 | DNA | Arabidopsis thaliana | Predicted polypeptide sequence is paralogous to G1073 |
| 2078 | G1067 | PRT | Arabidopsis thaliana | Paralogous to G1073 |
| 2079 | G1076 | DNA | Arabidopsis thaliana | Predicted polypeptide sequence is paralogous to G1075 |
| 2080 | G1076 | PRT | Arabidopsis thaliana | Paralogous to G1075 |
| 2081 | G1136 | DNA | Arabidopsis thaliana | Predicted polypeptide sequence is paralogous to G584 |
| 2082 | G1136 | PRT | Arabidopsis thaliana | Paralogous to G584 |
| 2083 | G1149 | DNA | Arabidopsis thaliana | Predicted polypeptide sequence is paralogous to G1146 |
| 2084 | G1149 | PRT | Arabidopsis thaliana | Paralogous to G1146 |
| 2085 | G1152 | DNA | Arabidopsis thaliana | Predicted polypeptide sequence is paralogous to G1146 |
| 2086 | G1152 | PRT | Arabidopsis thaliana | Paralogous to G1146 |
| 2087 | G1211 | DNA | Arabidopsis thaliana | Predicted polypeptide sequence is paralogous to G291 |
| 2088 | G1211 | PRT | Arabidopsis thaliana | Paralogous to G291 |
| 2089 | G1277 | DNA | Arabidopsis thaliana | Predicted polypeptide sequence is paralogous to G24 |
| 2090 | G1277 | PRT | Arabidopsis thaliana | Paralogous to G24 |
| 2091 | G1290 | DNA | Arabidopsis thaliana | Predicted polypeptide sequence is paralogous to G278 |
| 2092 | G1290 | PRT | Arabidopsis thaliana | Paralogous to G278 |
| 2093 | G1329 | DNA | Arabidopsis thaliana | Predicted polypeptide sequence is paralogous to G663 |
| 2094 | G1329 | PRT | Arabidopsis thaliana | Paralogous to G663 |
| 2095 | G1335 | DNA | Arabidopsis thaliana | Predicted polypeptide sequence is paralogous to G652 |
| 2096 | G1335 | PRT | Arabidopsis thaliana | Paralogous to G652 |
| 2097 | G1349 | DNA | Arabidopsis thaliana | Predicted polypeptide sequence is paralogous to G896 |
| 2098 | G1349 | PRT | Arabidopsis thaliana | Paralogous to G896 |
| 2099 | G1357 | DNA | Arabidopsis thaliana | Predicted polypeptide sequence is paralogous to G1452 |
| 2100 | G1357 | PRT | Arabidopsis thaliana | Paralogous to G1452 |
| 2101 | G1364 | DNA | Arabidopsis thaliana | Predicted polypeptide sequence is paralogous to G481, G482 |
| 2102 | G1364 | PRT | Arabidopsis thaliana | Paralogous to G481, G482 |
| 2103 | G1379 | DNA | Arabidopsis thaliana | Predicted polypeptide sequence is paralogous to G24 |
| 2104 | G1379 | PRT | Arabidopsis thaliana | Paralogous to G24 |
| 2105 | G1387 | DNA | Arabidopsis thaliana | Predicted polypeptide sequence is paralogous to G975, G2583 |
| 2106 | G1387 | PRT | Arabidopsis thaliana | Paralogous to G975, G2583 |
| 2107 | G1425 | DNA | Arabidopsis thaliana | Predicted polypeptide sequence is paralogous to G504 |
| 2108 | G1425 | PRT | Arabidopsis thaliana | Paralogous to G504 |
| 2109 | G1454 | DNA | Arabidopsis thaliana | Predicted polypeptide sequence is paralogous to G504 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 2110 | G1454 | PRT | Arabidopsis thaliana | Paralogous to G504 |
| 2111 | G1456 | DNA | Arabidopsis thaliana | Predicted polypeptide sequence is paralogous to G1927 |
| 2112 | G1456 | PRT | Arabidopsis thaliana | Paralogous to G1927 |
| 2113 | G1461 | DNA | Arabidopsis thaliana | Predicted polypeptide sequence is paralogous to G1463 |
| 2114 | G1461 | PRT | Arabidopsis thaliana | Paralogous to G1463 |
| 2115 | G1462 | DNA | Arabidopsis thaliana | Predicted polypeptide sequence is paralogous to G1463 |
| 2116 | G1462 | PRT | Arabidopsis thaliana | Paralogous to G1463 |
| 2117 | G1464 | DNA | Arabidopsis thaliana | Predicted polypeptide sequence is paralogous to G1463 |
| 2118 | G1464 | PRT | Arabidopsis thaliana | Paralogous to G1463 |
| 2119 | G1465 | DNA | Arabidopsis thaliana | Predicted polypeptide sequence is paralogous to G1463 |
| 2120 | G1465 | PRT | Arabidopsis thaliana | Paralogous to G1463 |
| 2121 | G1484 | DNA | Arabidopsis thaliana | Predicted polypeptide sequence is paralogous to G1255 |
| 2122 | G1484 | PRT | Arabidopsis thaliana | Paralogous to G1255 |
| 2123 | G1548 | DNA | Arabidopsis thaliana | Predicted polypeptide sequence is paralogous to G390, G391, G438 |
| 2124 | G1548 | PRT | Arabidopsis thaliana | Paralogous to G390, G391, G438 |
| 2125 | G1646 | DNA | Arabidopsis thaliana | Predicted polypeptide sequence is paralogous to G715 |
| 2126 | G1646 | PRT | Arabidopsis thaliana | Paralogous to G715 |
| 2127 | G1664 | DNA | Arabidopsis thaliana | Predicted polypeptide sequence is paralogous to G1062 |
| 2128 | G1664 | PRT | Arabidopsis thaliana | Paralogous to G1062 |
| 2129 | G1759 | DNA | Arabidopsis thaliana | Predicted polypeptide sequence is paralogous to G157, G859, G1842, G1843 |
| 2130 | G1759 | PRT | Arabidopsis thaliana | Paralogous to G157, G859, G1842, G1843 |
| 2131 | G1782 | DNA | Arabidopsis thaliana | Predicted polypeptide sequence is paralogous to G1363 |
| 2132 | G1782 | PRT | Arabidopsis thaliana | Paralogous to G1363 |
| 2133 | G1791 | DNA | Arabidopsis thaliana | Predicted polypeptide sequence is paralogous to G1792 |
| 2134 | G1791 | PRT | Arabidopsis thaliana | Paralogous to G1792 |
| 2135 | G1795 | DNA | Arabidopsis thaliana | Predicted polypeptide sequence is paralogous to G1792 |
| 2136 | G1795 | PRT | Arabidopsis thaliana | Paralogous to G1792 |
| 2137 | G1806 | DNA | Arabidopsis thaliana | Predicted polypeptide sequence is paralogous to G1198 |
| 2138 | G1806 | PRT | Arabidopsis thaliana | Paralogous to G1198 |
| 2139 | G1808 | DNA | Arabidopsis thaliana | Predicted polypeptide sequence is paralogous to G1047 |
| 2140 | G1808 | PRT | Arabidopsis thaliana | Paralogous to G1047 |
| 2141 | G1816 | DNA | Arabidopsis thaliana | Predicted polypeptide sequence is paralogous to G226, G682 |
| 2142 | G1816 | PRT | Arabidopsis thaliana | Paralogous to G226, G682 |
| 2143 | G1839 | DNA | Arabidopsis thaliana | Predicted polypeptide sequence is paralogous to G1749 |
| 2144 | G1839 | PRT | Arabidopsis thaliana | Paralogous to G1749 |
| 2145 | G1844 | DNA | Arabidopsis thaliana | Predicted polypeptide sequence is paralogous to G157, G859, G1842, G1843 |
| 2146 | G1844 | PRT | Arabidopsis thaliana | Paralogous to G157, G859, G1842, G1843 |
| 2147 | G1888 | DNA | Arabidopsis thaliana | Predicted polypeptide sequence is paralogous to G1482 |
| 2148 | G1888 | PRT | Arabidopsis thaliana | Paralogous to G1482 |
| 2149 | G1889 | DNA | Arabidopsis thaliana | Predicted polypeptide sequence is paralogous to G353, G354 |
| 2150 | G1889 | PRT | Arabidopsis thaliana | Paralogous to G353, G354 |
| 2151 | G1929 | DNA | Arabidopsis thaliana | Predicted polypeptide sequence is paralogous to G1478 |
| 2152 | G1929 | PRT | Arabidopsis thaliana | Paralogous to G1478 |
| 2153 | G1945 | DNA | Arabidopsis thaliana | Predicted polypeptide sequence is paralogous to G2155 |
| 2154 | G1945 | PRT | Arabidopsis thaliana | Paralogous to G2155 |
| 2155 | G1974 | DNA | Arabidopsis thaliana | Predicted polypeptide sequence is paralogous to G353, G354 |
| 2156 | G1974 | PRT | Arabidopsis thaliana | Paralogous to G353, G354 |
| 2157 | G1995 | DNA | Arabidopsis thaliana | Predicted polypeptide sequence is paralogous to G361, G362 |
| 2158 | G1995 | PRT | Arabidopsis thaliana | Paralogous to G361, G362 |
| 2159 | G1998 | DNA | Arabidopsis thaliana | Predicted polypeptide sequence is paralogous to G325 |
| 2160 | G1998 | PRT | Arabidopsis thaliana | Paralogous to G325 |
| 2161 | G2107 | DNA | Arabidopsis thaliana | Predicted polypeptide sequence is paralogous to G912, G913 |
| 2162 | G2107 | PRT | Arabidopsis thaliana | Paralogous to G912, G913 |
| 2163 | G2131 | DNA | Arabidopsis thaliana | Predicted polypeptide sequence is paralogous to G979 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 2164 | G2131 | PRT | Arabidopsis thaliana | Paralogous to G979 |
| 2165 | G2156 | DNA | Arabidopsis thaliana | Predicted polypeptide sequence is paralogous to G1073 |
| 2166 | G2156 | PRT | Arabidopsis thaliana | Paralogous to G1073 |
| 2167 | G2184 | DNA | Arabidopsis thaliana | Predicted polypeptide sequence is paralogous to G1927 |
| 2168 | G2184 | PRT | Arabidopsis thaliana | Paralogous to G1927 |
| 2169 | G2334 | DNA | Arabidopsis thaliana | Predicted polypeptide sequence is paralogous to G1863 |
| 2170 | G2334 | PRT | Arabidopsis thaliana | Paralogous to G1863 |
| 2171 | G2345 | DNA | Arabidopsis thaliana | Predicted polypeptide sequence is paralogous to G481, G482 |
| 2172 | G2345 | PRT | Arabidopsis thaliana | Paralogous to G481, G482 |
| 2173 | G2421 | DNA | Arabidopsis thaliana | Predicted polypeptide sequence is paralogous to G663 |
| 2174 | G2421 | PRT | Arabidopsis thaliana | Paralogous to G663 |
| 2175 | G2422 | DNA | Arabidopsis thaliana | Predicted polypeptide sequence is paralogous to G663 |
| 2176 | G2422 | PRT | Arabidopsis thaliana | Paralogous to G663 |
| 2177 | G2423 | DNA | Arabidopsis thaliana | Predicted polypeptide sequence is paralogous to G1330 |
| 2178 | G2423 | PRT | Arabidopsis thaliana | Paralogous to G1330 |
| 2179 | G2424 | DNA | Arabidopsis thaliana | Predicted polypeptide sequence is paralogous to G1645 |
| 2180 | G2424 | PRT | Arabidopsis thaliana | Paralogous to G1645 |
| 2181 | G2432 | DNA | Arabidopsis thaliana | Predicted polypeptide sequence is paralogous to G736 |
| 2182 | G2432 | PRT | Arabidopsis thaliana | Paralogous to G736 |
| 2183 | G2513 | DNA | Arabidopsis thaliana | Predicted polypeptide sequence is paralogous to G912, G913 |
| 2184 | G2513 | PRT | Arabidopsis thaliana | Paralogous to G912, G913 |
| 2185 | G2535 | DNA | Arabidopsis thaliana | Predicted polypeptide sequence is paralogous to G961 |
| 2186 | G2535 | PRT | Arabidopsis thaliana | Paralogous to G961 |
| 2187 | G2545 | DNA | Arabidopsis thaliana | Predicted polypeptide sequence is paralogous to G427 |
| 2188 | G2545 | PRT | Arabidopsis thaliana | Paralogous to G427 |
| 2189 | G2631 | DNA | Arabidopsis thaliana | Predicted polypeptide sequence is paralogous to G484 |
| 2190 | G2631 | PRT | Arabidopsis thaliana | Paralogous to G484 |
| 2191 | G2718 | DNA | Arabidopsis thaliana | Predicted polypeptide sequence is paralogous to G226, G682 |
| 2192 | G2718 | PRT | Arabidopsis thaliana | Paralogous to G226, G682 |
| 2193 | G2776 | DNA | Arabidopsis thaliana | Predicted polypeptide sequence is paralogous to G1652 |
| 2194 | G2776 | PRT | Arabidopsis thaliana | Paralogous to G1652 |
| 2195 | G2826 | DNA | Arabidopsis thaliana | Predicted polypeptide sequence is paralogous to G361, G362 |
| 2196 | G2826 | PRT | Arabidopsis thaliana | Paralogous to G361, G362 |
| 2197 | G2838 | DNA | Arabidopsis thaliana | Predicted polypeptide sequence is paralogous to G361, G362 |
| 2198 | G2838 | PRT | Arabidopsis thaliana | Paralogous to G361, G362 |
| 2199 | G2839 | DNA | Arabidopsis thaliana | Predicted polypeptide sequence is paralogous to G353, G354 |
| 2200 | G2839 | PRT | Arabidopsis thaliana | Paralogous to G353, G354 |
| 2201 | G3010 | DNA | Arabidopsis thaliana | Predicted polypeptide sequence is paralogous to G987 |
| 2202 | G3010 | PRT | Arabidopsis thaliana | Paralogous to G987 |

Molecular Modeling

Another means that may be used to confirm the utility and function of transcription factor sequences that are orthologous or paralogous to presently disclosed transcription factors is through the use of molecular modeling software. Molecular modeling is routinely used to predict polypeptide structure, and a variety of protein structure modeling programs, such as "Insight II" (Accelrys, Inc.) are commercially available for this purpose. Modeling can thus be used to predict which residues of a polypeptide can be changed without altering function (Crameri et al. (2003) U.S. Pat. No. 6,521,453). Thus, polypeptides that are sequentially similar can be shown to have a high likelihood of similar function by their structural similarity, which may, for example, be established by comparison of regions of superstructure. The relative tendencies of amino acids to form regions of superstructure (for example, helixes and β-sheets) are well established. For example, O'Neil et al. (1990) Science 250: 646-651) have discussed in detail the helix forming tendencies of amino acids. Tables of relative structure forming activity for amino acids can be used as substitution tables to predict which residues can be functionally substituted in a given region, for example, in DNA-binding domains of known transcription factors and equivalogs. Homologs that are likely to be functionally similar can then be identified.

Of particular interest is the structure of a transcription factor in the region of its conserved domain, such as those identified in Table 5. Structural analyses may be performed by comparing the structure of the known transcription factor around its conserved domain with those of orthologs and paralogs. Analysis of a number of polypeptides within a transcription factor group or clade, including the functionally or sequentially similar polypeptides provided in the Sequence Listing, may also provide an understanding of structural elements required to regulate transcription within a given family.

EXAMPLES

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

The complete descriptions of the traits associated with each polynucleotide of the invention are fully disclosed in Table 4 and Table 6. The complete description of the transcription factor gene family and identified conserved domains of the polypeptide encoded by the polynucleotide is fully disclosed in Table 5.

Example I

Full Length Gene Identification and Cloning

Putative transcription factor sequences (genomic or ESTs) related to known transcription factors were identified in the *Arabidopsis thaliana* GenBank database using the tblastn sequence analysis program using default parameters and a P-value cutoff threshold of −4 or −5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$P dCTP using the High Prime DNA Labeling Kit (Boehringer Mannheim Corp. (now Roche Diagnostics Corp., Indianapolis, Ind.). Purified radiolabelled probes were added to filters immersed in Church hybridization medium (0.5 M NaPO$_4$ pH 7.0, 7% SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the MARATHON cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the MARATHON Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Construction of Expression Vectors

The sequence was amplified from a genomic or cDNA library using primers specific to sequences upstream and downstream of the coding region. The expression vector was pMEN20 or pMEN65, which are both derived from pMON316 (Sanders et al. (1987) *Nucleic Acids Res.* 15:1543-1558) and contain the CaMV 35S promoter to express transgenes. To clone the sequence into the vector, both pMEN20 and the amplified DNA fragment were digested separately with SalI and NotI restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a QIAQUICK gel extraction kit (Qiagen, Valencia Calif.). The fragments of interest were ligated at a ratio of 3:1 (vector to insert). Ligation reactions using T4 DNA ligase (New England Biolabs, Beverly Mass.) were carried out at 16° C. for 16 hours. The ligated DNAs were transformed into competent cells of the *E. coli* strain DH5alpha by using the heat shock method. The transformations were plated on LB plates containing 50 mg/l kanamycin (Sigma Chemical Co. St. Louis Mo.). Individual colonies were grown overnight in five milliliters of LB broth containing 50 mg/l kanamycin at 37° C. Plasmid DNA was purified by using Qiaquick Mini Prep kits (Qiagen).

Example III

Transformation of *Agrobacterium* with the Expression Vector

After the plasmid vector containing the gene was constructed, the vector was used to transform *Agrobacterium tumefaciens* cells expressing the gene products. The stock of *Agrobacterium tumefaciens* cells for transformation were made as described by Nagel et al. (1990) *FEMS Microbiol Letts.* 67: 325-328. *Agrobacterium* strain ABI was grown in 250 ml LB medium (Sigma) overnight at 28° C. with shaking until an absorbance over 1 cm at 600 nm ($A_{600}$) of 0.5-1.0 was reached. Cells were harvested by centrifugation at 4,000×g for 15 min at 4° C. Cells were then resuspended in 250 μl chilled buffer (1 mM HEPES, pH adjusted to 7.0 with KOH). Cells were centrifuged again as described above and resuspended in 125 μl chilled buffer. Cells were then centrifuged and resuspended two more times in the same HEPES buffer as described above at a volume of 100 μl and 750 μl, respectively. Resuspended cells were then distributed into 40 μl aliquots, quickly frozen in liquid nitrogen, and stored at −80° C.

*Agrobacterium* cells were transformed with plasmids prepared as described above following the protocol described by Nagel et al. (supra). For each DNA construct to be transformed, 50-100 ng DNA (generally resuspended in 10 mM Tris-HCl, 1 mM EDTA, pH 8.0) was mixed with 40 μl of *Agrobacterium* cells. The DNA/cell mixture was then transferred to a chilled cuvette with a 2 mm electrode gap and subject to a 2.5 kV charge dissipated at 25 μF and 200 μF using a Gene Pulser II apparatus (Bio-Rad, Hercules, Calif.). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 μg/ml spectinomycin (Sigma) and incubated for 24-48 hours at 28° C. Single colonies were then picked and inoculated in fresh medium. The presence of the plasmid construct was verified by PCR amplification and sequence analysis.

Example IV

Transformation of *Arabidopsis* Plants with *Agrobacterium tumefaciens* with Expression Vector After transformation of *Agrobacterium tumefaciens* with plasmid vectors containing the gene, single *Agrobacterium* colonies were identified, propagated, and used to transform *Arabidopsis* plants. Briefly, 500 ml cultures of LB medium containing 50 mg/l kanamycin were inoculated with the colonies and grown at 28° C. with shaking for 2 days until an optical absorbance at 600 nm wavelength over 1 cm ($A_{600}$) of >2.0 is reached. Cells were then harvested by centrifugation at 4,000×g for 10 min, and resuspended in infiltration medium (½× Murashige and Skoog salts (Sigma), 1× Gamborg's B-5 vitamins (Sigma), 5.0% (w/v) sucrose (Sigma), 0.044 µM benzylamino purine (Sigma), 200 µl/l Silwet L-77 (Lehle Seeds) until an $A_{600}$ of 0.8 was reached.

Prior to transformation, *Arabidopsis thaliana* seeds (ecotype Columbia) were sown at a density of ~10 plants per 4" pot onto Pro-Mix BX potting medium (Hummert International) covered with fiberglass mesh (18 mm×16 mm). Plants were grown under continuous illumination (50-75 µE/m²/sec) at 22-23° C. with 65-70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of *Agrobacterium* infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

Example V

Identification of *Arabidopsis* Primary Transformants

Seeds collected from the transformation pots were sterilized essentially as follows. Seeds were dispersed into in a solution containing 0.1% (v/v) Triton X-100 (Sigma) and sterile water and washed by shaking the suspension for 20 min. The wash solution was then drained and replaced with fresh wash solution to wash the seeds for 20 min with shaking. After removal of the ethanol/detergent solution, a solution containing 0.1% (v/v) Triton X-100 and 30% (v/v) bleach (CLOROX; Clorox Corp. Oakland Calif.) was added to the seeds, and the suspension was shaken for 10 min. After removal of the bleach/detergent solution, seeds were then washed five times in sterile distilled water. The seeds were stored in the last wash water at 4° C. for 2 days in the dark before being plated onto antibiotic selection medium (1× Murashige and Skoog salts (pH adjusted to 5.7 with 1M KOH), 1× Gamborg's B-5 vitamins, 0.9% phytagar (Life Technologies), and 50 mg/l kanamycin). Seeds were germinated under continuous illumination (50-75 µE/m²/sec) at 22-23° C. After 7-10 days of growth under these conditions, kanamycin resistant primary transformants ($T_1$ generation) were visible and obtained. These seedlings were transferred first to fresh selection plates where the seedlings continued to grow for 3-5 more days, and then to soil (Pro-Mix BX potting medium).

Primary transformants were crossed and progeny seeds ($T_2$) collected; kanamycin resistant seedlings were selected and analyzed. The expression levels of the recombinant polynucleotides in the transformants varies from about a 5% expression level increase to a least a 100% expression level increase. Similar observations are made with respect to polypeptide level expression.

Example VI

Identification of *Arabidopsis* Plants with Transcription Factor Gene Knockouts The screening of insertion mutagenized *Arabidopsis* collections for null mutants in a known target gene was essentially as described in Krysan et al. (1999) *Plant Cell* 11: 2283-2290. Briefly, gene-specific primers, nested by 5-250 base pairs to each other, were designed from the 5' and 3' regions of a known target gene. Similarly, nested sets of primers were also created specific to each of the T-DNA or transposon ends (the "right" and "left" borders). All possible combinations of gene specific and T-DNA/transposon primers were used to detect by PCR an insertion event within or close to the target gene. The amplified DNA fragments were then sequenced which allows the precise determination of the T-DNA/transposon insertion point relative to the target gene. Insertion events within the coding or intervening sequence of the genes were deconvoluted from a pool comprising a plurality of insertion events to a single unique mutant plant for functional characterization. The method is described in more detail in Yu and Adam, U.S. application Ser. No. 09/177,733 filed Oct. 23, 1998.

Example VII

Identification of Modified Phenotypes in Overexpression or Gene Knockout Plants Experiments were performed to identify those transformants or knockouts that exhibited modified biochemical characteristics. Among the biochemicals that were assayed were insoluble sugars, such as arabinose, fucose, galactose, mannose, rhamnose or xylose or the like; prenyl lipids, such as lutein, beta-carotene, xanthophyll-1, xanthophyll-2, chlorophylls A or B, or alpha-, delta- or gamma-tocopherol or the like; fatty acids, such as 16:0 (palmitic acid), 16:1 (palmitoleic acid), 18:0 (stearic acid), 18:1 (oleic acid), 18:2 (linoleic acid), 20:0, 18:3 (linolenic acid), 20:1 (eicosenoic acid), 20:2, 22:1 (erucic acid) or the like; waxes, such as by altering the levels of C29, C31, or C33 alkanes; sterols, such as brassicasterol, campesterol, stigmasterol, sitosterol or stigmastanol or the like, glucosinolates, protein or oil levels.

Fatty acids were measured using two methods depending on whether the tissue was from leaves or seeds. For leaves, lipids were extracted and esterified with hot methanolic $H_2SO_4$ and partitioned into hexane from methanolic brine. For seed fatty acids, seeds were pulverized and extracted in methanol:heptane:toluene:2,2-dimethoxypropane:$H_2SO_4$ (39:34:20:5:2) for 90 minutes at 80° C. After cooling to room temperature the upper phase, containing the seed fatty acid esters, was subjected to GC analysis. Fatty acid esters from both seed and leaf tissues were analyzed with a SUPELCO SP-2330 column (Supelco, Bellefonte, Pa.).

Glucosinolates were purified from seeds or leaves by first heating the tissue at 95° C. for 10 minutes. Preheated ethanol:water (50:50) is added and after heating at 95° C. for a further 10 minutes, the extraction solvent is applied to a DEAE Sephadex column (Pharmacia) which had been previously equilibrated with 0.5 M pyridine acetate. Desulfoglucosinolates were eluted with 300 ul water and analyzed by reverse phase HPLC monitoring at 226 nm.

For wax alkanes, samples were extracted using an identical method as fatty acids and extracts were analyzed on a HP 5890 GC coupled with a 5973 MSD. Samples were chromatographically isolated on a J&W DB35 mass spectrometer (J&W Scientific Agilent Technologies, Folsom, Calif.).

To measure prenyl lipid levels, seeds or leaves were pulverized with 1 to 2% pyrogallol as an antioxidant. For seeds, extracted samples were filtered and a portion removed for tocopherol and carotenoid/chlorophyll analysis by HPLC. The remaining material was saponified for sterol determination. For leaves, an aliquot was removed and diluted with methanol and chlorophyll A, chlorophyll B, and total carotenoids measured by spectrophotometry by determining optical absorbance at 665.2 nm, 652.5 nm, and 470 nm. An aliquot was removed for tocopherol and carotenoid/chlorophyll composition by HPLC using a Waters μBondapak C18 column (4.6 mm×150 mm). The remaining methanolic solution was saponified with 10% KOH at 80° C. for one hour. The samples were cooled and diluted with a mixture of methanol and water. A solution of 2% methylene chloride in hexane was mixed in and the samples were centrifuged. The aqueous methanol phase was again re-extracted 2% methylene chloride in hexane and, after centrifugation, the two upper phases were combined and evaporated. 2% methylene chloride in hexane was added to the tubes and the samples were then extracted with one ml of water. The upper phase was removed, dried, and resuspended in 400 ul of 2% methylene chloride in hexane and analyzed by gas chromatography using a 50 m DB-5 ms (0.25 mm ID, 0.25 um phase, J&W Scientific).

Insoluble sugar levels were measured by the method essentially described by Reiter et al. (1999), *Plant J.* 12: 335-345. This method analyzes the neutral sugar composition of cell wall polymers found in *Arabidopsis* leaves. Soluble sugars were separated from sugar polymers by extracting leaves with hot 70% ethanol. The remaining residue containing the insoluble polysaccharides was then acid hydrolyzed with allose added as an internal standard. Sugar monomers generated by the hydrolysis were then reduced to the corresponding alditols by treatment with NaBH4, then were acetylated to generate the volatile alditol acetates which were then analyzed by GC-FID. Identity of the peaks was determined by comparing the retention times of known sugars converted to the corresponding alditol acetates with the retention times of peaks from wild-type plant extracts. Alditol acetates were analyzed on a Supelco SP-2330 capillary column (30 m×250 μm×0.2 μm) using a temperature program beginning at 180° C. for 2 minutes followed by an increase to 220° C. in 4 minutes. After holding at 220° C. for 10 minutes, the oven temperature is increased to 240° C. in 2 minutes and held at this temperature for 10 minutes and brought back to room temperature.

To identify plants with alterations in total seed oil or protein content, 150 mg of seeds from T2 progeny plants were subjected to analysis by Near Infrared Reflectance Spectroscopy SIRS) using a Foss NirSystems Model 6500 with a spinning cup transport system. NIRS is a non-destructive analytical method used to determine seed oil and protein composition. Infrared is the region of the electromagnetic spectrum located after the visible region in the direction of longer wavelengths. 'Near infrared' owns its name for being the infrared region near to the visible region of the electromagnetic spectrum. For practical purposes, near infrared comprises wavelengths between 800 and 2500 nm. NIRS is applied to organic compounds rich in O—H bonds (such as moisture, carbohydrates, and fats), C—H bonds (such as organic compounds and petroleum derivatives), and N—H bonds (such as proteins and amino acids). The NIRS analytical instruments operate by statistically correlating NIRS signals at several wavelengths with the characteristic or property intended to be measured. All biological substances contain thousands of C—H, O—H, and N—H bonds. Therefore, the exposure to near infrared radiation of a biological sample, such as a seed, results in a complex spectrum which contains qualitative and quantitative information about the physical and chemical composition of that sample.

The numerical value of a specific analyte in the sample, such as protein content or oil content, is mediated by a calibration approach known as chemometrics. Chemometrics applies statistical methods such as multiple linear regression (MLR), partial least squares (PLS), and principle component analysis (PCA) to the spectral data and correlates them with a physical property or other factor, that property or factor is directly determined rather than the analyte concentration itself. The method first provides "wet chemistry" data of the samples required to develop the calibration.

Calibration of NIRS response was performed using data obtained by wet chemical analysis of a population of *Arabidopsis* ecotypes that were expected to represent diversity of oil and protein levels.

The exact oil composition of each ecotype used in the calibration experiment was performed using gravimetric analysis of oils extracted from seed samples (0.5 g or 1.0 g) by the accelerated solvent extraction method (ASE; Dionex Corp, Sunnyvale, Calif.). The extraction method was validated against certified canola samples (Community Bureau of Reference, Belgium). Seed samples from each ecotype (0.5 g or 1 g) were subjected to accelerated solvent extraction and the resulting extracted oil weights compared to the weight of oil recovered from canola seed that has been certified for oil content (Community Bureau of Reference). The oil calibration equation was based on 57 samples with a range of oil contents from 27.0% to 50.8%. To check the validity of the calibration curve, an additional set of samples was extracted by ASE and predicted using the oil calibration equation. This validation set counted 46 samples, ranging from 27.9% to 47.5% oil, and had a predicted standard error of performance of 0.63%. The wet chemical method for protein was elemental analysis (% N×6.0) using the average of 3 representative samples of 5 mg each validated against certified ground corn (NIST). The instrumentation was an Elementar Vario-EL III elemental analyzer operated in CNS operating mode (Elementar Analysensysteme GmbH, Hanau, Germany).

The protein calibration equation was based on a library of 63 samples with a range of protein contents from 17.4% to 31.2%. An additional set of samples was analyzed for protein by elemental analysis (n=57) and scanned by NIRS in order to validate the protein prediction equation. The protein range of the validation set was from 16.8% to 31.2% and the standard error of prediction was 0.468%.

NIRS analysis of *Arabidopsis* seed was carried out on between 40-300 mg experimental sample. The oil and protein contents were predicted using the respective calibration equations.

Data obtained from NIRS analysis was analyzed statistically using a nearest-neighbor (N—N) analysis. The N—N analysis allows removal of within-block spatial variability in a fairly flexible fashion, which does not require prior knowledge of the pattern of variability in the chamber. Ideally, all hybrids are grown under identical experimental conditions within a block (rep). In reality, even in many block designs, significant within-block variability exists. Nearest-neighbor procedures are based on assumption that environmental effect of a plot is closely related to that of its neighbors. Nearest-neighbor methods use information from adjacent plots to adjust for within-block heterogeneity and so provide more precise estimates of treatment means and differences. If there is within-plot heterogeneity on a spatial scale that is larger than a single plot and smaller than the entire block, then yields from adjacent plots will be positively correlated. Information from neighboring plots can be used to reduce or remove the unwanted effect of the spatial heterogeneity, and hence improve the estimate of the treatment effect. Data from neighboring plots can also be used to reduce the influence of competition between adjacent plots. The Papadakis N—N analysis can be used with designs to remove within-block variability that would not be removed with the standard split plot analysis (Papadakis (1973) Inst. d'Amelior. Plantes Thessaloniki (Greece) Bull. *Scientif*. No. 23; Papadakis (1984) *Proc. Acad. Athens* 59: 326-342.

Experiments were performed to identify those transformants or knockouts that exhibited modified sugar-sensing. For such studies, seeds from transformants were germinated on media containing 5% glucose or 9.4% sucrose which normally partially restrict hypocotyl elongation. Plants with altered sugar sensing may have either longer or shorter hypocotyls than normal plants when grown on this media. Additionally, other plant traits may be varied such as root mass.

Experiments may be performed to identify those transformants or knockouts that exhibited an improved pathogen tolerance. For such studies, the transformants are exposed to biotropic fungal pathogens, such as *Erysiphe orontii*, and necrotropic fungal pathogens, such as *Fusarium oxysporum*. *Fusarium oxysporum* isolates cause vascular wilts and damping off of various annual vegetables, perennials and weeds (Mauch-Mani and Slusarenko (1994) *Molec Plant-Microbe Interact*. 7: 378-383). For *Fusarium oxysporum* experiments, plants are grown on Petri dishes and sprayed with a fresh spore suspension of *F. oxysporum*. The spore suspension is prepared as follows: A plug of fungal hyphae from a plate culture is placed on a fresh potato dextrose agar plate and allowed to spread for one week. Five ml sterile water is then added to the plate, swirled, and pipetted into 50 ml Armstrong *Fusarium* medium. Spores are grown overnight in *Fusarium* medium and then sprayed onto plants using a Preval paint sprayer. Plant tissue is harvested and frozen in liquid nitrogen 48 hours post-infection.

*Erysiphe orontii* is a causal agent of powdery mildew. For *Erysiphe orontii* experiments, plants are grown approximately 4 weeks in a greenhouse under 12 hour light (20° C., 30% relative humidity (rh)). Individual leaves are infected with *E. orontii* spores from infected plants using a camel's hair brush, and the plants are transferred to a Percival growth chamber (20° C., 80% rh.). Plant tissue is harvested and frozen in liquid nitrogen 7 days post-infection.

*Botrytis cinerea* is a necrotrophic pathogen. *Botrytis cinerea* is grown on potato dextrose agar under 12 hour light (20° C., 30% relative humidity (rh)). A spore culture is made by spreading 10 ml of sterile water on the fungus plate, swirling and transferring spores to 10 ml of sterile water. The spore inoculum (approx. 105 spores/ml) is then used to spray 10 day-old seedlings grown under sterile conditions on MS (minus sucrose) media. Symptoms are evaluated every day up to approximately 1 week.

*Sclerotinia sclerotiorum* hyphal cultures are grown in potato dextrose broth. One gram of hyphae is ground, filtered, spun down and resuspended in sterile water. A 1:10 dilution is used to spray 10 day-old seedlings grown aseptically under a 12 hour light/dark regime on MS (minus sucrose) media. Symptoms are evaluated every day up to approximately 1 week.

*Pseudomonas syringae* pv *maculicola* (Psm) strain 4326 and pv *maculicola* strain 4326 was inoculated by hand at two doses. Two inoculation doses allows the differentiation between plants with enhanced susceptibility and plants with enhanced resistance to the pathogen. Plants are grown for 3 weeks in the greenhouse, then transferred to the growth chamber for the remainder of their growth. Psm ES4326 may be hand inoculated with 1 ml syringe on 3 fully-expanded leaves per plant (4½ wk old), using at least 9 plants per overexpressing line at two inoculation doses, OD=0.005 and OD=0.0005. Disease scoring is performed at day 3 post-inoculation with pictures of the plants and leaves taken in parallel.

In some instances, expression patterns of the pathogen-induced genes (such as defense genes) may be monitored by microarray experiments. In these experiments, cDNAs are generated by PCR and resuspended at a final concentration of ~100 ng/μl in 3×SSC or 150 mM Na-phosphate (Eisen and Brown (1999) *Methods Enzymol*. 303: 179-205). The cDNAs are spotted on microscope glass slides coated with polylysine. The prepared cDNAs are aliquoted into 384 well plates and spotted on the slides using, for example, an x-y-z gantry (OmniGrid) which may be purchased from GeneMachines (Menlo Park, Calif.) outfitted with quill type pins which may be purchased from Telechem International (Sunnyvale, Calif.). After spotting, the arrays are cured for a minimum of one week at room temperature, rehydrated and blocked following the protocol recommended by Eisen and Brown (1999; supra).

Sample total RNA (10 μg) samples are labeled using fluorescent Cy3 and Cy5 dyes. Labeled samples are resuspended in 4×SSC/0.03% SDS/4 μg salmon sperm DNA/2 μg tRNA/50 mM Na-pyrophosphate, heated for 95° C. for 2.5 minutes, spun down and placed on the array. The array is then covered with a glass coverslip and placed in a sealed chamber. The chamber is then kept in a water bath at 62° C. overnight. The arrays are washed as described in Eisen and Brown (1999, supra) and scanned on a General Scanning 3000 laser scanner. The resulting files are subsequently quantified using IMA-GENE, software (BioDiscovery, Los Angeles Calif.).

RT-PCR experiments may be performed to identify those genes induced after exposure to biotropic fungal pathogens, such as *Erysiphe orontii*, necrotrophic fungal pathogens, such as *Fusarium oxysporum*, bacteria, viruses and salicylic acid, the latter being involved in a nonspecific resistance response in *Arabidopsis thaliana*. Generally, the gene expression patterns from ground plant leaf tissue is examined.

Reverse transcriptase PCR was conducted using gene specific primers within the coding region for each sequence identified. The primers were designed near the 3' region of each DNA binding sequence initially identified.

Total RNA from these ground leaf tissues was isolated using the CTAB extraction protocol. Once extracted total RNA was normalized in concentration across all the tissue types to ensure that the PCR reaction for each tissue received the same amount of cDNA template using the 28S band as reference. Poly(A+) RNA was purified using a modified protocol from the Qiagen OLIGOTEX purification kit batch protocol. cDNA was synthesized using standard protocols. After the first strand cDNA synthesis, primers for Actin 2 were used to normalize the concentration of cDNA across the tissue types. Actin 2 is found to be constitutively expressed in fairly equal levels across the tissue types being investigated.

For RT PCR, cDNA template was mixed with corresponding primers and Taq DNA polymerase. Each reaction consisted of 0.2 µl cDNA template, 2 µl 10× Tricine buffer, 2 µl 10× Tricine buffer and 16.8 µl water, 0.05 µl Primer 1, 0.05 µl, Primer 2, 0.3 µl Taq DNA polymerase and 8.6 µl water.

The 96 well plate is covered with microfilm and set in the thermocycler to start the reaction cycle. By way of illustration, the reaction cycle may comprise the following steps:
STEP 1: 93° C. FOR 3 MIN;
Step 2: 93° C. for 30 sec;
Step 3: 65° C. for 1 min;
Step 4: 72° C. for 2 min;
Steps 2, 3 and 4 are repeated for 28 cycles;
Step 5: 72° C. for 5 min; and
Step 6 4° C.

To amplify more products, for example, to identify genes that have very low expression, additional steps may be performed: The following method illustrates a method that may be used in this regard. The PCR plate is placed back in the thermocycler for 8 more cycles of steps 2-4.
Step 2 93° C. for 30 sec;
Step 3 65° C. for 1 min;
Step 4 72° C. for 2 min, repeated for 8 cycles; and
Step 5 4° C.

Eight microliters of PCR product and 1.5 µl of loading dye are loaded on a 1.2% agarose gel for analysis after 28 cycles and 36 cycles. Expression levels of specific transcripts are considered low if they were only detectable after 36 cycles of PCR. Expression levels are considered medium or high depending on the levels of transcript compared with observed transcript levels for an internal control such as actin2. Transcript levels are determined in repeat experiments and compared to transcript levels in control (e.g., non-transformed) plants.

Experiments were performed to identify those transformants or knockouts that exhibited an improved environmental stress tolerance. For such studies, the transformants were exposed to a variety of environmental stresses. Plants were exposed to chilling stress (6 hour exposure to 4-8° C.), heat stress (6 hour exposure to 32-37° C.), high salt stress (6 hour exposure to 200 mM NaCl), drought stress (168 hours after removing water from trays), osmotic stress (6 hour exposure to 3 M mannitol), or nutrient limitation (nitrogen: all components of MS medium remained constant except N was reduced to 20 mg/l of $NH_4NO_3$; phosphate: all components of MS medium except $KH_2PO_4$, which was replaced by $K_2SO_4$; potassium: all components of MS medium except removal of $KNO_3$ and $KH_2PO_4$, which were replaced by $NaH_4PO_4$).

Experiments were performed to identify those transformants or knockouts that exhibited a modified structure and development characteristics. For such studies, the transformants were observed by eye to identify novel structural or developmental characteristics associated with the ectopic expression of the polynucleotides or polypeptides of the invention.

Flowering time was measured by the number of rosette leaves present when a visible inflorescence of approximately 3 cm is apparent. Rosette and total leaf number on the progeny stem are tightly correlated with the timing of flowering (Koornneef et al. (1991) *Mol. Gen. Genet.* 229: 57-66). The vernalization response was also measured. For vernalization treatments, seeds were sown to MS agar plates, sealed with micropore tape, and placed in a 4° C. cold room with low light levels for 6-8 weeks. The plates were then transferred to the growth rooms alongside plates containing freshly sown non-vernalized controls. Rosette leaves were counted when a visible inflorescence of approximately 3 cm was apparent.

Modified phenotypes observed for particular overexpressor or knockout plants are provided in Table 4. For a particular overexpressor that shows a less beneficial characteristic, it may be more useful to select a plant with a decreased expression of the particular transcription factor. For a particular knockout that shows a less beneficial characteristic, it may be more useful to select a plant with an increased expression of the particular transcription factor.

The sequences of the Sequence Listing or those in Tables 4-8, or those disclosed here, can be used to prepare transgenic plants and plants with altered traits. The specific transgenic plants listed below are produced from the sequences of the Sequence Listing, as noted. Table 4 provides exemplary polynucleotide and polypeptide sequences of the invention.

Example VIII

Examples of Genes that Confer Significant Improvements to Plants

A number of genes and homologs that confer significant improvements to knockout or overexpressing plants were noted below. Experimental observations made with regard to specific genes whose expression was modified in overexpressing or knockout plants, and potential applications based on these observations, were also presented.

G8 (SEQ ID NO: 1)
Published Information

G8 corresponds to gene At2g28550 (AAD21489), and was described as RAP2.7 (Okamuro et al. (1997) *Proc. Natl. Acad. Sci.* 94:7076-7081).

Experimental Observations

The function of G8 was studied using transgenic plants in which the gene was expressed under the control of the 35S promoter. Overexpression of G8 caused alterations in plant development, the most consistent one being a delay in flowering time.

The individual plants showed a relatively strong phenotype and typically made 30-50 leaves (versus 10-12 the wild-type controls) prior to bolting, under 24-hour light. This phenotype was reproduced in some, but not all, of the T2 progeny plants from each one of the lines. Additionally, a further T2 population was found to flower later than wild type in 12-hour light conditions. Thus, late flowering was observed in both the T1 and T2 generations, and in different photoperiodic conditions.

It should also be noted that many 35S::G8 plants appeared smaller than controls, particularly at early stages. Accordingly, in the T2 lines used for physiological analyses it was observed that seedlings were smaller and showed reduced vigor when germinated on MS plates. However, not all 35S:: G8 lines showed these effects.

G8 was ubiquitously expressed, at higher levels in rosette leaves.

Potential Applications

G8 or its equivalogs can be used to alter flowering time.

In general, a wide variety of applications exist for systems that either lengthen or shorten the time to flowering.

Most modern crop varieties were the result of extensive breeding programs. Many generations of backcrossing may be required to introduce desired traits. Systems that accelerate flowering can have valuable applications in such programs since they allow much faster generation times. Additionally, in some instances, a faster generation time can allow additional harvests of a crop to be made within a given growing season. With the advent of transformation systems for tree species such as oil palm and *Eucalyptus*, forest biotechnology is a growing area of interest. Acceleration of flowering can reduce generation times and make breeding programs feasible which would otherwise be impossible.

In species such as sugarbeet where the vegetative parts of the plants constitute the crop and the reproductive tissues were discarded, it is advantageous to delay or prevent flowering. Extending vegetative development can bring about large increases in yields. By regulating the expression of flowering-time controlling genes, using inducible promoters, flowering can be triggered as desired (for example, by application of a chemical inducer). This can allow, for example, flowering to be synchronized across a crop and facilitate more efficient harvesting. Such inducible systems can be used to tune the flowering of crop varieties to different latitudes. At present, species such as soybean and cotton were available as a series of maturity groups that were suitable for different latitudes on the basis of their flowering time (which is governed by day-length). A system in which flowering can be chemically controlled could allow a single high-yielding northern maturity group to be grown at any latitude. In southern regions such plants can be grown for longer, thereby increasing yields, before flowering was induced. In more northern areas, the induction can be used to ensure that the crop flowers prior to the first winter frosts. Currently, the existence of a series of maturity groups for different latitudes represents a major barrier to the introduction of new valuable traits. Any trait (e.g. disease resistance) has to be bred into each of the different maturity groups separately; a laborious and costly exercise. The availability of single strain, which can be grown at any latitude, could therefore greatly increase the potential for introducing new traits to crop species such as soybean and cotton.

For many crop species, high yielding winter-varieties can only be grown in temperate regions where the winter season is prolonged and cold enough to elicit a vernalization response. If the vernalization treatment can be compensated for by modulating the expression of certain transcription factors in crop plants, winter varieties of wheat, for instance, might then be grown in areas like Southern California which would otherwise be too warm to allow effective vernalization. Another application is in cherry (*Prunus*). Locally grown cherries are unavailable in the early Californian spring since the winters are too warm for vernalization to occur.

A further application exists in strawberry (*Fragaria*). Strawberry has a well-defined perennial cycle of flower initiation, dormancy, chilling, crop growth and runner production. In temperate European countries, the plants flower in early spring, and fruit is produced in May or June. Following fruiting, runners are generated that carry plantlets which take root. The plants then remain dormant all through the late summer and autumn. Flowering cannot be repeated until the following spring after the plants have received a winter cold treatment. A system that bypasses this vernalization requirement could permit a second autumn crop of strawberries to be harvested in addition to the spring crop.

G19 (SEQ ID NO: 3)
Published Information

G19 belongs to the EREBP subfamily of transcription factors and contains only one AP2 domain. G19 corresponds to the previously described gene RAP2.3 (Okamuro et al. (1997) *Proc. Natl. Acad. Sci.* 94:7076-7081). Close inspection of the *Arabidopsis* cDNA sequences of RAP2.3 (AF003096; Okamuro et al. (1997) supra), AtEBP (Y09942; Buttner et al. (1997) *Proc. Natl. Acad. Sci.* 94:5961-5966), and ATCADINP (Z37504) suggests that they may correspond to the same gene (Riechmann et al. (1998) *Biol. Chem.* 379:633-646). G19/RAP2.3 is ubiquitously expressed (Okamuro et al. (1997) supra). AtEBP was isolated by virtue of the protein-protein interaction between AtEBP and OBF4, a basic-region leucine zipper transcription factor (Buttner et al. (1997) supra). AtEBP expression levels in seedlings were increased after treatment with ethylene (ethephon) (Buttner et al. (1997) supra). AtEBP was found to bind to GCC-box containing sequences, like that of the PRB-1b promoter (Buttner et al. (1997) supra). It has been suggested that the interaction between AtEBP and OBF4 reflects cross-coupling between EREBP and bZIP transcription factors that might be important in regulating gene expression during the plant defense response (Buttner et al. (1997) supra).

Experimental Observations

Transgenic plants in which G19 is expressed under the control of the 35S promoter were morphologically similar to control plants. G19 is constitutively expressed in the different tissues examined; however G19 expression was significantly repressed by methyl jasmonate (MeJ) and induced by ACC (this latter result correlates with the previously described increase in G19 expression levels in seedlings after treatment with ethylene (ethephon); Buttner et al. (1997) supra). G19 was significantly induced upon infection by the fungal pathogen *Erysiphe orontii*. In addition, G19 overexpressing plants were more tolerant to infection with a moderate dose of *Erysiphe orontii*. G19 overexpressing plants were also tested for their tolerance to two other pathogens, the necrotrophic fungal pathogen *Fusarium oxysporum* and the bacterial pathogen *Pseudomonas syringae*; the transgenic plants were not found to have altered susceptibility to the pathogens.

Both the jasmonic acid and the ethylene signal transduction pathways were involved in the regulation of the defense response and the wound response, and the two pathways have been found to interact synergistically. The regulation of G19 expression by both hormones, its induction upon *Erysiphe orontii* infection, as well as the preliminary data indicating that increased tolerance to that pathogen was conferred by G19 overexpression, suggest that G19 plays a role in the control of the defense and/or wound response. It would be of interest to test G19 overexpressing plants in insect-plant interaction experiments. The increase in tolerance to *Erysiphe orontii* that is conferred by G19 overexpression can be tested using other races of the pathogen. It would also be of interest to test other pathogens in addition to *Erysiphe orontii*, *Fusarium oxysporum*, and *Pseudomonas syringae*.

Since G19 was expressed at significant levels in a constitutive fashion, similar experiments to those described here can be performed with G19 knockout mutant plants to further elucidate the function of this gene.

Potential Applications

G19 or its equivalogs can be used to manipulate the plant defense- wound- or insect-response, as well as the jasmonic acid and ethylene signal transduction pathways themselves.

G22 (SEQ ID NO: 5)
Published Information

G22 was identified in the sequence of BAC T13E15 (gene T13E15.5) by The Institute of Genomic Research (TIGR) as a "TINY transcription factor isolog". G22 belongs to the EREBP subfamily and contains only one AP2 domain, and phylogenetic analyses place G22 relatively close to other EREBP subfamily genes, such as, TINY and ATDL4400C (Riechmann et al. (1998) *Biol. Chem.* 379:633-646).

Experimental Observations

G22 was constitutively expressed at medium levels. There appeared to be no phenotypic alteration on plant morphology upon G22 overexpression. Plants ectopically overexpressing G22 were more tolerant to high NaCl containing media in a root growth assay compared with wild-type controls.

Potential Applications

G22 or its equivalogs can be used to increase plant tolerance to soil salinity during germination, at the seedling stage, or throughout the plant life cycle. Salt tolerance is a particularly desirable phenotype during the germination stage of a crop plant, which would impact survivability and yield.

G24 (SEQ ID NO: 7)

Published Information

G24 corresponds to gene At2g23340 (AAB87098).

Experimental Observations

The function of G24 was studied using transgenic plants in which the gene was expressed under the control of the 35S promoter. Overexpression of G24 caused alterations in plant growth and development. Most notably, 35S::G24 seedlings often developed black necrotic tissue patches on cotyledons and leaves, and many died at that stage. Some 35S::G24 seedlings exhibited a weaker phenotype, and although necrotic patches were visible on the cotyledons, they did not die. These seedlings developed into plants that were usually small, slow growing, and poorly fertile in comparison to wild-type controls. The leaves of older 35S::G24 plants were also observed to become yellow and senesce prematurely compared with wild type. For those lines that could be assayed in biochemical and physiological assays, no differences were observed with respect to wild-type controls.

G24 was ubiquitously expressed, at apparently lower levels in germinating seedlings.

The AP2 domain of G24 is nearly identical to that of other *Arabidopsis* EREBP proteins, such as G12, G1379, and G1277.

Potential Applications

G24 or its equivalogs can be used to trigger cell death and influence or control processes in which cell death plays a role. G24 can be used to block pathogen infection by triggering it in infected cells and blocking spread of the disease.

G28 (SEQ ID NO: 9)

Published Information

G28 corresponds to AtERF1 (GenBank accession number AB008103) (Fujimoto et al. (2000) *Plant Cell* 12:393-404). G28 appears as gene AT4 g17500 in the annotated sequence of *Arabidopsis* chromosome 4 (AL161546.2).

AtERF1 has been shown to have GCC-box binding activity [some defense-related genes that were induced by ethylene were found to contain a short cis-acting element known as the GCC-box: AGCCGCC (Ohme et al. (1990) *Plant Mol. Biol.* 15:941-946)]. Using transient assays in *Arabidopsis* leaves, AtERF1 was found to be able to act as a GCC-box sequence specific transactivator (Fujimoto et al. (2000) supra).

AtERF1 expression has been described to be induced by ethylene (two- to three-fold increase in AtERF1 transcript levels 12 h after ethylene treatment) (Fujimoto et al. (2000) supra). In the ein2 mutant, the expression of AtERF1 was not induced by ethylene, suggesting that the ethylene induction of AtERF1 is regulated under the ethylene signaling pathway (Fujimoto et al. (2000) supra). AtERF1 expression was also induced by wounding, but not by other abiotic stresses (such as cold, salinity, or drought) (Fujimoto et al. (2000) supra).

It has been suggested that AtERFs, in general, may act as transcription factors for stress-responsive genes, and that the GCC-box may act as a cis-regulatory element for biotic and abiotic stress signal transduction in addition to its role as an ethylene responsive element (ERE) (Fujimoto et al. (2000) supra), but there is no data available on the physiological functions of AtERF1.

Experimental Observations

The function of G28 was analyzed using transgenic plants in which this gene was expressed under the control of the 35S promoter. G28 overexpressing lines were more tolerant to infection with a moderate dose of the fungal pathogen *Erysiphe orontii*. G28 overexpression did not seem to have detrimental effects on plant growth or vigor, since plants from most of the lines were morphologically wild-type. In addition, no difference was detected between those lines and the corresponding wild-type controls in all the biochemical assays that were performed. G28 was ubiquitously expressed.

G28 overexpressing lines were also more tolerant to *Sclerotinia sclerotiorum* and *Botrytis cinerea*. In a repeat experiment using individual lines, all three lines analyzed showed tolerance to *S. sclerotiorum*, and two of the three lines tested were more tolerant to *B. cinerea*.

Potential Applications

G28 transgenic plants had an altered response to fungal pathogens, in that those plants were more tolerant to the pathogens. Therefore, G28 or its equivalogs can be used to manipulate the defense response in order to generate pathogen-resistant plants.

G47 (SEQ ID NO: 11)

Published Information

G47 corresponds to gene T22J18.2 (AAC25505).

Experimental Observations

The function of G47 was studied using transgenic plants in which the gene was expressed under the control of the 35S promoter. Overexpression of G47 resulted in a variety of morphological and physiological phenotypic alterations.

35S::G47 plants showed enhanced tolerance to osmotic stress. In a root growth assay on PEG containing media, G47 overexpressing transgenic seedlings were larger and had more root growth compared with the wild-type controls. G47 expression levels can be altered by environmental conditions, in particular reduced by salt and osmotic stresses.

Overexpression of G47 also produced a substantial delay in flowering time and caused a marked change in shoot architecture. 35S::G47 transformants were small at early stages and switched to flowering more than a week later than wild-type controls (continuous light conditions). The inflorescences from these plants appeared thick and fleshy, had reduced apical dominance, and exhibited reduced internode elongation leading to a short compact stature. The branching pattern of the stems also appeared abnormal, with the primary shoot becoming "kinked" at each cofluorescence node. Additionally, the plants showed reduced fertility and formed rather small siliques that were borne on short pedicels and held vertically, close against the stem.

Additional alterations were detected in the inflorescence stems of 35S::G47 plants. Stem sections from T2-21 and T2-24 plants were of wider diameter, and had large irregular vascular bundles containing a much greater number of xylem vessels than wild type. Furthermore, some of the xylem vessels within the bundles appeared narrow and were possibly more lignified than were those of controls.

G47 was expressed at higher levels in rosette leaves, and transcripts were detected in other tissues (flower, embryo, silique, and germinating seedling), but not in roots.

Potential Applications

G47 or its equivalogs can be used to manipulate flowering time, to modify plant architecture and stem structure (including development of vascular tissues and lignin content) and to improve plant performance under osmotic stress.

Transcription factor equivalogs that modulate lignin content can be valuable. This modulation can allow the quality of wood used for furniture or construction to be improved. Lignin is energy rich; increasing lignin composition is valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production. In addition to forest biotechnology applications, changing lignin content can increase the palatability of various fruits and vegetables.

G156 (SEQ ID NO: 13)

Published Information

G156 corresponds to gene MKD15.12 (GenBank accession number BAB11181.1). G156 has also been described as AGL32 (Alvarez-Buylla et al. (2000) Proc. Natl. Acad. Sci. 97:5328-5333). Phylogenetic analyses of the Arabidopsis MADS box gene family indicate that G156/AGL32 is a Type II MADS-box gene, but it does not belong to any of the well-characterized Type II MADS gene clades (Alvarez-Buylla et al. 2000 supra).

Experimental Observations

The complete cDNA sequence of G156 was determined. The function of this gene was analyzed using both transgenic plants in which G156 was expressed under the control of the 35S promoter and a line homozygous for a T-DNA insertion in the gene. The T-DNA insertion lies in the second intron, and was expected to result in a strong loss-of-function or null mutation.

G156 knockout mutant plants produced yellow seed that showed more variation in shape than wild type, implying a function (direct or indirect) for G156 in seed development. G156 mutant plants were otherwise normal at all other developmental stages. Expression of G156 was determined to be specific to floral tissues. Although expression was detected by RT-PCR in flowers, siliques, and embryos, it could well be that G156 was specifically expressed in embryo/seed during development, in light of the many MADS box genes that have been shown to be expressed in specific floral organs or cell types, and of the G156 knockout mutant phenotype. In situ RNA hybridization experiments will determine more precisely G156 expression pattern.

The coloration phenotype of the G156 knockout mutant seed resembles that of ttg1 and the transparent testa mutants. TTG1, which is localized in Chromosome 5, but approximately 0.5 Mb away from the clone that contains G156 (MKD15), codes for a WD40 repeat protein (Walker et al. (1999) Plant Cell 11:1337-1350). The transparent testa (tt) loci were identified in screens for mutations that result in yellow or pale brown seeds (Koornneef (1990) Arabidopsis Inf. Ser. 27:1-4). Many of the "TT" genes have been mapped, and several of them have been cloned and shown to be involved in the anthocyanin pathway (Debeaujon et al. (2001) Plant Cell 13:853-872)

None of the TT genes corresponds to G156. TT3, TT4, TT5, and TT7 code for dihydroflavol 4-reductase, chalcone synthase, chalcone flavanone isomerase, and flavonoid 3'-hydroxylase, respectively (Shirley et al. (1992) Plant Cell 4:333-347; Shirley et al. (1995) Plant J. 8:659-671). TT12 encodes a multidrug secondary transporter-like protein required for flavonoid sequestration in vacuoles of the seed coat endothelium (Debeaujon et al. (2001) supra). TT6 and TT9 map on Chromosome 3, and TT1 maps on Chromosome 1. TT2 and TT10 map on Chromosome 5, but far away from the position of G156 (Shirley et al. (1995) supra). TT8 has also been cloned and shown to encode a transcription factor of the basic helix-loop-helix class (Nesi et al. (2000) Plant Cell 12:1863-1878), providing further evidence for the regulation of the anthocyanin pathway at the transcriptional level.

The similarity of the G156 knockout and tt seed coloration phenotypes, and the involvement of at least some of the TT genes in the anthocyanin pathway, suggested that G156 is involved in its regulation.

In addition to the seed coloration phenotype, the G156 knockout mutant showed a significant increase in the percentage of seed 18:1 fatty acids.

G156 overexpressing plants showed a variety of morphological alterations, largely uninformative. The most severely affected transformants were extremely dwarfed, had aberrant branching, and sometimes possessed terminal flowers. These phenotypic alterations were frequently observed when MADS box genes that were involved in flower development were overexpressed in Arabidopsis (for instance, AG, AP1, and AP3+PI; Mizukami et al. (1992) Cell 71:119-131; Mandel et al. (1995) Nature 377:522-524; Krizek et al. (1996) Development 122:11-22).

Both G156 knockout mutant plants and G156 overexpressing lines behaved like the wild-type controls in the physiological assays performed.

Potential Applications

G156 or its equivalogs can be used to manipulate the anthocyanin biosynthetic pathway, such as for altering seed coloration. In addition, the promoter of G156 may be used to confer seed-specific expression to genes of interest.

G157 (SEQ ID NO: 15)

Published Information

G157 was first identified in the sequence of BAC F22K20 (GenBank accession number AC002291; gene F22K20.15).

Experimental Observations

G157 was recognized as a gene highly related to Arabidopsis FLOWERING LOCUS C (FLC; Michaels et al. (1999) Plant Cell 11:949-956; Sheldon et al. (1999) Plant Cell 11:445-458). FLC acts as a repressor of flowering. Late flowering vernalization responsive ecotypes and mutants have high steady state levels of FLC transcript, which decrease during the promotion of flowering by vernalization. FLC therefore has a central role in regulating the response to vernalization (Michaels (1999) supra; Sheldon et al. (1999) supra; Sheldon et al. (2000) Proc. Natl. Acad. Sci. 97:3753-3758).

The function of G157 was studied using transgenic plants in which this gene was expressed under the control of the 35S promoter. Over-expression of G157 modifies flowering time, and it appears to do so in a quantitative manner: a modest level of over-expression triggers early flowering, whereas a larger increase delays flowering. G157 over-expression promoted flowering in the Arabidopsis late-flowering vernalization-dependent ecotypes Stockholm and Pitztal.

In contrast to FLC, G157 transcript levels showed no correlation with the vernalization response, and over-expression of G157 did not influence FLC transcript levels. Thus, G157 likely acts downstream or independently of FLC transcription. In addition, a cluster of four additional FLC-like and G157-like genes were identified, raising the possibility that a whole sub-group of proteins within the MADS family regulates flowering time.

G157 overexpressing plants did not show any other morphological, physiological, or biochemical alteration in the assays that were performed. Overexpression of G157 was not observed to have deleterious effects: 35S::G157 plants were healthy and attained a wild-type stature when mature.

For many crops, high yielding winter strains can only be grown in regions where the growing season is sufficiently cold and prolonged to elicit vernalization. A system that could trigger flowering at higher temperatures would greatly expand the acreage over which winter varieties can be cultivated. The finding that G157 overexpression caused early flowering in *Arabidopsis* Stockholm and Pitztal plants, indicated that the gene can overcome the high level of FRIGIDA and FLC activity present in those late-ecotypes. That the effects were similar to those caused by vernalization implied that G157 might be applicable to winter strains of crop species. To date, a substantial number of genes have been found to promote flowering. Many, however, including those encoding the transcription factors, APETALA1, LEAFY, and CONSTANS, produce extreme dwarfing and/or shoot termination when over-expressed. Overexpression of G157 was not observed to have deleterious effects. 35S::G157 *Arabidopsis* plants were healthy and attained a wild-type stature when mature. Irrespective of the mode of G157 action, and whether its true biological role is as an activator or a repressor of flowering, the results suggested that G157 may produce either early or late flowering, according to the level of over-expression.

G162 (SEQ ID NO: 17)
Published Information
G162 corresponds to gene At2g34440 (AAC26702), and it has also been referred to as AGL29.
Experimental Observations
The function of G162 was studied using transgenic plants in which the gene was expressed under the control of the 35S promoter. 35S::G162 plants were wild-type in morphology and development. Overexpression of G162 resulted in a significant increase in oil content in seeds, as measured by NIR.
Potential Applications
G162 or its equivalogs may be used to increase seed oil content and manipulate seed protein content in crop plants.

G175 (SEQ ID NO: 19)
Published Information
G175 was identified in the sequence of P1 clone M3E9 (Gene AT4g26440/M3E9.130; GenBank accession number CAB79499).
Experimental Observations
The complete cDNA sequence of G175 was determined. The function of this gene was studied using transgenic plants in which G175 was expressed under the control of the 35S promoter. 35S::G175 plants were more tolerant to osmotic stress conditions (better germination in NaCl- and sucrose-containing media). The plants were otherwise wild-type in morphology and development. Whereas some phenotypic changes were detected in the biochemical assays that were performed, these were not observed in more than one line.

G175 appeared to be specifically expressed in floral tissues, and also appeared to be induced elsewhere by heat and salt stress.
Potential Applications
G175 or its equivalogs can be used to increase germination under adverse osmotic stress conditions, which could impact survivability and yield. The promoter of G175 may be used to drive flower specific expression.

G180 (SEQ ID NO: 21)
Published Information
G180 was identified in the sequence of BAC F16B22 (GenBank accession number AC003672).
Experimental Observations
The complete sequence of G180 was determined. G180 was not annotated in the sequence of *Arabidopsis thaliana* chromosome II section 239 of 255 of the complete sequence (AC003672.2), where it resides between At2g44740 and At2g44750.

The function of G180 was analyzed using transgenic plants in which this gene was expressed under the control of the 35S promoter.

G180 overexpressing plants were early flowering, but did not exhibit other major developmental alterations. A number of *Arabidopsis* genes have already been shown to accelerate flowering when constitutively expressed. These include LEAFY, APETALA1 and CONSTANS. In these cases, however, the early flowering plants showed undesirable side effects such as extreme dwarfing, infertility, or premature termination of shoot meristem growth (Mandel et al. (1995) *Nature* 377:522-524; Weigel et al. (1995) 377: 495-500; Simon et al. (1996) *Nature* 384:59-62). It appeared that G180 induced flowering without these toxic pleiotropic effects.

G180 overexpressing lines also showed a decrease in seed oil content. That decrease was accompanied increased seed protein content in one of the three lines analyzed.
Potential Applications
G180 overexpression appeared to alter flowering time by accelerating the transition from vegetative to reproductive state. Therefore, G180 or its equivalogs may be used to manipulate flowering time in plants. In addition, G180 or its equivalogs can also have utility in modifying seed traits, particularly in modifying seed oil and protein levels in crop plants.

G183 (SEQ ID NO: 23)
Published Information
G183 corresponds to gene F20N2.3 (AAF79511).
Experimental Observations
The function of G183 was studied using transgenic plants in which the gene was expressed under the control of the 35S promoter. Overexpression of G183 resulted in an a reduction of the time to flowering.

Under continuous light conditions, 35S::G183 plants formed flower buds approximately 2-4 days earlier than wild-type control plants. Such a phenotype was seen in two separate plantings and in each of two independent T2 lines. Overexpression of G183 also resulted in seedlings with an altered response to light. In a germination assay conducted in darkness, G183 seedlings failed to show an etiolation response. However, the phenotype was severe in seedlings from one line where overexpression of the transgene resulted in reduced hypocotyl elongation and open, greenish cotyledons, but this line did not show alterations in flowering time in the T2 generation.

In addition to the effects on flowering time, 35S::G183 transformants were generally small, produced rather thin inflorescences, and had a low seed yield compared with wild type. Such effects were particularly apparent in some of the T1 plants. It should also be noted that the transformation rate attained with this transgene was relatively low, suggesting that G183 might have lethal effects at high dosages. Overexpression of G183 did not result in any biochemical phenotypic alteration.

According to the results obtained in the RT-PCR experiments, G183 was specifically expressed in flower, embryo, and silique tissues. It should be noted, however, that there have already been cases described of *Arabidopsis* transcription factor genes that were specifically expressed in flower-derived tissues but that can affect flowering time when their expression pattern is modified, including a homeobox gene long considered representing a true flowering time locus, FWA.
Potential Applications
G183 or its equivalogs may be used to modify flowering time and light response.

G183 or its equivalogs may alter a plant's light response and thus modify growth or development, for example, photomorphogenesis in poor light, or accelerating flowering time in response to various light intensities, quality or duration to which a non-transformed plant would not similarly respond, and increased planting densities with subsequent yield enhancement.

G188 (SEQ ID NO: 25)
Published Information
G188 corresponds to gene MXC20.3, first identified in the sequence of clone MXC20 (released by the *Arabidopsis* Genome Initiative; GenBank accession number AB009055).
Experimental Observations
The annotation of G188 in BAC AB009055 was experimentally confirmed. G188 was expressed in all tissues and under all conditions examined.

A line homozygous for a T-DNA insertion in G188 was initially used to characterize the function of this gene. In such line, the T-DNA insertion in G188 was localized in the second intron of the gene, located in the middle of the conserved WRKY box. Such insertion would result in a null mutation (unless the large fragment of exogenous sequence is perfectly spliced out from the transcribed G188 pre-mRNA). G188 mutant plants displayed several phenotypic alterations in physiological assays. G188 knockout mutant seed germinated better than wild-type controls under several kinds of osmotic stress. G188 knockout plants also showed higher susceptibility to the necrotroph fungal pathogen *Fusarium oxysporum* compared with control plants (more disease spread after infection). No significant morphological changes were observed in G188 knockout plants.

The function of G188 was subsequently analyzed using transgenic plants in which the gene was expressed under the control of the 35S promoter. G188 overexpressing plants were morphologically wild-type, and indistinguishable from the corresponding controls in all physiological and biochemical assays that were performed. Overexpression of G188 did not increase resistance to *Fusarium oxysporum*.

Further experiments to characterize G188 function can include testing the plant (knockout or overexpressor) to different doses of the pathogen *Fusarium oxysporum*, as well as more sophisticated gene expression profiling experiments.
Potential Applications
G188 or its equivalogs can be used to enhance seed germination under adverse osmotic conditions. G188 appears to be involved in the plant's response to *Fusarium oxysporum* and thus it may be used to manipulate such responses.

G189 (SEQ ID NO ID NO: 27)
Published Information
G189 was identified in the sequence of BAC clone T20D16 (gene At2g23320/T20D16.5, GenBank accession number AAB87100).
Experimental Observations
The function of G189 was studied using transgenic plants in which the gene was expressed under the control of the 35S promoter. T1 G189 overexpressing plants showed leaves of larger area than wild type. This phenotype, which was observed in two different T1 plantings, became more apparent at late vegetative development. T2 plants were morphologically wild-type. In wild-type plants, G189 was constitutively expressed.

G189 overexpressing plants were wild-type in all the physiological analyses performed.
Potential Applications
G189 or its equivalogs can be used to increase plant biomass. Large size is useful in crops where the vegetative portion of the plant is the marketable portion since vegetative growth often stops when plants make the transition to flowering.

G192 (SEQ ID NO: 29)
Published Information
G192 corresponds to gene A_IG002N01.6, first identified in the sequence of BAC clone A_IG002N01 (released by the *Arabidopsis* Genome Initiative; GenBank accession number AF007269).
Experimental Observations
The annotation of G192 in BAC AF007269 was experimentally confirmed. G192 was expressed in all plant tissues and under all conditions examined. Its expression was induced upon infection by *Fusarium*.

The function of G192 was analyzed using transgenic plants in which this gene was expressed under the control of the 35S promoter. G192 overexpressors were late flowering under 12 hour light and had more leaves than control plants. This phenotype was manifested in the three T2 lines analyzed. In addition, one line showed a decrease in seed oil content. No other differences between G192 overexpressing lines and control plants were noted in the assays performed.

A decrease in seed oil observed previously in one transgenic line was replicated in an independent experiment.
Potential Applications
G192 overexpression delayed flowering. A wide variety of applications exist for genes or their equivalogs that either lengthen or shorten the time to flowering, or for systems of inducible flowering time control. In particular, in species where the vegetative parts of the plants constitute the crop and the reproductive tissues were discarded, it would be advantageous to delay or prevent flowering. Extending vegetative development may bring about large increases in yields.

G192 or its equivalogs can be used to manipulate seed oil content, which might be of nutritional value.

G196 (SEQ ID NO: 31)
Published Information
G196 corresponds to gene At2g34830 (AAC12823).
Experimental Observations
The function of G196 was studied using transgenic plants in which the gene was expressed under the control of the 35S promoter. 35S::G196 plants show more tolerance to salt stress in a germination assay. Overexpression of G196 also produced a range of effects on plant morphology including a reduction in overall size, lowered fertility and changes in leaf shape. T1 seedlings were typically small, often had abnormal shaped cotyledons, and the rosette leaves produced by these plants were often undersized, contorted and darker green compared with wild type. Later in development, during the reproductive stage, the plants formed thin inflorescences bearing poorly fertile flowers with underdeveloped organs. 35S::G196 primary transformants were obtained at a relatively low frequency, suggesting that the gene might have lethal effects if overexpressed at very high levels.

35S::G196 plants were wild-type in the biochemical analyses that were performed. G196 was ubiquitously expressed (and different levels among the various tissues).
Potential Applications
G196 or its equivalogs may be used to improve plant performance under conditions of salt stress. Evaporation from the soil surface causes upward water movement and salt accumulation in the upper soil layer where the seeds were placed. Thus, germination normally takes place at a salt concentration that is higher than the mean salt concentration in the whole soil profile. Increased salt tolerance during the germination stage of a crop plant may impact survivability and yield.

G211 (SEQ ID NO: 33)

Published Information

G211 corresponds to Atmyb5 (U26935; Li et al. (1996) *FEBS Lett* 379:117-121). *Arabidopsis* plants transgenic for a chimeric Atmyb5 promoter/GUS gene expressed the enzyme in developing leaf trichomes, stipules, epidermal cells on the margins of young rosette and cauline leaves, and in immature seeds. In immature seeds, Atmyb5 expression occurs between fertilization and the 16 cell stage of embryo development and persists beyond the heart stage.

Experimental Observations

The function of G211 was investigated using a homozygous mutant line in which a T-DNA was inserted into the coding region of the gene as well as using transgenic lines in which G211 is expressed under the control of the 35S promoter. The phenotype of the G211 knockout mutant plants was wild-type in all respects. Overexpression of G211, however, had marked effects on leaf and inflorescence development. 35S::G211 plants were generally small, slow developing, and produced rounded, slightly serrated leaves, with very short petioles. Additionally these plants were dark green in coloration, and in some cases, appeared to have reduced trichome density. Following the switch to reproductive growth, 35S::G211 inflorescences had short internodes and showed a general reduction in apical dominance, leading to a bushy appearance. In many cases, due to the small size, seed yield was reduced compared with wild-type controls. These effects were highly penetrant and were apparent in the majority of T1 lines and, to some extent, in each of the three T2 populations. An increase in leaf xylose in two lines was also observed in the T2 35S::G211 transgenics.

As determined by RT-PCR, expression of G211 was found primarily in embryos and siliques. G211 expression in leaf tissue was unaffected by any environmental stress-related condition tested.

Potential Applications

G211 overexpression resulted in plants with altered leaf insoluble sugar content. Transcription factors such as G211 or their equivalogs that alter plant cell wall composition have several potential applications including altering food digestibility, plant tensile strength, wood quality, pathogen resistance and in pulp production.

In particular, hemicellulose is not desirable in paper pulps because of its lack of strength compared with cellulose. Thus, modulating the amounts of cellulose vs. hemicellulose in the plant cell wall is desirable for the paper/lumber industry. Increasing the insoluble carbohydrate content in various fruits, vegetables, and other edible consumer products will result in enhanced fiber content. Increased fiber content would not only provide health benefits in food products, but might also increase digestibility of forage crops. In addition, the hemicellulose and pectin content of fruits and berries affects the quality of jam and catsup made from them. Changes in hemicellulose and pectin content could result in a superior consumer product.

G214 (SEQ ID NO ID NO: 35)

Published Information

G214 (CCA1) was published by Wang et al. (1997) *Plant Cell* 9: 491-507. CCA1 is involved in phytochrome induction of CAB genes. The transcript is transiently induced by phytochrome and oscillates with a circadian rhythm. It feedback-regulates its own expression at the transcriptional level. Overexpressing CCA1 abolished circadian rhythm of several genes and results in plants that were late flowering, and have elongated hypocotyls.

Experimental Observations

G214 overexpressing lines were late bolting, show larger biomass (increased leaf number and size), and were darker green in vegetative and reproductive tissues due to a higher chlorophyll content in the later stages of development. In these later stages, the overexpressors also have higher insoluble sugar, leaf fatty acid, and carotenoid content per unit area. Line #11 also showed a significant, repeatable increase in lutein levels in seeds. Microarray data was consistent with the morphological and biochemical data in that the genes that were highly induced included chloroplast localized enzymes, and light regulated genes such as Rubisco, carbonic anhydrase, and the photosystem 1 reaction center subunit precursor. A chlorophyll biosynthetic enzyme was also highly induced, consistent with the dark green color of the adult leaves and perhaps a higher photosynthetic rate. A measurement of leaf fatty acid in the older overexpressors suggested that the overall levels were higher than wild-type levels (except for the percent composition of 16:3 in line #11). Percent composition of 16:1 and 16:3 fatty acids (found primarily in plastids) is similar to wild type arguing against an increase in chloroplast number as an explanation for increase chlorophyll content in the leaves. Three G214-overexpressing lines were sensitive to germination on high glucose showing less cotyledon expansion and hypocotyl elongation suggesting the late bolting and dark green phenotype could be tied into carbon sensing which has been shown to regulate phytochrome A signaling (Dijkwel et al. (1997) *Plant Cell* 9:583-595; Van Oosten et al. (1997) *Plant J.* 12:1011-1020). Sugars are key regulatory molecules that affect diverse processes in higher plants including germination, growth, flowering, senescence, sugar metabolism and photosynthesis. Glucose-specific hexose-sensing has also been described in plants and implicated in cell division and the repression of famine genes (photosynthetic or glyoxylate cycles).

Potential Applications

Potential utilities of this gene or its equivalogs include increasing chlorophyll content allowing more growth and productivity in conditions of low light. With a potentially higher photosynthetic rate, fruits can have higher sugar content. Increased carotenoid content may be used as a nutraceutical to produce foods with greater antioxidant capability. G214 or its equivalogs can also be used to manipulate seed composition, which is very important for the nutritional value and production of various food products.

G214 overexpression delayed flowering time in transgenic plants, and thus this gene or its equivalogs would be useful in modifying flowering time. In a sizeable number of species, for example, root crops, where the vegetative parts of the plants constitute the crop and the reproductive tissues were discarded, it is advantageous to identify and incorporate transcription factor genes that delay or prevent flowering in order to prevent resources being diverted into reproductive development. Extending vegetative development can thus bring about large increases in yields.

G226 (SEQ ID NO: 37)

Published Information

G226 was identified from the *Arabidopsis* BAC sequence, AC002338, based on its sequence similarity within the conserved domain to other Myb family members in *Arabidopsis*. To date, there is no published information regarding the function of this gene.

Experimental Observations

The function of G226 was analyzed through its ectopic overexpression in plants. G226 overexpressors were more tolerant to low nitrogen and high salt stress. They showed more root growth and possibly more root hairs under conditions of nitrogen limitation compared with wild-type controls. Many plants were glabrous and lacked anthocyanin production when under stress such as growth conditions of low nitrogen and high salt. Several G226 overexpressors were glabrous and produce less anthocyanin under stress; these effects might be due to binding site competition with other Myb family transcription factors involved in these functions and not directly related to the primary function of this gene.

Results from the biochemical analysis of G226 overexpressors suggested that one line had higher amounts of seed protein, which could have been a result of increased nitrogen uptake by these plants.

A microarray experiment was done on a separate G226 overexpressing line. The G226 sequence itself was overexpressed 16-fold above wild type, however, very few changes in other gene expression were observed in this line. On the array, a chlorate/nitrate transporter DNA sequence was induced 2.7-fold over wild type, which could explain the low nitrogen tolerant phenotype of the plants and the increased amounts of seed protein in one of the lines. The same DNA sequence was present several times on the array and in all cases the DNA sequence showed induction, adding more validity to the data. Five other genes/DNA sequences induced but had unknown function. A methyltransferase, a pollen-specific protein, and a zinc binding peroxisomal membrane protein encoding sequences were also induced, however their role in regard to the phenotype of the plants is not known.

Potential Applications

The utilities of a gene or its equivalogs conferring tolerance to conditions of low nitrogen include: (1) Cost savings to the farmer by reducing the amounts of fertilizer needed; (2) Environmental benefits of reduced fertilizer runoff, (3) Improved yield and stress tolerance. In addition, G226 can be used to increase seed protein amounts and/or composition, which may impact yield as well as the nutritional value and production of various food products.

G226 or its equivalogs can be used to alter trichome number and distribution in plants. Trichome glands on the surface of many higher plants produce and secrete exudates, which give protection from the elements and pests such as insects, microbes and herbivores. These exudates may physically immobilize insects and spores, may be insecticidal or antimicrobial or they may allergens or irritants to protect against herbivores. It has also been suggested that trichomes may decrease transpiration by decreasing leaf surface airflow, and by exuding chemicals that protect the leaf from the sun.

G241 (SEQ ID NO: 39)
Published Information

G241 is equivalent to Y19 (X90384), a putative light regulated Myb that was identified by Quaedvlieg et al. (1996) *Plant Mol. Biol.* 32:987-993. The Myb Consortium renamed this gene MYB15 and found that it was constitutively expressed at a low level with expression higher in etiolated seedlings (Kranz et al. (1998) *Plant J.* 16:263-276).

Experimental Observations

The function of G241 was analyzed through its ectopic overexpression in plants as well as through the analysis of a line homozygous for a knockout mutation in G241. The knockout mutant plants were wild-type in all assays performed. G241 overexpressors had a glucose germination phenotype suggesting these plants could be involved in glucose-specific sugar sensing.

Results from the biochemical analysis of G241 knockouts showed that a lower amount of seed oil and an increase in seed protein.

RT-PCR analysis of the endogenous levels of G241 showed the gene is expressed in all tissue types tested.

Results from an array experiment using a G241 overexpressor line were consistent with expression in seeds. Several gene sequences were induced that could be involved in osmotic stress tolerance or desiccation tolerance, which are important for germinating seeds. In this experiment, the G241 DNA sequence itself was induced 38-fold. Many of the induced genes were transcription factors with unknown function. Both CBF1 and CBF2 (involved in freezing tolerance) were up-regulated. As mentioned above, several genes indicative of osmotic stress tolerance were also up-regulated. These same gene sequences were up-regulated on arrays of plants treated with mannitol as an osmotic stress, in a CBF2 overexpressor, and in cold-acclimated plants. A glucose transporter sequence was also up-regulated, however, this gene sequence is not up-regulated in any of the other arrays mentioned above. The phenotype of the overexpressor was reduced seedling growth on high glucose. It is possible that the plants were taking up more glucose. In such a scenario, the gene is not likely to be involved in sugar sensing but rather the high glucose condition is inhibiting their growth. The G241 overexpressors were tested for osmotic stress tolerance using mannitol. It is possible the glucose transporter is increasing mannitol uptake and increasing its toxicity to the plant as well. Polyethylene glycol (PEG) is an alternative osmoticum that can be tested at various concentrations.

Potential Applications

One potential utility of this gene or its equivalogs can be to engineer plants that are tolerant to stress. This can greatly impact yield. Alternatively, if this gene is involved in sugar sensing, the potential utility of a gene involved in glucose-specific sugar sensing is to alter energy balance, photosynthetic rate, biomass production, and senescence. Sugars are key regulatory molecules that affect diverse processes in higher plants including germination, growth, stress responses, flowering, senescence, sugar metabolism and photosynthesis. Glucose-specific hexose-sensing has been described in plants and implicated in cell division, and repression of famine genes (photosynthetic or glyoxylate cycles). This gene may also be used to alter oil and protein production in seeds, which may be very important for the nutritional quality and caloric content of foods.

G248 (SEQ ID NO: 41)
Published Information

G248 was identified at Mendel Biotechnology. Kranz et al. ((1998) *Plant J.* 16:263-276) published a cDNA sequence corresponding to G248, naming it MYB22.

Experimental Observations

The function of G248 was analyzed using transgenic plants in which the gene was expressed under the control of the 35S promoter. The phenotype of these transgenic plants was wild-type with respect to their morphology. However, overexpression of G248 in *Arabidopsis* was found to confer greater sensitivity to disease, particularly following infection by *Botrytis cinerea*. All three lines show the susceptible phenotype.

As determined by RT-PCR, G248 appears to be expressed at low levels in embryo and silique tissue. No expression was detected in other tissues. G248 appears to be induced in response to salicylic acid (SA) treatment. It is well know that both synergistic and antagonistic crosstalk between growth regulator controlled defense pathways occurs in response to disease.

Potential Applications

Since G248 transgenic plants had an altered response to the fungal pathogen *Botrytis cinerea*, G248 or its equivalogs can be used to manipulate the defense response in order to generate pathogen-resistant plants.

G254 (SEQ ID NO: 43)
Published Information

G254 was identified from the *Arabidopsis* BAC sequence, AF007269, based on its sequence similarity within the conserved Myb domain to other Myb family members in *Arabidopsis*.

Experimental Observations

The function of G254 was analyzed through the ectopic overexpression of the gene in plants. Overexpression of G254 resulted in a reduction of germination and reduced seedling growth on glucose containing media. G254 may be involved in sugar sensing.

RT-PCR analysis of the endogenous levels of G254 indicated that this gene was expressed in all tissues tested. A cDNA microarray experiment supported the tissue distribution data by RT-PCR. There was no induction of G254 above its basal level in response to environmental stress treatments. G254 was constitutively expressed.

Potential Applications

The potential utility of G254 or its equivalogs is to alter source-sink relationships in the plant. Sugars are key regulatory molecules that affect diverse processes in higher plants including germination, growth, flowering, senescence, sugar metabolism, and photosynthesis. Sucrose is the major transport form of photosynthate and its flux through cells has been shown to affect gene expression and alter storage compound accumulation in seeds (source-sink relationships). The potential utilities of a gene involved in glucose-specific sugar sensing are to alter energy balance, photosynthetic rate, carbohydrate accumulation, biomass production, source-sink relationships, and senescence. Glucose-specific hexose-sensing has been described in plants and implicated in cell division and the repression of 'famine' genes (photosynthetic or glyoxylate cycles).

G256 (SEQ ID NO ID NO: 45)

Published Information

G256 is equivalent to Y13, a gene that was identified by Quaedvlieg et al. ((1996) Plant Mol. Biol. 32:987-093) as being induced in etiolated seedlings one hour after being exposed to light. The Myb consortium has renamed this gene MYB31. Quaedvlieg et al. (1996, supra) found a low level of expression in stem and silique tissue with no induction in etiolated seedlings after being exposed to light. However, there was also a slight induction of G256 following cold treatment.

Experimental Observations

The function of G256 was analyzed through its ectopic overexpression in plants. G256 overexpressors had enhanced seedling vigor during cold germination. These overexpressing lines were more tolerant to chilling conditions compared to wild-type controls, as seen in 12-day-old seedlings that were transferred to cold temperatures (8° C.).

There was no difference in germination rate under normal growth conditions. The chilling tolerant phenotype is most noticeable with respect to enhanced root growth although the cotyledons show less anthocyanin production than wild-type controls.

Plants overexpressing G256 were also small and early bolting. In the T2, one line lacked the waxy surface on the bolts. Three lines were tolerant to cold germination and therefore co-suppression was not a likely cause of the morphological change observed in one line. An array experiment was performed on this G256 overexpressing line. The gene itself was induced 3.5-fold over wild-type levels. Very few additional gene sequences were significantly induced in response to G256 overexpression. Induced genes included four gene sequences of unknown function, a sugar carrier sequence, a cell wall degrading enzyme (BGL2) sequence, pectinesterase sequence, and a proteasome subunit protein sequence. Expression of gene sequences such as allene oxidase sequence (which could mean down-regulation of the associated jasmonate synthesis pathway), and endochitinase were repressed.

RT-PCR analysis of the endogenous levels of G256 indicated that this gene sequence was expressed primarily in shoots, flowers, and siliques. A cDNA microarray experiment confirmed this tissue distribution data by RT-PCR. There was no induction of G256 in leaves or in seedlings in response to environmental stress treatments.

Potential Applications

The potential utility of this gene or its equivalogs is to confer better germination and growth in the cold. The germination of many crops is very sensitive to cold temperatures. A gene that would allow germination and seedling vigor in the cold would have tremendous utility in allowing seeds to be planted earlier in the season with a high rate of survivability.

G278 (SEQ ID NO ID NO: 47)

Published Information

G278 was identified by amino acid sequence similarity to plant and mammalian ankyrin-repeat proteins. G278 is on chromosome 1 BAC F15H21 (GenBank accession number AC066689.5; nid=12323462), released by the Arabidopsis Genome Initiative. The transcription start/stop codon was correctly predicted. G278 is referred to in the public literature as NPR1, a gene that controls the onset of systemic acquired resistance in plant (Cao et al. (1997) Cell 88:57-63; Cao et al. (1998) Proc. Natl. Acad. Sci. 95:6531-6536).

It was shown that a 2-3-fold overexpression of 35S::NPR1 over basal wild-type expression level results in transgenic plants resistant to the bacterial pathogen Psm ES4326 and the oomycete Peronospora parasitica Noco. An inducing signal (SA, INA, or a pathogen infection) is necessary for the expression of the phenotype and downstream induction of pathogen-related proteins.

Experimental Observations

RT-PCR analysis of the endogenous level of G278 transcripts revealed that G278 was present at moderate, constitutive level in all tissues examined. G278 expression levels were similar to the wild-type control in all the biotic/abiotic treatments examined. The function of G278 was analyzed in transgenic plants overexpressing G278 under the control of the 35S promoter. Transformants were morphologically indistinguishable from wild-type plants. Plants overexpressing G278 were more susceptible to infection with the necrotrophic fungal pathogen Sclerotinia sclerotiorum when compared with control plants. The experiment was confirmed on individual lines. Transgenic G278 overexpressing lines were similar to control wild-type plant when challenged with Botrytis cinerea and Fusarium oxysporum.

Data in the public literature indicated that G278/NPR1 plays an important role in mediating the onset of systemic acquired resistance in plant. Dual resistance of a 35S::NPR1 transgenic plants to bacterial and fungal pathogen suggested that G278/NPR1 may be key to the generation of broad-spectrum resistance in plant. The 35S::G278 overexpressor experimental data indicated that overexpressing G278 had little effect in improving resistance following infection with necrotrophic pathogens (Fusarium oxysporum, Botrytis cinerea, and Sclerotinia sclerotiorum). In fact, reduced tolerance of the transgenic 35S::NPR1 plant to infection with Sclerotinia sclerotiorum was observed. Although we cannot rule out the possibility of co-suppression in transgenic T2 lines tested, it is likely that that resistance to necrotrophic pathogens is mediated by different pathway than the SA/SAR pathway. Overexpression of G278 may directly or indirectly introduces competition for co-factor(s) or results in biochemical interference, which may be detrimental for proper development of resistance to Sclerotinia sclerotiorum.

Potential Applications

35S::G278 overexpression in *Arabidopsis* was shown to affect the onset of disease following inoculation with *Sclerotinia sclerotiorum*. Therefore, G278 or its equivalogs can be used to manipulate the defense response in plants.

G291 (SEQ ID NO: 49)

Published Information

G291 is referred to in the public literature as the *Arabidopsis* AJH1, a plant homolog of the c-Jun coactivator. AJH1 was isolated by peptide sequencing of a subunit of the COP9 complex, an important component in light-mediated signal transduction in *Arabidopsis*. It is postulated that the COP9 complex may modulate the activities of transcription factors in response to environmental stimuli. Localization experiment reveals that AJH1 was present in monomeric form, which suggested a possible involvement in other developmentally regulated processes (Kwok et al. (1998) *Plant Cell* 10:1779-1790). G291 is found in the sequence of the chromosome 1 BAC F19G10 (GenBank accession AF000657.1 GI:2098816), released by the *Arabidopsis* Genome Initiative. The start and stop codons were correctly predicted.

Experimental Observations

The expression profile of G291 revealed a low, but constitutive, expression of G291 transcripts in all tissues examined. G291 transcript levels were similar to the wild-type controls in all the physiological treatments examined as determined by RT-PCR analysis.

G291 overexpressors produced significantly more seed oil than wild-type plants.

Potential Applications

G291 or its equivalogs can be used to increase seed oil content, which may be of nutritional value for food for human consumption as well as animal feeds.

G303 (SEQ ID NO: 51)

Published Information

G303 corresponds to gene MNA5.5 (BAB11554.1).

Experimental Observations

The complete sequence of G303 was determined. G303 was detected at very low levels in roots and rosette leaves.

The function of this gene was analyzed using transgenic plants in which G303 was expressed under the control of the 35S promoter. G303 overexpressing plants had more tolerance to osmotic stress in a germination assay in three separate experiments. They had more seedling vigor than wild-type control when germinated on plates containing high salt and high sucrose. No altered morphological or biochemical phenotypes were detected in G303 overexpressing plants.

Potential Applications

G303 or its equivalogs may be useful for enhancing seed germination under high salt conditions or other conditions of osmotic stress. Evaporation from the soil surface causes upward water movement and salt accumulation in the upper soil layer where the seeds are placed. Thus, germination normally takes place at a salt concentration much higher than the mean salt concentration in the whole soil profile. Increased salt tolerance during the germination stage of a crop plant would impact survivability and yield. G303 can also be used to engineer plants with enhanced tolerance to drought, salt stress, and freezing.

G312 (SEQ ID NO: 53)

Published Information

G312 corresponds to a predicted SCWERECROW gene regulator in annotated P1 clone MUD21 (AB010700), from chromosome 5 of *Arabidopsis* (Kaneko et al. (1998) *DNA Res.* 5: 131-145).

Experimental Observations

The function of this gene was analyzed using transgenic plants in which G312 was expressed under the control of the 35S promoter. Transgenic plants overexpressing G312 were more salt tolerant than wild-type plants, as determined by a germination assay on MS media supplemented with 150 mM NaCl. G312 was constitutively expressed at very low levels in all tissues tested. Expression of G312 did not appear to be induced by any of the environmental or stress conditions tested.

Potential Applications

Transgenic plants overexpressing G312 germinated better in a high salt environment than control plants. These data suggested that G312 or its equivalogs can be used to create crop plants that are more tolerant of high salt conditions. Better germination in high salt conditions is desirable because, in the field, germination normally takes place at a salt concentration much higher than the mean salt concentration in the whole soil profile. This is because evaporation from the soil surface causes upward water movement and salt accumulation in the upper soil layer where the seeds are placed. Increased salt tolerance during the germination stage of a crop plant would impact survivability and yield.

G325 (SEQ ID NO ID NO: 55)

Published Information

G325 was identified as a gene in the sequence of chromosome 4, ESSA I FCA contig fragment No. 3 (GenBank Accession number Z97338), released by the European Union *Arabidopsis* Sequencing Project.

Experimental Observations

The function of G325 was analyzed using transgenic plants in which G325 was expressed under the control of the 35S promoter. G325 overexpressing plants had more tolerance to osmotic stress in a germination assay in three separate experiments. They had more seedling vigor than wild-type control when germinated on plates containing high salt and high sucrose. No altered morphological phenotypes or altered phenotypes in the biochemical assays were observed.

G325 was expressed at high levels in flowers and cauline leaves, and at lower levels in shoots, rosette leaves, and seedlings. G325 was induced by auxin, cold- and heat-stress. The expression of G325 also was reduced in response to *Fusarium* infection or salicylic acid treatment.

Potential Applications

G325 or its equivalogs may be useful for enhancing seed germination under high salt conditions or other conditions of osmotic stress. Evaporation from the soil surface causes upward water movement and salt accumulation in the upper soil layer where the seeds are placed. Thus, germination normally takes place at a salt concentration much higher than the mean salt concentration in the whole soil profile. Increased salt tolerance during the germination stage of a crop plant would impact survivability and yield.

G325 or its equivalogs can also be used to engineer plants with enhanced tolerance to drought, salt stress, and freezing, at later stages.

G343 (SEQ ID NO: 59)

Published Information

G343 was identified as GATA-2 (accession number Y13649) by homology to other GATA transcription factors.

Experimental Observations

RT-PCR and microarray data analysis of the endogenous levels of G343 indicated that this gene was ubiquitously expressed in all tissues albeit predominantly in seedling. In addition, G343 was repressed in response to treatment with *Erysiphe* and *Fusarium*.

The function of G343 was analyzed through its ectopic overexpression in plants. G343 overexpressors grew very poorly on soil, and T2 plants were not propagated for biochemical analysis. On the other hand, G343 overexpressors grew as well as wild-type controls on MS media, where they exhibited an increase in tolerance to glyphosate and oxidative stress. G343 T2 plants were rescued from the control plates, propagated to the next generation, and tested again on glyphosate plates where they exhibited the same resistance phenotype. Additional T2 lines were obtained and tested. A fourth line also showed a striking tolerance to glyphosate, though two other lines exhibited a slight increase in susceptibility to glyphosate. These opposite effects in the T2 lines might be caused by silencing of the gene. It would, therefore, be very interesting to determine the phenotype of G343 knockouts in glyphosate-resistance assays.

Potential Applications

G343 or its equivalogs can be used for the generation of glyphosate resistant plants, and to increase plant resistance to oxidative stress.

G353 (SEQ ID NO: 59)
Published Information

G353 was identified in the sequence of P1 clone MMN10, GenBank accession number AB0154751, released by the *Arabidopsis* Genome Initiative. G353 corresponds to RHL41 (Kazuoka et al. (2000) *Plant J.* 24:191-203) and Zat12 (Meissner et al. (1997) *Plant Mol. Biol.* 33:615-624). Transgenic *Arabidopsis* plants over-expressing the RHL41 gene showed an increased tolerance to high-intensity light, and also morphological changes of thicker and dark green leaves. The palisade parenchyma was highly developed in the leaves of the transgenic plants. Anthocyanin content, as well as the chlorophyll content, also increased. Antisense transgenic plants exhibited decreased tolerance to high irradiation. RHL41 protein may play a key role in the acclimatization response to changes in light intensity.

Experimental Observations

G353 was uniformly expressed in all tissues and under all conditions tested in RT-PCR experiments. The highest level of expression was observed in rosette leaves, embryos, and siliques. The function of this gene was analyzed using transgenic plants in which G353 was expressed under the control of the 35S promoter. Overexpression of G353 in resulted in enhanced tolerance to osmotic stress in one transgenic line. The most dramatic effect of overexpression of G353 was observed in flower morphology. 35S::G353 plants had a reduction in flower pedicel length, and downward pointing siliques. This phenotype was very similar to that described for the brevipedicellus (bp) mutant (Koornneef et al. (1983) *J. Hered.* 74:265-272) and in overexpression of a related gene, G354. Other morphological changes in shoots were also observed in 35S::G353 plants. Leaves had short petioles, were rather flat, rounded, and sometimes showed changes in coloration. These effects were observed in varying degrees in the majority of transformants. Severely affected plants were tiny, had contorted leaves, poor fertility, and produced few seeds. Overexpression of G353 in *Arabidopsis* resulted in an increase in seed glucosinolate M39494 in two T2 lines.

Potential Applications

G353 or its equivalogs can be used to alter inflorescence structure, which may have value in production of novel ornamental plants.

G353 or its equivalogs can be used to alter a plant's response to water deficit conditions and, therefore, be used to engineer plants with enhanced tolerance to drought, salt stress, and freezing.

Increases or decreases in specific glucosinolates or total glucosinolate content may be desirable depending upon the particular application. For example: (1) Glucosinolates are undesirable components of the oilseeds used in animal feed, since they produce toxic effects. Low-glucosinolate varieties of canola have been developed to combat this problem; (2) Some glucosinolates have anti-cancer activity; thus, increasing the levels or composition of these compounds might be of interest from a nutraceutical standpoint; (3) Glucosinolates form part of a plants natural defense against insects; modification of glucosinolate composition or quantity could therefore afford increased protection from predators; furthermore, in edible crops, tissue specific promoters might be used to ensure that these compounds accumulate specifically in tissues, such as the epidermis, which are not taken for consumption.

G354 (SEQ ID NO: 61)
Published Information

G354 was identified in the sequence of BAC clone F12M12, GenBank accession number AL355775, released by the *Arabidopsis* Genome Initiative. G354 corresponds to ZAT7 (Meissner et al. *Plant Mol. Biol.* 33:615-624).

Experimental Observations

Greatest levels of expression of G354 were observed in rosette leaves, embryos, and siliques. Some expression of G354 was also observed in flowers.

The function of this gene was analyzed using transgenic plants in which G353 was overexpressed under the control of the 35S promoter. 35S::G354 plants had a reduction in flower pedicel length, and downward pointing siliques. This phenotype was very similar to that described for the brevipedicellus (bp) mutant (Koornneef et al. (1983) *J. Hered.* 74:265-272) and in overexpression of a related gene, G353. Other morphological changes in shoots were also observed in 35S::G354 plants. Many 35S::G354 seedlings had abnormal cotyledons, elongated, thickened hypocotyls, and short roots. The majority of T1 plants had a very extreme phenotype, were tiny, and arrested development without forming inflorescences. T1 plants showing more moderate effects had poor seed yield.

Overexpression of G354 in *Arabidopsis* resulted in seedlings with an altered response to light. In darkness, G354 seedlings failed to etiolate. The phenotype was most severe in seedlings from one line where overexpression of the transgene resulted in reduced open and greenish cotyledons.

Potential Applications

G354 or its equivalogs can be used to alter inflorescence structure, which may have value in production of novel ornamental plants.

G354 modifies the light response and thus G354 or its equivalogs may be useful for modifying plant growth or development, for example, photomorphogenesis in poor light, or accelerating flowering time in response to various light intensities, quality or duration to which a non-transformed plant would not similarly respond. Elimination of shading responses may lead to increased planting densities with subsequent yield enhancement.

G361 (SEQ ID NO: 63)
Published Information

G361 was first isolated by Tague et al. ((1995) *Plant Mol. Biol.* 28:267-279) in an effort to study the sequence and the expression pattern of C2H2 zinc finger protein encoding genes in *Arabidopsis* (Takatsuji (1998) *Cell. Mol. Life. Sci.* 54:582-596). The latter study showed that G361 (ZFP6) was mostly expressed in roots and shoots based on Northern analysis.

Experimental Observations

A full-length cDNA was isolated and used to transform plants. G361 overexpressors were small and very late bolting. The plants did not show any physiological phenotype. G361 overexpressing plants had increased levels of polyunsaturated fatty acids. The phenotype could be related to the darker green color of the plants and their possible higher chlorophyll content (repeat of analysis also in progress). Higher 16:3 fatty acid content, in particular, could be a reflection of a higher chloroplast number or more chloroplast membranes. RT-PCR data showed that the gene was expressed mostly in shoots and in roots at low levels.

Potential Applications

The late-flowering phenotype of G361 or its equivalogs is useful in that late flowering is desirable in crops where the vegetative portion of the plant is harvested (often vegetative growth stops when plants make the transition to flowering). In this case, it can be advantageous to prevent or delay flowering in order to increase yield. Also, prevention of flowering can be useful in these same crops in order to prevent the spread of transgenic pollen and/or to prevent seed set. In any case, the overexpressors were clearly smaller, an undesirable phenotype which has to be corrected before overexpression of the gene can lead to any useful crop product.

G362 (SEQ ID NO: 65)

Published Information

G362 was identified in the sequence of BAC clone T10024, GenBank accession number AC007067, released by the *Arabidopsis* Genome Initiative.

Experimental Observations

The function of this gene was analyzed using transgenic plants in which G362 was expressed under the control of the 35S promoter. 35S::G362 had a number of developmental effects with the most prominent result being an increase in trichome number as well as the ectopic formation of trichomes. Overexpression of G362 also increased anthocyanin levels in various tissues at different stages of growth. Seedlings sometimes showed high levels of pigment in the first true leaves. Late flowering lines also became darkly pigmented. Seeds from a number of lines were observed to develop patches of dark purple pigmentation. Inflorescences from 35S::G362 plants were thin, and flowers sometimes displayed poorly developed organs. The seed yield from many lines was somewhat poor. 35S::G362 transgenic plants showed no phenotypic alterations in response to the physiological or biochemical analyses performed.

As determined by RT-PCR, G362 was expressed in roots, and was expressed at significantly lower levels in siliques, seedlings, and shoots. No expression of G362 was detected in the other tissues tested. G362 expression was induced in rosette leaves by heat stress.

Potential Applications

G362 or its equivalogs can be used to alter anthocyanin production. The utilities of this gene includes alterations in pigment production for horticultural purposes, and possibly increasing stress resistance in combination with another transcription factor.

G362 or its equivalogs can be used to delay flowering in transgenic plants. This can have useful implications in crop plants. In species such as sugarbeet where the vegetative parts of the plants constitute the crop and the reproductive tissues were discarded, it would be advantageous to delay or prevent flowering. In addition, extending vegetative development could have a beneficial effect on yield, since the plants have a longer time to build up their photosynthetic capacity. This in turn can translate into larger accumulations of storage products.

G362 or its equivalogs can be used to alter trichome number and distribution in plants. Trichome glands on the surface of many higher plants produce and secrete exudates, which give protection from the elements and pests such as insects, microbes and herbivores. These exudates may physically immobilize insects and spores, may be insecticidal or antimicrobial or they may allergens or irritants to protect against herbivores. Trichome have also been suggested to decrease transpiration by decreasing leaf surface air flow, and by exuding chemicals that protect the leaf from the sun.

Another utility for G362 or its equivalogs is to increase the density of cotton fibers in cotton bolls. Cotton fibers are modified unicellular trichomes that are produced from the ovule epidermis. Typically only 30% of the epidermal cells take on a trichome fate (Basra et al. (1984) *Int. Rev. Cytol.* 89:65-113). Thus cotton yields might be increased by inducing a greater proportion of the ovule epidermal cells to become fibers.

Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides, and cosmetics. One class of secondary metabolites, the diterpenes, can effect several biological systems such as tumor progression, prostaglandin synthesis, and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways were impossible to engineer, increasing trichome density or size on leaves may be the only way to increase plant productivity.

Thus, the use of G362 and its homologs to increase trichome density, size, or type may therefore have profound utilities in so called molecular farming practices (for example, the use of trichomes as a manufacturing system for complex secondary metabolites), and in producing insect-resistant and herbivore-resistant plants.

G371 (SEQ ID NO: 67)

Published Information

G371 was identified as the published gene A-RZF accession number U81598, expressed preferentially in seed development (Zou et al. (1997) *Gene* 196:291-295).

Experimental Observations

The sequence of G371 was experimentally determined and the function of G371 was analyzed using transgenic plants in which G371 was expressed under the control of the 35S promoter. Plants overexpressing G371 appeared to be more sensitive to *Botrytis* infection. No altered morphological or biochemical phenotypes were observed for G371 overexpressing plants.

The function of this gene was also studied by knockout analysis. The phenotype of the G371 knockout was wild-type for all assays performed.

Array analysis of endogenous levels of G371 indicated that this gene was expressed predominantly in embryos, consistent with its published expression pattern. There was no change in the expression of this gene in response to environmental stress according to RT-PCR data. However, according to array data, this gene was induced 4-fold in response to *Erysiphe* infection, its expression was not affected by infection with *Fusarium*, and it was repressed 3-fold after a 12 hour treatment at 4° C.

Potential Applications

Because G371 confers sensitivity to *Botrytis*, this gene or its equivalogs has utility in producing pathogen resistant plants.

G390 (SEQ ID NO: 69)

Published Information

G390 was isolated by Ruzza et al. (GenBank Accession: CAD29544, gi:20069421) using degenerate oligonucleotides corresponding to a conserved 6 amino acid sequence from the helix-3 region of athb-1 and athb-2. It was named athb-9. The published Northern blot showed slightly higher level of expression in stems, and lower levels in leaves, flowers, roots, and siliques. The G390 protein shares very extensive amino acid identity with other HD-ZIP class III proteins that exist in *Arabidopsis* (for example, G391 and G438). HD-ZIP class III proteins are known to have complex roles in determining meristem development, vascular tissue formation, and stem lignification (Baima et al. (1995) *Development* 12:4171-4182; Baima et al. (2001) *Plant Physiol.* 126:643-655; Talbert et al. (1995) *Development* 121:2723-2735; Zhong et al. (1997) *Plant Cell* 9:2159-2170; Sessa et al. (1998) *Plant Mol. Biol.* 38:609-622; Zhong et al. (1999) *Plant Cell* 11:2139-2152; Ratcliffe et al. (2000) *Plant Cell* 12:315-317; and Otsuga et al. (2001) *Plant J.* 25:223-236).

Experimental Observations

Fourteen 35S::G390 T1 lines were obtained which displayed a consistent morphological phenotype; the majority of these plants were slightly small, had abnormal phyllotaxy, and exhibited stem bifurcations in which shoot meristems split to form two or three separate shoots. Additionally, a significant number of these extra T1 lines flowered earlier than controls. Comparable effects were obtained by overexpression of G391.

Potential Applications

The overexpression data suggest that G390 or its equivalogs has utility in the manipulation of shoot architecture. Additionally, since a number of the 35S::G390 lines flowered early, this gene or its equivalogs can be used to manipulate flowering time.

G391 (SEQ ID NO ID NO: 71)

Published Information

G391, also known as Athb-14, was isolated based on its homology with a previously identified homeobox containing gene, Athb-8 (G392). The full-length cDNAs encode proteins of 852 amino acids. Athb-8, -9 and -14 (G392, G390, and G391, respectively) are members of a small family of HD-Zip proteins (HD-ZIP III) characterized by a HD-Zip motif confined to the N-terminus of the polypeptide. The spatial organization of the HD-Zip domain of Athb-8, -9 and -14 is different from that of the Athb-1 (G409, a member of the HD-ZIP I family) and Athb-2 (G400, a member of the HD-ZIP II family) HD-Zip domains. DNA binding analysis performed with random-sequence DNA templates showed that the Athb-9 HD-Zip (HD-Zip-9) domain, but not the Athb-9 HD alone, binds to DNA. The HD-Zip-9 domain recognizes a 11 bp pseudopalindromic sequence (GTAAT(G/C)ATTAC) as determined by selecting high-affinity binding sites from random-sequence DNA. Moreover, gel retardation assays demonstrated that the HD-Zip-9 domain binds to DNA as a dimer. These data supported the notion that the HD-ZIP III domain interacts with DNA recognition elements in a fashion similar to the HD-ZIP I and II domains.

The G391 protein shares very extensive amino acid identity with other HD-ZIP class III proteins that exist in *Arabidopsis* (for example, G390 and G438). These genes are known to have complex roles in determining meristem development, vascular tissue formation, and stem lignification (Baima et al. (1995) *Development* 12:4171-4182; Baima et al. (2001) *Plant Physiol.* 126:643-655; Talbert et al. (1995) *Development* 121:2723-2735; Zhong et al. (1997) *Plant Cell* 9:2159-2170; Sessa et al. (1998) *Plant Mol. Biol.* 38:609-622; Zhong et al. (1999) *Plant Cell* 11:2139-2152; Ratcliffe et al. (2000) *Plant Cell* 12:315-317; and Otsuga et al. (2001) *Plant J.* 25:223-236).

Experimental Observations

The function of this gene was analyzed using transgenic plants in which G391 was expressed under the control of the 35S promoter. Although plants from the T2 generation were wild-type in morphology, the T1 plants showed significant deleterious effects. The plants were small and dark green with short bolts. All other phenotypes were wild-type in all assays performed. As determined by RT-PCR, G391 was moderately expressed in shoots, and was expressed at lower levels in roots, flowers, and rosettes.

An additional sixteen 35S::G391 T1 lines were obtained that displayed a consistent morphological phenotype; the majority of these plants were small, had abnormal phyllotaxy, and exhibited stem bifurcations in which shoot meristems split to form two or three separate shoots. Additionally a significant number of these extra T1 lines flowered earlier than controls. Comparable effects were obtained by overexpression of G390.

Potential Applications

The overexpression data suggested that G391 or its equivalogs have utility in the manipulation of shoot architecture. Additionally, since a number of the 35S::G391 lines flowered early, this gene or its equivalogs can be used to manipulate flowering time.

G409 (SEQ ID NO: 73)

Published Information

G409, also named Athb-1, was one of the earliest plant homeodomain leucine (HD-ZIP) zipper genes cloned. It was isolated from a cDNA library by highly degenerate oligonucleotides corresponding to a conserved eight amino acid sequence from the helix-3 region of the homeodomain. The protein was found to transactivate a promoter linked to a specific DNA binding site (CAATTATTG) by transient expression assays. Overexpression of Athb-1 affected the development of palisade parenchyma under normal growth conditions, resulting in light green sectors in leaves and cotyledons, whereas other organs in the transgenic plants remained normal.

Experimental Observations

G409 was induced by drought and repressed by NaCl. Plants overexpressing G409 were more tolerant to infection by the fungal pathogen *Erysiphe orontii*. In addition to the *Erysiphe* tolerant phenotype, the overexpressors were slightly early flowering.

Potential Applications

The expression of transcription factors such as G409 or its equivalogs involved in plant/pathogen interaction can be modulated to manipulate the plant defense- wound- or insect-response in order to generate pathogen resistant plants.

G427 (SEQ ID NO: 75)

Published Information

G427 corresponds to KNAT4, one of four KNOX class II homeobox genes in *Arabidopsis*. This gene was originally identified by Serikawa et al. ((1996) *Plant Mol. Biol.* 32:673-683) using low-stringency screening of *Arabidopsis* cDNA libraries using the knl homeobox from maize. No genetic characterization of KNAT4 have been published, but it is expressed at high levels in leaves and young siliques (Serikawa et al. (1996) supra). It should be noted that KNAT4 shares a very high level of sequence similarity with another KNOX class II gene, KNAT3 (G426). Expression of each of these genes is light dependent, suggesting that that they might have a role in light regulated developmental processes (Serikawa et al. (1996) supra; Serikawa et al. (1997) *Plant J.* 11:853-861).

Experimental Observations

The function of G427 was assessed by analysis of transgenic *Arabidopsis* lines in which the cDNA was constitutively expressed under the control of the 35S CaMV promoter.

35S::G427 transformants flowered markedly earlier than wild-type controls in conditions of either continuous light or a 12-hour photoperiod. Such results indicated that G427 can promote flowering in *Arabidopsis* under either inductive or non-inductive conditions. These data correlated well with the published observation that G427 expression is light regulated, and indicated that the gene likely has a function in the regulation of flowering time in *Arabidopsis*. Additionally, 35S::G427 seedlings were noted to have rather vertically positioned leaves, a feature that is often apparent in plants with abnormal light regulated development.

Overexpression of G427 in *Arabidopsis* also resulted in an increase in seed oil and a decrease in seed protein in two T2 lines. No other phenotypic alterations were observed.

Potential Applications

G427 or its equivalogs can be used to manipulate seed oil and seed protein content, which may be of nutritional value for human consumption, and for animal feeds.

G427 or its equivalogs can be used to regulate flowering time in commercial species. A wide range of potential applications exist; prevention of flowering might help maximize vegetative yields and prevent escape of GMO pollen, whereas accelerating flowering could shorten crop and tree breeding programs.

Additionally, G427 or its equivalogs can be used in inducible systems that could be used to synchronize flowering in a crop.

G438 (SEQ ID NO: 77)

Published Information

G438 was identified as a homeobox gene (MUP 24.4) within P1 clone MUP 24 (GenBank accession number AB005246). G438 was identified as the *Arabidopsis* REVOLUTA (REV) gene (Ratcliffe et al. (2000) *Plant Cell* 12:315-317). Based on its mutant phenotype, REV had previously been identified as having a key role in regulating the relative growth of apical versus non-apical (cambial) meristems (Alvarez (1994) in *Arabidopsis: An Atlas of Morphology and Development* (ed. J. Bowman), pp. 188-189, New York, N.Y.: Springer-Verlag; Talbert et al. (1995) *Development* 121: 2723-2735). The revoluta phenotype was highly pleiotropic but was characterized by a failure in development of all types of apical meristem: lateral shoot meristems in the axils of cauline and rosette leaves were often completely absent, or replaced by a solitary leaf. These effects were most evident in higher order shoots, but in some cases, the primary shoot meristem also failed and terminated growth in a cluster of filamentous structures. Rev floral meristems often failed to complete normal development and form incomplete or abortive filamentous structures. In contrast to apical meristems, structures formed by non-apical meristems, such as leaves, stems, and floral organs often became abnormally large and contorted in the rev mutant.

The features of rev mutants were similar to those of the interfascicular fiberless1 (ifl1) mutant. Ifl1 was isolated during screens for mutants lacking normal stem fiber differentiation (Zhong et al. (1997) *Plant Cell* 9:2159-2170). Wild-type *Arabidopsis* plants form interfascicular fibers which became lignified and added support to the inflorescence stem (Aloni (1987) *Annu. Rev. Plant Physiol.* 38:179-204); Zhong et al. (1997) supra; Zhong et al. (1999) *Plant Cell* 11:2139-2152). In the ifl1 mutant, normal interfascicular fibers were absent and the differentiation of both xylary fibers and vessel elements was disrupted. In addition to these internal features, ifl1 mutants had secondary morphological features very similar to those of rev. Recently the IFL1 gene was cloned by Zhong et al. (1999 supra). It was found that the IFL1 sequence and map position were identical to those of the REV gene cloned, demonstrating that REV and IFL1 are the same gene. (Ratcliffe et al. (2000) supra).

It had been suggested that REV promotes the growth of apical meristems (including floral meristems) at the expense of non-apical meristems (Talbert et al. (1995) supra). It is not yet clear, however, whether expression data support such a role: strong expression of REV has been detected in interfascicular regions and developing vascular tissue, but in-situ expression analysis of apical meristems has not yet been reported. (Zhong et al. (1999) supra). REV is a group III HD-ZIP protein and shares high sequence similarity (and organization) with the proteins encoded by three other *Arabidopsis* genes: Athb8, Athb9, and Athb 14 (Sessa et al. (1998) *Plant Mol. Biol.* 38:609-622). It is possible, therefore, that these genes act together in the same developmental process. Supporting this suggestion, Athb8 had a similar expression pattern to REV and was transcribed in the procambial regions of vascular bundles (Baima et al. (1995) *Development* 12:4171-4182).

Experimental Observations (Knockout)

G438 was initially identified as MUP24.4, a novel putative homeobox gene within P1 clone MUP24 (GenBank Accession AB005246). Annotation was confirmed by isolation of the G438 cDNA: the cDNA had an in-frame stop codon immediately 5' to the predicted start codon and comprised 18 exons that had been predicted within the genomic sequence.

Plants homozygous for a T-DNA insertion in the G438 sequence were obtained by PCR based screening of DNA pools from the Jack Collection of insertional mutants (Campisi et al. (1999) *Plant Journal* 17:699-707). The T-DNA insertion was located 466 bp downstream of the putative start codon, and was predicted to create a null mutation. The mutation was recessive and produced a revoluta phenotype. Complementation crosses and sequencing of a known revoluta allele demonstrated that G438 was REVOLUTA.

RT-PCR analyses detected G438 expression at medium to high levels in all tissues and conditions tested. Further expression analysis was possible since the T-DNA insertion contained an enhancer trap construct (Campisi et al. (1999) supra). GUS staining could therefore be used to reveal the expression pattern of genes within which insertions occurred. GUS staining of seedlings homozygous and heterozygous for the G438 T-DNA insertion revealed very strong expression within axillary shoots. This expression data correlates with the marked effects of the rev mutation on outgrowth of higher order shoots.

Experimental Observations (Overexpressor)

A full-length clone was amplified from cDNA derived from mixed tissue samples, and 35S::G438 transformants were generated. These lines appeared wild-type in the physiological assays, but showed differences in morphology compared with control plants. At early stages, a small number of T1 plants displayed aberrant phyllotaxy and were rather dwarfed, but these effects were inconsistent, and the majority of lines appeared wild-type. At later stages, however, around half of the primary transformants, from two of the three T1 sowings, developed slightly larger flatter leaves than wild type at late stages. The progeny of four lines that had shown these phenotypes were examined in the T2 generation. At late stages, plants from two of these T2 populations again displayed slightly broad flat leaves, but plants from the other two T2 populations appeared wild-type at all stages.

A single T1 plant line out of a total of 37 lines had highly aberrant shoot meristem development. At the early seedling stage, it appeared as though the primary shoot apex of this individual had developed into a terminal leaf-like structure. Subsequent growth then continued from an axillary shoot meristem that initiated from the base of a cotyledon petiole. However, this effect became silenced between generations and was not observed in the T2 progeny from one line. Given that this effect was observed in only a single line, it could have been the result of an activation tagged locus at the T-DNA insertion site, rather than due to G438 expression. However, the phenotype would fit with a role for REV in regulating apical meristem development.

Potential Applications

The mutant phenotypes indicated that REV/IFL1 or its equivalogs have an important role in determining overall plant architecture and the distribution of lignified fiber cells within the stem. A number of utilities can be envisaged based upon these functions.

Modifying the activity of REVOLUTA orthologs from tree species can offer the potential for modulating lignin content. This can allow the quality of wood used for furniture or construction to be improved. Lignin is energy rich; increasing lignin composition could therefore be valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production (Tzira et al. (1998) *TIBTECH* 16:439-446; Robinson (1999) *Nature Biotechnology* 17:27-30). In addition to forest biotechnology applications, changing lignin content might increase the palatability of various fruits and vegetables.

In *Arabidopsis*, reduced REV activity results in a reduction of higher-order shoot development. Reducing activity of REV orthologs may generate trees that lack side branches, and have fewer knots in the wood. Altering branching patterns can also have applications amongst ornamental and agricultural crops. For example, applications might exist in any species where secondary shoots currently have to be removed manually, or where changes in branching pattern could increase yield or facilitate more efficient harvesting.

G450 (SEQ ID NO: 79)

Published Information

G450 is IAA14, a member of the Aux/IAA class of small, short-lived nuclear proteins that contain four conserved domains. IAA14 was found as one of a group of *Arabidopsis* IAA genes that was isolated based on homology to early auxin-induced genes of pea (Abel et al. (1995) *J. Mol. Biol.* 251:533-549). Recently a gain-of-function mutant in IAA14, slr (solitary root), was found to abolish lateral root formation, reduce root hair formation, and impair gravitropic responses (Fukaki (2001) Abstracts 12th Intl. Conf. *Arabidopsis* Res. #448, Madison, Wis.).

Experimental Observations

Overexpression of G450 influenced leaf development, overall plant stature, and seed size. 35S::G450 plants produced seeds that were larger than wild-type seed.

Potential Applications

G450 or its equivalogs can used to produce larger seed in plants, which may positively influence seed storage characteristics, appearance and yield.

G464 (SEQ ID NO: 81)

Published Information

G464 is IAA12, a member of the Aux/IAA class of small, short-lived nuclear proteins that contain four conserved domains. IAA12 was found as one of a group of *Arabidopsis* IAA genes that was isolated based on homology to early auxin-induced genes of pea. IAA12 transcripts were modestly (2 to 4-fold) induced by auxin, with optimal induction at 10 μM auxin (Abel et al. (1995) *J. Mol. Biol.* 251:533-549).

Experimental Observations

G464 overexpressing *Arabidopsis* lines showed enhanced germination in high heat conditions. In addition, one *Arabidopsis* line overexpressing G464 showed an increase in total seed protein and a decrease in total seed oil by NIR in one assay.

Potential Applications

G464 or its equivalogs in native or altered form is useful to produce plants that germinate better in hot conditions.

G470 (SEQ ID NO: 83)

Published Information

A partial cDNA clone corresponding to G470 was isolated in a two-hybrid screen for proteins that interact with ARF1, a transcription factor that binds to auxin response elements, and this clone was named ARF1 Binding Protein (Ulmasov et al. (1997) *Science* 276:1865-1868). A full-length clone was later isolated, and the gene was renamed ARF2 (Ulmasov et al. (1999a) *Proc. Natl. Acad. Sci.* 96:5844-5849). ARF2 was shown to bind to an auxin response element (Ulmasov et al. (1999b) *Plant J.* 19:309-319).

Co-transfection of ARF2 and a reporter construct with an auxin response element into carrot protoplasts did not result in either activation or repression of transcription of the reporter gene (Ulmasov et al. (1999a) supra). ARF2 binding to palindromic auxin response elements is thought to be facilitated by dimerization mediated by the carboxy-terminal domain of ARF2 (Ulmasov et al. (1999b) supra). It is possible that ARF2 regulates gene expression through heterodimerization with other ARF proteins or with IAA proteins. ARF2 was found to be expressed uniformly in roots, rosette leaves, cauline leaves, flowers, and siliques (Ulmasov et al. (1999b) supra).

Experimental Observations

Expression of a truncated G470 clone in the antisense orientation under the 35S promoter caused infertility in *Arabidopsis*. In primary transformants expressing the G470 clone, the stamens failed to elongate properly. Pollen was produced, but was not deposited on the stigma. The transformants appeared otherwise morphologically normal. Because of the infertility of the primary transformants, no material was available for biochemical and physiological analyses. The truncated clone corresponds to the carboxy-terminal portion of the ARF2 protein, and lacks the DNA binding domain.

Potential Applications

G470 or its equivalogs are useful in engineering infertility in self-pollinating plants.

G477 (SEQ ID NO ID NO: 85)

Published Information

G477 corresponds to SPL6 (AJ011643, Cardon et al. (1999) *Gene* 237:91-104), a member of the SBP family of transcription factors. G477 is expressed constitutively throughout the development of *Arabidopsis*. Outside the SBP-domain, G477 has a putative myc-like helix-loop-helix dimerization domain (Cardon et al. (1999) supra).

Experimental Observations

The complete sequence of G477 was determined. The function of this gene was analyzed using transgenic plants in which G477 was expressed under the control of the 35S promoter. The phenotype of these transgenic plants was wild-type in all morphological and biochemical assays performed.

Plants overexpressing G477 were slightly more sensitive to the herbicides glyphosate and acifluorfen and to oxidative stress caused by rose bengal compared with wild-type controls. Plants overexpressing G477 also develop more disease symptoms following inoculation with a moderate dose of *Sclerotinia sclerotiorum* compared with control plants. It is well known that oxidative stress is a component of a plant defense response to pathogen and therefore the disease susceptibility phenotype could be related to a general sensitivity to oxidative stress.

G477 was expressed in all tissues and under all conditions tested in RT-PCR and cDNA microarray experiments.

Potential Applications

G477 activity was shown to affect the response of transgenic plants to the fungal pathogen *Sclerotinia sclerotiorum* and oxidative stress tolerance. Therefore, G477 or its equivalogs can be used to manipulate the defense response in order to generate pathogen-resistant plants.

G481 (SEQ ID NO: 87)

Published Information

G481 is equivalent to AtHAP3a which was identified by Edwards et al. ((1998) *Plant Physiol.* 117:1015-1022) as an EST with extensive sequence homology to the yeast HAP3. Northern blot data from five different tissue samples indicated that G481 was primarily expressed in flower and/or silique, and root tissue.

Experimental Observations

G481 was analyzed through its ectopic overexpression in plants. G481 overexpressors were more tolerant to high sucrose in a germination assay. The phenotype of G481 was mild; however, there was a consistent difference in the hypocotyl and root elongation in the overexpressor plants compared to wild-type controls. Sucrose-sensing has been implicated in the regulation of source-sink relationships in plants. Consistent with the sugar sensing phenotype of the G481 overexpressors were the results from the biochemical analysis of G481 overexpressor plants indicating that one line had higher amounts of seed oils and lower amounts of seed protein. This suggested that G481 was involved in the allocation of storage compounds to the seed. One G481 overexpressor line was darker green in the T2 generation, which could mean a higher photosynthetic rate consistent with the possible role of G481 in sugar sensing.

G481 overexpressing plants were found to be more tolerant to drought in a soil-based assay.

Potential Applications

The utility of G481 or its equivalogs includes a role in sugar sensing, a plant mechanism that has been shown to be involved in the following: 1) altering storage compound accumulation (oil and/or protein) in seeds which could impact yield and seed quality, and 2) altering photosynthetic rate which could also impact yield in vegetative tissues as well as seed. G481 was shown to alter sugar sensing. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships).

The enhanced germination phenotype of transgenic plants overexpressing G481 under a condition of drought or osmotic stress (such as high concentrations of sucrose) suggested the gene or its equivalogs can also be used to improve plant tolerance to water deficit related conditions such as water deprivation, salt stress, and freezing stress. Thus, G481 can be used to engineer plants with enhanced stress tolerance that can ultimately impact survivability and yield.

G482 (SEQ ID NO: 89)

Published Information

G482 is equivalent to AtHAP3b which was identified by Edwards et al. ((1998) *Plant Physiol.* 117:1015-1022) as an EST with homology to the yeast gene HAP3b. Edwards' northern blot data suggests that AtHAP3b is expressed primarily in roots. No other functional information regarding G482 is publicly available.

Experimental Observations

G482 function was analyzed through its ectopic overexpression in plants under the control of a 35S promoter. G482 overexpressors were more tolerant to high NaCl in a germination assay.

RT-PCR analysis of endogenous levels of G482 transcripts indicated that this gene was expressed constitutively in all tissues tested. A cDNA array experiment supported the RT-PCR derived tissue distribution data. G482 was not induced above basal levels in response to any environmental stress treatments tested.

Potential Applications

The utilities of this gene or its equivalogs include the ability to confer salt tolerance during the germination stage of a crop plant. This would most likely impact survivability and yield. Evaporation of water from the soil surface causes upward water movement and salt accumulation in the upper soil layer, where the seeds were placed. Thus, germination normally takes place at a salt concentration much higher than the mean salt concentration in the whole soil profile.

G484 (SEQ ID NO: 91)

Published Information

G484 is equivalent to ATHDR1B and was isolated by Kuromori et al. ((1994) *Nucleic Acids Res.* 22:5296-5301). The *Arabidopsis* sequence is highly homologous to the human DR1 gene that has been shown to interact with TATA-binding protein (TBP) to repress transcription of class II genes (Yeung et al. (1994) *Genes Dev.* 8:2097-2109).

Experimental Observations

Homozygous knockout mutant plants as well as plants ectopically overexpressing G484 were used to determine the function of this gene in *Arabidopsis*. Insertion of T-DNA into G484 at nucleotide position +439 with respect to the start ATG codon was within the first third of the G484 coding sequence of the gene and therefore was likely to result in a null mutation. The phenotype for G484 overexpressor and knockout mutant plants was similar to wild-type for all morphological, biochemical and physiological assays performed. RT-PCR analysis of the endogenous levels of G484 transcripts indicated that this gene was expressed primarily in shoots, roots and flowers, with a low level expression in the other tissues tested. G484 was not induced significantly above basal levels in response to any environment stress treatments tested.

Potential Applications

G484 knockout mutant seed had an altered glucosinolate profile and therefore the gene or its equivalogs can be used to modify glucosinolate composition in plants.

G489 (SEQ ID NO: 93)

Published Information

G489 was identified from a BAC sequence that showed high sequence homology to AtHAP5-like transcription factors in *Arabidopsis*. No published information is available regarding the function of this gene.

Experimental Observations

The function of G489 was analyzed through its ectopic overexpression in plants. G489 overexpressors were more tolerant to high NaCl stress, showing more root growth and leaf expansion compared with the controls in culture. Two well characterized ways in which NaCl toxicity is manifested in the plant is through general osmotic stress and potassium deficiency due to the inhibition of its transport. These G489 overexpressor lines were more tolerant to osmotic stress in general, showing more root growth on mannitol containing media.

RT-PCR analysis of endogenous levels of G489 transcripts indicated that this gene was expressed constitutively in all tissues tested. A cDNA array experiment confirmed the RT-PCR derived tissue distribution data. G489 was not induced above basal levels in response to the stress treatments tested.

Potential Applications

The utilities of this gene or its equivalogs include the ability to confer salt tolerance during the growth and developmental stages of a crop plant. This would impact yield and or biomass.

G490 (SEQ ID NO: 95)
Published Information

G490 is member of the Hap5-like subfamily of the CAAT-box binding transcription factors. G490 was identified in the sequence of BAC MXA21, GenBank accession number AB005247, released by the *Arabidopsis* Genome Initiative.

Experimental Observations

The complete sequence of G490 was determined. The function of this gene was analyzed using transgenic plants in which G490 was expressed under the control of the 35S promoter. The phenotype of these transgenic plants was wild-type in all physiological assays performed. Overexpression of G490 resulted in a marked early flowering phenotype under continuous light conditions.

During initial studies on lines #1-20, plants were not carefully examined for flowering time, and at later developmental stages, appeared to have a wild-type phenotype. To assess flowering time more carefully, a further batch of 35S::G490 T1 plants were grown. The majority of these plants showed a very clear acceleration of flowering and had visible flower buds up to a week earlier than wild type. At later stages the plants appeared wild-type. To confirm these observations, T2 progeny from three early flowering T1 plants were grown; all three T2 lines showed early flowering.

In addition to the flowering time phenotype, seed of 35S::G490 transgenic plants showed altered tocopherol composition. In seeds of two lines, an increase in the percentage of delta-tocopherol was observed.

As determined by RT-PCR, G490 was expressed at low levels in flower, rosette leaf, embryo and silique. No expression of G490 was detected in the other tissues tested. G490 expression is induced to low levels in rosette leaves by auxin treatment, drought, heat, osmotic and salt stress treatments.

Potential Applications

One utility of a gene such as G490 or its equivalogs is to accelerate flowering.

In addition, G490 or its equivalogs can be used to alter tocopherol composition. Tocopherols have anti-oxidant and vitamin E activity.

G504 (SEQ ID NO: 97)
Published Information

G504 was identified in the sequence of BAC F11P17, GenBank accession number AC002294, released by the *Arabidopsis* Genome Initiative.

Experimental Observations

The complete sequence of G504 was determined. The function of this gene was analyzed using transgenic plants in which G504 was expressed under the control of the 35S promoter. The phenotype of these transgenic plants was wild-type in all physiological and biochemical assays performed. 35S::G504 transgenic plants had a subtle leaf phenotype in the early developmental stages but were wild-type in appearance in later stages of development. In one transgenic line, a decrease in seed oil as measured by NIR was observed. Also, seeds of this same line also showed an increase in the percentage of 18:2 fatty acid and a decrease in the percentage of 20:1 fatty acid.

In an RT PCR experiment, endogenous G504 appeared to be expressed specifically and at high levels in flower tissue. No induction of endogenous G504 expression in leaf tissue was detected in response to any environmental conditions tested.

Potential Applications

G504 or its equivalogs may be used to modify seed oil content in seeds, which may be very important for the nutritional value and production of various food products. The promoter of G504 can be used to engineer flower specific gene expression.

G509 (SEQ ID NO: 99)
Published Information

G509 was identified in the sequence of BAC F20O9, GenBank accession number AL021749, released by the *Arabidopsis* Genome Initiative.

Experimental Observations

The function of G509 was analyzed using transgenic plants in which G509 was expressed under the control of the 35S promoter, as well as using a line homozygous for a T-DNA insertion in G509. The T-DNA insertion of G509 at nucleotide position +1583 with respect to the start ATG codon was approximately half way into the coding sequence of the gene and therefore was likely to result in a null mutation. G509 primary transformants showed no significant morphological differences from control plants, though one T2 line was noted to be small and sickly at the seedling and rosette stages, and pale and late flowering at the flowering stage. Knockout plants showed no consistent morphological differences from controls. G509 knockout plants may be more susceptible to infection with a moderate dose of the fungal pathogen *Erysiphe orontii;* 8 out of 8 plants tested showed more fungal growth compared with the wild-type controls. G509 lines had significantly higher levels of chlorophyll a, and lower levels of chlorophyll b in seeds.

G509 knockout mutants produced more seed oil and more seed protein than wild-type control plants.

Endogenous G509 was expressed constitutively in all tissues tested, with the highest levels of expression in shoots, roots, flowers and siliques.

Potential Applications

G509 or its equivalogs can be used to produce plants with altered seed oil and seed protein content.

G509 or its equivalogs can be used to manipulate the defense response in order to generate pathogen-resistant plants.

In addition, G509 or its equivalogs can be used to regulate the levels of chlorophyll in seeds.

G519 (SEQ ID NO: 101)
Published Information

G519 was first identified in the sequence of the P1 clone MBK5, GenBank accession number AB005234, released by the *Arabidopsis* Genome Initiative.

Closely Related Genes from Other Species

A related gene to G519 is the rice gene OsNAC6 (GenBank accession number BAA89800).

Experimental Observations

The function of G519 was analyzed with transgenic plants in which G519 was expressed under the control of the 35S promoter.

RT-PCR analysis was used to determine the endogenous levels of G519 in a variety of tissues and under a variety of environmental stress-related conditions. G519 was constitutively expressed with the highest level of expression in shoots, roots and seedlings. RT-PCR data also indicated an induction of G519 transcripts accumulation upon auxin, abscisic acid (ABA), cold, heat, *Fusarium* and salicylic acid (SA) treatments.

As measured by NIR, G519 overexpressors were found to have increased seed oil content compared to wild-type plants.

Potential Applications

G519 or its equivalogs may be used to alter seed oil content in plants, which may be very important for the nutritional value and production of various food products.

G545 (SEQ ID NO: 103)

Published Information

G545 was discovered independently by two groups. Lippuner et al. (1996) *J. Biol. Chem.* 271:12859-12866) identified G545 as an *Arabidopsis* cDNA (STZ), which increases the tolerance of yeast to Li+ and Na+. They found that STZ expression is most abundant in leaves and roots, and that its level of expression increases slightly upon exposure of the plant to salt. The second group (Meissner et al (1997) *Plant Mol. Biol.* 33:615-624), identified G545 (ZAT10) in a group of *Arabidopsis* C2H2 zinc finger protein-encoding cDNAs that they isolated by degenerate PCR. According to their data, ZAT10 is expressed in roots, shoots and stems.

Closely Related Genes from Other Species

A closely related non-*Arabidopsis* sequence is a cDNA from the nitrogen-fixing species *Datisca glomerata* (AF119050). The similarity of this sequence with G545 extends beyond the conserved domain.

Experimental Observations

Plants overexpressing G545 flowered early, and in extreme cases were infertile. G545 overexpression conferred tolerance of transgenic plants to phosphate deficiency. This could be the result of insensitivity to phosphate, higher rates of phosphate assimilation or larger stores of phosphate. G545 overexpressors also appeared to be more sensitive to NaCl than wild-type plants. This result was unexpected, since yeast cells overexpressing G545 are more tolerant to salt stress than control cells. There may be a dominant negative effect in plants, triggered by the over-accumulation of the G545 protein, which does not exist in yeast.

G545 overexpressing plants appeared to be significantly more susceptible to pathogens than control plants. This implied a role for the G545 in the control of defense mechanisms.

Potential Applications

G545 or equivalog overexpression may result in tolerance to phosphate deficiency. Young plants have a rapid intake of phosphorous, so it is important that seed beds have high enough content in phosphate to sustain their growth. Also, root crops such as carrot, potato and parsnip will all decrease in yield if there is insufficient phosphate available. Phosphate costs represent a relatively small but significant portion of farmers' operating costs (3-4% of total costs to a corn farmer in the US, higher to a vegetable grower). Plants that are tolerant to phosphate deficiency can represent a cost saving for farmers, especially in areas where soils are very poor in phosphate.

Another desirable phenotype, salt tolerance, may arise from G545 or equivalog silencing rather than overexpression.

Additionally, G545 appeared to be induced by cold, drought, salt and osmotic stresses, which was in agreement with a potential role of the genes in protecting the plant in such adverse environmental conditions.

G545 also appears to be involved in the control of defense processes. However, overexpression of G545 made *Arabidopsis* plants more susceptible to disease. This negative effect will have to be corrected before G545 can be used in a crop to induce tolerance to low phosphate, such as by restricting overexpression of G545 or its equivalogs to roots.

G546 (SEQ ID NO: 105)

Published Information

G546 was identified in the sequence of P1 clone MJB20 and BAC clone T19E12, GenBank accession number AC007584, released by the *Arabidopsis* Genome Initiative.

Closely Related Genes from Other Species

G546 homologs in other species are Y14573.1: 33104.33991 from barley, OSJNBb0064P21.7 from rice.

Experimental Observations

RT-PCR was used to analyze the endogenous levels of G546 transcripts. RT-PCR data indicated that G546 was expressed constitutively in all tissues examined. There was a moderate level of G546 transcript detected in shoots and roots while in flowers, rosette and cauline leaves, and siliques transcript level was low. G546 transcripts were not elevated in response to the environmental stress treatments.

The function of this gene was analyzed using transgenic plants in which G546 was expressed under the control of the 35S promoter. Overexpression of G546 in *Arabidopsis* resulted in one line in which seedlings were ABA insensitive in a germination assay. Morphologically, the plants were small at early stages, grew slowly, became dark colored, and senesced late. Somewhat similar effects were observed in approximately half of the primary transformants. 35S::G546 transformants also sporadically displayed increased anthocyanin levels in cotyledons at the seedling stage, young leaves, and in the stems of secondary shoots.

Potential Applications

G546 appears to affect ABA sensitivity, therefore, G546 or its equivalogs may have a utility in modifying ABA responses such as seed dormancy and drought tolerance.

In addition, G546 or its equivalogs could be used to alter anthocyanin production. The potential utilities of this gene include alterations in pigment production for horticultural purposes, and increasing stress resistance, possibly in combination with another transcription factor.

G561 (SEQ ID NO: 107)

Published Information

G561 is the *Arabidopsis* gene GBF2 (Schindler et al (1992) *EMBO J.* 11:1261-1273), which was cloned by hybridization to GBF1. GBF2 is constitutive in both light and dark grown leaves, expressed in roots, and the nuclear import of GBF1 may be light regulated (Terzaghi et al (1997) *Plant J.* 11:967-982).

Closely Related Genes from Other Species

Close relatives of G561 include a G-box binding protein from *Sinapis alba* (Y16953; unpublished) and a G-Box binding protein from *Raphanus sativus* (X92102, unpublished).

Experimental Observations

The function of G561 was analyzed using transgenic plants in which this gene was expressed under the control of the 35S promoter. Plants over-expressing G561 showed more root growth on potassium free media. Expression of G561 also appears to be constitutive, and may be preferentially expressed in siliques and moderately inducible with heat stress.

An important aspect of the potassium root growth assay is that plants were firstly germinated on media with potassium and then transferred onto potassium-free media. G561 overexpressors may have be able to somehow cope with less potassium, and it is also possible that G561 overexpressors accumulated more potassium before they were transferred, which allowed the roots to grow more vigorously after transfer.

As measured by NIR, G561 overexpressors were found to have increased seed oil content compared to wild-type plants.

Potential Applications

G561 or its equivalogs could be used to increase seedling vigor or plant growth in soils that are low in potassium. Potassium is a macronutrient required for a variety of basic plant functions which is commonly added to soil as a fertilizer. The ability to grow plants on low potassium soils may save the ecological and material cost of soil fertilization.

G561 or its equivalogs may also be used to manipulate sterol composition, and may be used to modify seed oil content in plants, which may be very important for the nutritional value and production of various food products.

G562 (SEQ ID NO: 109)

Published Information

G562 is the published *Arabidopsis* transcription factor GBF3, which was cloned through its hybridization with GBF1 (Schindler et al. (1992) *EMBO J.* 11: 1261-1273). GBF3, like GBF1 and GBF2, can bind G-box elements as a homodimer, or as a heterodimer with other bZIP family members. GBF3 appears to be highly expressed in roots in comparison to leaves, and repressed by light. GBF3 binds to G-box elements in the *Arabidopsis* ADH promoter in vitro, is induced by ABA in suspension cultures, and is proposed to be the transcription factor responsible for the ABA regulated ADH gene expression (Lu et al. (1996) *Plant Cell.* 8:847-857).

Closely Related Genes from Other Species

Similar genes to G562 include the *B. napus* proteins BnGBF1 and BnGBF2 (U27107 and U27108) which are strikingly similar to G562 for their entire lengths. An unpublished *Catharanthus roseus* G-box binding protein 1 protein (AF084971) also has significant homology to G562 outside of the conserved domain.

Experimental Observations

G562 appeared to be preferentially expressed in root and flower tissues by RT-PCR analysis, and expressed at lower levels in other tissues of the plant. G562 was induced by heat, drought and osmotic stress in seedlings. The function of G562 was analyzed using transgenic plants in which G562 was expressed under the control of the 35S promoter. Plants overexpressing G562 were consistently and significantly later flowering, with more crinkled leaves than wild-type plants.

Potential Applications

G562 or its equivalogs could be used to manipulate flowering time in plants.

G567 (SEQ ID NO: 111)

Published Information

G567 was discovered as a bZIP gene in BAC T10P11, accession number AC002330, released by the *Arabidopsis* genome initiative.

Closely Related Genes from Other Species

G567 is similar to two bZIP factors from *Petroselinum crispum* (1806261) and *Glycine max* (1905785). Similarity between these two proteins and the protein encoded by G567 extends beyond the conserved domains and thus they may have a function and utility to G567.

Experimental Observations

The annotation of G567 in BAC AC002330 was experimentally confirmed and the function of G567 was analyzed using transgenic plants in which G567 was expressed under the control of the 35S promoter.

Seedlings overexpressing G567 had slowly opening cotyledons and very short roots when grown on MS plates containing glucose. G567 is thus likely to be involved in sugar sensing or metabolism during germination.

As measured by NIR analysis, plants overexpressing G567 had an increase in total combined seed oil and seed protein content.

G567 appears to be constitutively expressed, and induced in leaves in a variety of conditions.

Potential Applications

G567 or its equivalogs may be useful in manipulating seed oil and protein content.

G567 or its equivalogs may be used to modify sugar sensing.

In addition to their important role as an energy source and structural component of the plant cell, sugars are central regulatory molecules that control several aspects of plant physiology, metabolism and development. It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, manipulating the sugar signal transduction pathway may lead to altered gene expression to produce plants with desirable traits. In particular, manipulation of sugar signal transduction pathways could be used to alter source-sink relationships in seeds, tubers, roots and other storage organs leading to increase in yield.

G568 (SEQ ID NO: 113)

Published Information

G568 was identified in the sequence of BAC T19K4, GenBank accession number AL022373, released by the *Arabidopsis* Genome Initiative.

Closely Related Genes from Other Species

The PTBF1 gene from *Populus×generosa* appears to be a potential homolog of G568 (GenBank accession no AF288616). PTBF1 expression is associated with terminal bud formation.

Experimental Observations

The annotation of G568 in BAC AL022373 was experimentally confirmed. G568 appeared to be preferentially expressed in shoots, roots and flowers and its expression was strongly repressed by the fungal pathogens *Erysiphe orontii* and *Fusarium oxysporum*, indicating that in some way it could be a repressor of a defense response.

The function of this gene was analyzed using transgenic plants in which G568 was expressed under the control of the 35S promoter. Plants overexpressing G568 displayed a variety of morphological phenotypes. These morphological phenotypes include narrow leaves, a darker green coloration, and bushy, spindly, poorly fertile shoots, dwarfing and flowering time alteration. No disease-related phenotype was observed.
Potential Applications G568 or its equivalogs may be used to manipulate plant architecture and flowering time. The expression pattern of G568 also indicated a use for this gene or its equivalogs in manipulating the defense response. The promoter of G568 may also have some utility as a promoter that can be used to engineer down-regulation of gene expression in response to pathogen attack.
G584 (SEQ ID NO: 115)
Published Information G584 was identified in chromosome IV BAC T6K21 sequence (gene T6K21.10) by the EU *Arabidopsis* sequencing project as "bHLH protein-like".
Closely Related Genes from Other Species A related gene to G584 is *Phaseolus vulgaris* phaseolin G-box binding protein PG1 (U18348). Similarity between G584 and PG1 extends beyond the signature motif of the family. No functional information is available for gene PG1 other than that the protein binds to a G-box motif CACGTG of the bean seed storage protein beta-phaseolin gene.
Experimental Observations The function of G584 was analyzed using transgenic plants in which G584 was expressed under the control of the 35S promoter. G584 transgenic plants seemed to produce seed of a larger size than control plants. Analysis of G584 overexpressors revealed no apparent physiological or biochemical changes when compared to wild-type control plants. Analysis of the endogenous expression level of G584, as determined by RT-PCR, revealed a moderate and constitutive expression level in all *Arabidopsis* tissues examined. G584 transcript level remained similar to wild-type controls in all the treatments examined.
Potential Applications G584 or its equivalogs could be used to produce larger seed size and/or altered seed morphology, which may positively influence seed storage characteristics, appearance and yield.
G585 (SEQ ID NO: 117)
Published Information G585 has been identified as GL3. It has been shown that G585 regulates trichome development in *Arabidopsis* through interaction with GL1 and TTG1 (Payne et al. (2000) *Genetics*. 156:1349-1362). An increase in the trichome density was observed in GL3 overexpressed transgenic plants in WS background.
Closely Related Genes from Other Species G585 protein shares a significant homology to GHDEL65 [*Gossypium hirsutum*] protein (PID:g13346182) as well as DEL [*Antirrhinum majus*] protein (PID:g166428).
Experimental Observations The sequence of G585 was experimentally determined and the function of G585 was analyzed using transgenic plants in which G585 was expressed under the control of the 35S promoter.

Overexpression of G585 reduced trichome density on leaves and stems. Since this phenotype was confined to a proportion of plants in a single T2 line, it could have been due to co-suppression. To examine this, a second selection of T1 plants was screened: one out of 18 of these plants exhibited a clear reduction in trichome density. Since the glabrous effects were eventually seen in two independent lines, they most likely represented a low penetrance G585 overexpression phenotype or co-suppression. An increase in the trichome density was not observed in G585 overexpressed transgenic plants in an ecotype background. These results are different from the published information, and may simply be due to the difference in ecotype used.

As determined by RT-PCR, G585 was uniformly expressed at low level in all tissues tested. Expression level of G585 appears to be enhanced by auxin treatments and repressed by pathogen *Fusarium* infections.
Potential Applications G585 or its equivalogs can be used to affect trichome number and/or distribution. A transcription factor that alters trichome number could be used to increase the production of chemical compounds (like essential oils) that are synthesized and/or stored in trichomes, as well as to protect plants against damage from a variety of herbivores.
G590 (SEQ ID NO ID NO: 119)
Published Information The sequence of G590 was obtained from the *Arabidopsis* genome sequencing project, GenBank accession number Z99707, based on its sequence similarity within the conserved domain to other bHLH/Myc related proteins. A knockout mutant in G590, named as SPATULA, has also been isolated and characterized (Heisler et al. (2000) *Development* 128:1089-1098).
Experimental Observations The function of this gene was studied by knockout analysis and by using transgenic plants in which G590 was expressed under the control of the 35S promoter.

G590 knockout plants produced more seed oil than wild-type controls.

Overexpression of G590 resulted in a reduction in flowering time and a shorter generation time. Under continuous light conditions, G590 overexpressing plants typically produced visible flower buds approximately one week earlier than wild-type controls. At the time of bolting, these plants had 4-8 rosette leaves compared with 8-11 in wild type. Additionally, G590 overexpressor had rather pointed leaves at early stages of development. The plants also appeared slightly small, yellow, and later, had elongated leaf petioles. No other physiological and biochemical alterations were observed in the overexpression transgenic plants when compared to wild-type controls.

Gene expression profiling using RT-PCR shows that G590 was relatively expressed at higher levels in flowers, siliques and roots. Its expression level was unaffected by any of the conditions tested.
Potential Applications G590 or its equivalogs could be used to increase seed oil content, which would be of nutritional value for food for human consumption as well as animal feeds.

Based on the current analysis of G590 overexpressing plants, G590 or its equivalogs could be used to manipulate flowering time. A wide variety of applications exist for systems that shorten the time to flowering.
G594 (SEQ ID NO: 121)
Experimental Observations The function of this gene was studied using transgenic plants in which G594 was expressed under the control of the 35S promoter.

Plants overexpressing G594 showed more disease symptoms following infection with the necrotrophic fungal pathogen *Sclerotinia sclerotiorum* compared to control plants. In a repeat experiment on individual lines, two lines showed the enhanced susceptibility phenotype. No other consistent morphological or biochemical differences were observed between G594 overexpressors and wild-type plants.

RT-PCR analysis of G594 transcripts indicate that G594 was constitutively expressed in all tissues with exception of roots. The expression level of G594 was induced by auxin treatments and repressed by cold, *Erysiphe* and *Fusarium* treatments.

Potential Applications

Since G594 transgenic plants have an altered response to the necrotrophic fungal pathogen *Sclerotinia sclerotiorum*, G594 or its equivalogs could be used to manipulate the defense response in order to generate pathogen-resistant plants.

G597 (SEQ ID NO: 123)

Published Information

G597 was identified in the sequence of BAC F4P9, GenBank accession number AC002332, released by the *Arabidopsis* Genome Initiative.

Closely Related Genes from Other Species

G597 has significant homology to a DNA-binding protein PD1 [*Pisum sativum*] and an *Oryza sativa* putative AT-Hook DNA-binding protein (PID:12643044).

Experimental Observations

The function of this gene was studied using transgenic plants in which G597 was expressed under the control of the 35S promoter.

Approximately half of the G597 primary transformants were observed to have narrow curled rosette leaves. Four T1 plants were also observed to be later bolting than wild type. However, these phenotypes were not apparent in the initial plantings or re-plants of the T2 populations.

Overexpression of G597 in one line caused an alteration in the leaf cell wall polysaccharide composition. An increase in the percentage of xylose and a decrease in the percentage of rhamnose was detected. Otherwise, G597 overexpressors behaved similarly to wild-type controls in all biochemical assays performed.

Based on the RT-PCR analysis, G597 was constitutively expressed in all tissues. Lower expression levels were observed in siliques and cauline leaves. Its expression level was unaffected by any of the conditions tested.

As measured by NIR, G597 overexpressors were found to have increased seed oil and decreased seed protein content as compared to wild-type plants.

Potential Applications

G597 or its equivalogs may be used to alter seed protein content in plants, which may be very important for the nutritional value and production of various food products.

G598 (SEQ ID NO: 125)

Published Information

G598 was identified in chromosome II BAC T6D20 sequence (gene T6D20.23) by The Institute for Genomic Research as an "unknown protein".

Experimental Observations cDNAs representing two splice variants of G598 were identified. These splice variants differ in the 3' end region and would produce proteins with different C-termini. The function of G598 was analyzed using transgenic plants in which splice variant number 1 of G598 was expressed under the control of the 35S promoter. G598 overexpressors had higher seed oil content in all three lines tested when measured by NIR. These three lines also showed increased galactose levels when insoluble sugar composition was determined. Otherwise, G598 overexpressors behaved similarly to wild-type controls in all biochemical assays performed. The characterization of G598 overexpressors revealed no apparent morphological or physiological changes when compared to wild-type control plants. Analysis of the endogenous expression level of G598, as determined by RT-PCR, revealed a moderate and constitutive expression level in all tissues and conditions examined.

One transgenic line showed a reproducible increase in galactose in leaves.

Potential Applications

On the basis of the biochemical analyses performed to date, G598 or its equivalogs may play a role in the accumulation or regulation of leaf insoluble sugars. Insoluble sugars are among the building blocks of plant cell walls. Transcription factors that alter plant cell wall composition such as galactose have several potential applications including altering food digestibility, plant tensile strength, wood quality, pathogen resistance and in pulp production. In particular, increasing the insoluble carbohydrate content in various fruits, vegetables, and other edible consumer products will result in enhanced fiber content. Increased fiber content would not only provide health benefits in food products, but might also increase digestibility of forage crops.

G598 or its equivalogs could be used to increase seed oil content, which would be of nutritional value for food for human consumption as well as animal feeds.

G634 (SEQ ID NO ID NO: 127)

Published Information

G634 was initially identified as public partial cDNAs sequences for GTL1 and GTL2 which are splice variants of the same gene (Smalle et al (1998) *Proc. Natl. Acad. Sci. USA* 95:3318-3322). The published expression pattern of GTL1 shows that G634 is highly expressed in siliques and not expressed in leaves, stems, flowers or roots.

Closely Related Genes from Other Species

A close non-*Arabidopsis* relative of G634 is *O. sativa* the gt-2 gene (2) which is proposed to bind and regulate the phyA promoter. In addition, the pea DNA-binding protein DF1 (13786451) shows strong homology to G634. The homology of these proteins to G634 extends to outside of the conserved domains and thus these genes are likely to be orthologs of G634.

Experimental Observations

The boundaries of G634 were experimentally determined and the function of G634 was investigated by constitutively expressing G634 using the CaMV 35S promoter.

Three constructs were made for G634: P324, P1374 and P1717. P324 was found to encode a truncated protein. P1374 and P1717 represent full length splice variants of G634; P1374, the shorter of the two splice variants was used for the experiments described here and the coding sequence of the P1374 clone is provided as the cDNA sequence for G634 in the Sequence Listing. The longest available cDNA (P1717), confirmed by RACE, had the same ATG and stop codons as the genomic sequence. Only data for P1374 are presented here.

Plants overexpressing G634 from construct P1374 had a dramatic increase the density of trichomes, which were also larger in size. The increase in trichome density was most noticeable on later arising rosette leaves, cauline leaves, inflorescence stems and sepals with the stem trichomes being more highly branched than controls. Approximately half of the primary transformants and two of three T2 lines showed the phenotype. Apart from slight smallness, there did not appear to be any other clear phenotype associated with the overexpression of G634. However, a reduction in germination was observed in T2 seeds grown in culture.

RT PCR data showed that G634 was preferentially expressed in flowers and germinating seedlings, and induced by auxin.

Potential Applications

G634 or its equivalogs may be used to alter trichome structure, function or density. Trichome glands on the surface of many higher plants produce and secrete exudates that give protection from the elements and pests such as insects, microbes and herbivores. These exudates may physically immobilize insects and spores, may be insecticidal or antmicrobial or they may allergens or irritants to protect against herbivores. Trichomes have also been suggested to decrease transpiration by decreasing leaf surface air flow, and by exuding chemicals that protect the leaf from the sun.

Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Thus, the use of G634 and its homologs to increase trichome density, size or type may therefore have profound utilities in so called molecular farming practices (i.e. the use of trichomes as a manufacturing system for complex secondary metabolites), and in producing resistant insect and herbivore resistant plants.

G635 (SEQ ID NO: 129)

Published Information

G635 was first identified in the sequence of BAC-end B67864, released by the *Arabidopsis* Genome Initiative. Subsequently, the full sequence of G635 was identified in BAC AB007649, also released by the *Arabidopsis* Genome Initiative.

Experimental Observations

The boundaries of G635 were experimentally determined and the function of G635 was analyzed using transgenic plants in which this gene was expressed under the control of the 35S promoter. Several plants over-expressing G635 were non-clonally sectored for chloroplast development and/or chlorosis. This phenotype seemed to correlate inversely with the expression level of the transgene, and plants over-expressing the highest amounts of G635 were wild-type in appearance. G635 over-expressing plants were otherwise wild-type biochemically and physiologically. G635 was constitutively expressed.

In the T2 generation, the bleaching phenotype did not show until plants started to flower, and the bleaching seemed to spread throughout the plant into areas that were previously green. This observation, in combination with the fact that the phenotype seems to be correlated with low expression of the gene, indicated that the phenotype was induced by silencing of G635.

A number of plants transformed with G635 had a variegated appearance.

Potential Applications

Based on the phenotype produced when G635 or its equivalogs may have a utility as a regulator of chloroplast development. In addition, G635 may be a herbicide target—if its activity or expression could be reduced using a small molecule, it could potentially kill the plant by causing chlorosis. G635 could also be developed into a marker for silencing in *Arabidopsis*.

The variegated phenotype associated with G635 or equivalog overexpression may find utility in ornamental applications.

G636 (SEQ ID NO: 131)

Published Information

G636 was identified through partial EST AA395524, released by Michigan State University. The entire sequence of G636 was later identified in BAC F7012, accession number F7012, released by the *Arabidopsis* genome initiative.

Closely Related Genes from Other Species

G636 is closely related to the *Pisum sativum* DNA-binding protein DF1, accession number AB052729, which may bind to light regulatory elements.

Experimental Observations

The 5' boundary of G636 was determined and the function of G636 was analyzed by constitutively expressing the gene using the CaMV 35S promoter. Overexpression of G636 resulted in premature senescence of leaves and reduced plant size and fertility. No other phenotypic alterations were noted as a result of physiological or biochemical analyses.

G636 was constitutively expressed.

Potential Applications

G636 or its equivalogs may be used to alter senescence responses in plants. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. Delayed flower senescence may also generate plants that retain their blossoms longer and this may be of potential interest to the ornamental horticulture industry.

G638 (SEQ ID NO: 133)

Published Information

G638 was identified in the sequence of BAC F17C15, GenBank accession number AL162506, released by the *Arabidopsis* Genome Initiative. During the course of its functional analysis, G638 was identified as the PETAL LOSS gene (Griffith et al. (1999) *Development:* 126:5635-5644). The PETAL LOSS knockout mutant displays a variety of flower phenotypes, most strikingly characterized by a reduction in the number of petals. In addition to flower organ number, organ identity, shape and orientation, particularly of petals, is altered.

Closely Related Genes from Other Species

A relative of G638 is a *Medicago truncatula* gene represented by the EST BF646615, which was isolated from an elicited cell culture cDNA library.

Experimental Observations

The boundaries of G638 were experimentally determined and the function of G638 was analyzed using transgenic plants in which this gene was expressed under the control of the 35S promoter. Expression of G638 causes severe alterations of plant development. The most striking feature of these overexpressor plants was that they have multipetallate flowers. In early flowers, some homeotic conversion had occurred between some organs of the flower. In all flowers made after these early flowers, petal number had been altered.

Up to eight petals were consistently observed on plants that flowered, and as the plants grew older, the number of petals on new flowers was reduced from eight to about five. This phenotype was somewhat opposite to the phenotype observed with PETAL LOSS knockout plants and confirms a role for G638 in counting or maintaining petal number within the *Arabidopsis* flower. In addition to the flower phenotype, G638 caused alterations in phyllotaxy, leaf shape and caused plants to be sterile. G638 appears to be constitutively expressed.

Potential Applications

G638 or its equivalogs could be used to manipulate plant architecture and leaf shape, in particular this gene could be used to increase or decrease petal number in flowers. Overexpression of G638 also causes sterility, indicating there may be some use for this gene in engineering sterility into commercially relevant species.

G652 (SEQ ID NO: 135)

Published Information

G652 was identified in the sequence of BAC clones F26H11 and F7O24, GenBank accession number AC006264, released by the *Arabidopsis* Genome Initiative.

Experimental Observations (Knockout)

G652 appears to be constitutively expressed at medium levels in all tissues and environmental conditions tested as determined by RT-PCR analysis. Expression of G652 was not detected in other tissues. A line homozygous for a T-DNA insertion in G652 was used to determine the function of this gene. The T-DNA insertion of G652 was approximately 75% into the coding sequence of the gene and therefore was likely to result in a null mutation. Plants homozygous for a T-DNA insertions within G652 displayed a spectrum of developmental abnormalities, particularly at the early seedling stage. These phenotypes were variable within the population, suggesting that other factors might be influencing the penetrance of the phenotype. For example, seedlings were small and filled with anthocyanins. Almost all the seedlings had defects in cotyledons ranging from unusual shape to fusions. Many seedlings did not survive, and those that did grew slowly. Fertility was reduced compared to controls, senescence delayed, and siliques were often rather short. The reason for this poor fertility was unclear. Many flowers had a reduced number of stamens (4-5 of these organs rather than 6). Interestingly, the absent stamen(s) were usually one or both of the shorter pair. Seeds produced by knockouts of G652 plants were somewhat wrinkled and misshapen.

The G652 knockout line had a reproducible increase in the leaf glucosinolate M39480. It also showed a reproducible increase in seed alpha-tocopherol. A decrease in seed oil as measured by NIR was also observed.

Experimental Observations (Overexpressor)

The function of G652 was studied using transgenic plants in which the gene was expressed under the control of the 35S promoter. Overexpression of G652 resulted in plants that were small and slow developing. Many plants died at an early stage of growth. The two lines that were morphologically examined in the T2 generation were small and showed premature senescence of rosette leaves.

35S::G652 plants were wild-type in physiological analyses that were performed.

Potential Applications

G652 or its equivalogs could be used to manipulate seed tocopherol composition and seed structure and to alter glucosinolate composition in leaves.

G652 may also be useful for modifying glucosinolate content. Increases or decreases in specific glucosinolates or total glucosinolate content might be desirable depending upon the particular application.

G663 (SEQ ID NO: 137)

Published Information

G663 was identified from the *Arabidopsis* EST sequence, H76020, based on its sequence similarity within the conserved domain to other Myb family members in *Arabidopsis*. This gene was named MYB90 (Kranz et al. (1998) *Plant J.* 16:263-276). Reverse Northern data suggested G663 is expressed highly in leaves, siliques, and flowers and is induced by ethylene treatment.

Experimental Observations

The function of G663 was analyzed by its ectopic overexpression in plants. G663 overexpressors had constitutive anthocyanin production in seeds and roots. One line had higher anthocyanin production in leaf tissue as well. In other overexpressing lines, constitutive anthocyanin production was noted in trichomes and leaf margins. The overproduction of pigment in select tissues suggests there may be another transcription factor with which G663 interacts to activate the pathway. Using the corn system as a model, the interacting protein may be a bZIP like transcription factor.

RT-PCR analysis of the endogenous levels of G663 indicated that this gene was expressed primarily in siliques and seedlings. Array data confirmed the high levels in silique and also detected high levels of G663 in germinating seed tissue. G663 transcripts were also induced above basal levels by all stress treatments tested except by infection with *Erysiphe orontii*. These data were consistent with G663 being involved in the anthocyanin biosynthetic pathway, which is part of a common multi-stress response pathway.

Potential Applications

The potential utilities of this gene or its equivalogs includes alterations in pigment production for horticultural purposes, and possibly increasing stress resistance in combination with another transcription factor. Flavonoids have antimicrobial activity and could be used to engineer pathogen resistance. Several flavonoid compounds have health promoting effects such as the inhibition of tumor growth and cancer, prevention of bone loss and the prevention of the oxidation of lipids. Increasing levels of condensed tannins, whose biosynthetic pathway is shared with anthocyanin biosynthesis, in forage legumes is an important agronomic trait because they prevent pasture bloat by collapsing protein foams within the rumen. For a review on the utilities of flavonoids and their derivatives, refer to Dixon et al. ((1999) *Trends Plant Sci.* 10: 394-400).

G664 (SEQ ID NO: 139)

Published Information

G664 was identified from the *Arabidopsis* EST sequence, N38154, based on its sequence similarity within the conserved domain to other Myb family members in *Arabidopsis*. The Myb consortium named this gene MYB4 (Kranz et al. (1998) *Plant J.* 16: 263-276). Reverse Northern data suggested G664 is expressed highly in silique tissue with a low level of expression detected in all other tissues.

Closely Related Genes from Other Species

G664 shows extensive homology to the tomato gene THM27 (X95296) and the barley gene (X70877).

Experimental Observations

The function of G664 was analyzed through its ectopic overexpression in plants. G664 overexpressors germinated better and then developed more rapidly in cold conditions (8° C.) than wild-type controls. No differences in germination rates were observed on control MS media or in response to any other stress. Array data indicated that G664 was normally expressed primarily in root, shoot and silique.
Potential Applications The potential utility of this gene or its equivalogs is to confer improved cold germination and/or growth. The germination of many crops like cotton is very sensitive to cold temperatures, a gene that would allow germination and seedling vigor in the cold would have tremendous utility in allowing seeds to be planted earlier in the season with a high rate of survivability.

G674 (SEQ ID NO: 141)
Published Information

G674 is a member of the (R1)R2R3 subfamily of myb transcription factors. G674 was identified in the sequence of BAC clone T2J13 with accession number AL132967 released by the *Arabidopsis* genome initiative. G674 has also been referred to as MYB45 (Kranz H D, et al. (1998) *Plant J.* 16:263-276). No information is available about the function(s) of G674.

Experimental Observations

The function of G674 was analyzed using transgenic plants in which the gene was expressed under the control of the 35S promoter. 35S::G674 transformants were generally rather smaller than wild-type controls, and possessed rounded, dark green leaves that were sometimes pointed upward. Overexpression of G674 also resulted in an increase in seed glucosinolate M39501 in two T2 lines. No other phenotypes were associated with the overexpression of G674.

RT-PCR analysis of endogenous levels of G674 indicated that this gene was expressed in all tissues except shoot. Expression levels of G674 seemed to vary in response to stress-related treatments.

Potential Applications

On the basis of the analyses performed to date, G674 or its equivalogs could be used to alter plant growth and development. In addition, overexpression of G674 caused changes in the seed glucosinolate profile.

G676 (SEQ ID NO: 143)
Published Information

G676 was identified from an *Arabidopsis* EST, N96391, based on its sequence similarity to other members of the Myb family within the conserved domain. The Myb consortium named this gene MYB66 (Kranz H D, et al. (1998) *Plant J.* 16:263-276) and in a report by Lee et al ((1999) *Cell* 1999 24; 99:473-483) a detailed functional analysis of G676, or "werewolf", is described. Werewolf (WER) is involved in position-dependent patterning of epidermal cell types. Transcripts were localized to root epidermal cells that will develop into non-hair cells. WER was shown to regulate the position-dependent expression of GLABRA2, to interact with the maize R gene, and to act as an antagonist to the myb protein CAPRICE (G225). These authors do not report altered trichome positioning in their 35S:wer overexpressors.

Experimental Observations

The function of G676 was analyzed through its ectopic overexpression in plants. Morphologically, the plants are small, and partially glabrous on the upper surface of the leaf. Ectopic trichomes developed on the underside of the leaf in one line. Lee et al (1999) *Cell* 99: 473-483) fail to report altered trichome phenotypes in the leaves of the 35S:were overexpression lines. The present lines showed a higher degree of overexpression, which could explain the small stature of the plants as well.

RT-PCR analysis of the endogenous levels of G676 indicated that this gene was expressed primarily in roots with a low level of expression in siliques and seedlings. G676 transcripts were not induced significantly above basal levels by any stress-related treatments tested. In disease-related treatments where whole seedlings were harvested, transcripts were detectable but not above basal levels. This may be related to the gene's root expression. G676 transcripts were not found in *Fusarium oxysporum* treated seedlings; it is possible this treatment represses G676 expression in the roots.

Potential Applications

The potential utility of G676 or its equivalogs is the production of ectopic trichomes on the surface of the leaf. It would be of significant agronomic value to have plants that exhibit greater numbers of glandular trichomes producing essential oils for the pharmaceutical and food industries, as well as oils that protect plants against insect and pathogen attack.

G680 (SEQ ID NO ID NO: 145)
Published Information

G680 or LHY (late elongated hypocotyl) is an unusual Myb transcription factor in that it contains a single Myb repeat instead of the two repeat sequences found in the majority of plant Myb genes (R2R3Mybs). There are over 30 members of this single repeat Myb-related subfamily in the *Arabidopsis* genome. Both signature repeats in R2R3Myb domain are required for sequence specific DNA binding. However, the Myb-related subfamily with a single repeat domain are also able to bind to DNA in a sequence-specific manner (Baranowskij et al. (1994) *EMBO J.* 13: 5383-5392; Feldbrugge et al. (1997) *Plant J.* 11: 1079-1093) and are therefore thought to function as transcription factors.

G680 or LHY overexpression affects many processes associated with the circadian clock including, the rythmicity in both leaf movement, and the expression of CAB and CCR2 genes, as well as photoperiodic control of flowering time (Schaffer et al. (1998) *Cell* 93: 1219-1229). Other reported pleiotropic effects include elongated hypocotyls, elongated petioles, and pale leaves (Schaffer et al. (1998) *Cell* 93: 1219-1229). All of these phenotypes could potentially be explained by the impairment of circadian clock function. LHY shows a high degree of homology to CCA1, another protein implicated in circadian clock function (Wang et al. (1997) *Plant Cell* 9: 491-507).

Experimental Observations

The function of G680 was analyzed through its ectopic overexpression in plants. G680 overexpressors were late flowering under both short and long day conditions, however, the late flowering phenotype appeared more consistently under short day conditions. The overexpressors were darker green in color compared to the wild-type controls at later stages of development. This was inconsistent with the published phenotype, which indicates the plants have less chlorophyll, and are pale in color (Schaffer et al. (1998) *Cell* 93: 1219-1229). Preliminary data indicated that a vernalization treatment applied to germinating seedlings partially overcame the delay in flowering in the G680 overexpressors. Vernalized plants showed an approximate 35% reduction in leaf number on average compared to non-vernalized controls. Overexpression of G680 in plants also resulted in sensitivity to media containing high glucose in a germination assay, indicating a potential role for G680 in sugar sensing.

As determined by RT-PCR, G680 was uniformly expressed in all tissues tested. RT-PCR data also indicated a moderate induction of G680 transcripts accumulation upon drought treatment, and *Erysiphe* treatment could repress the expression of this gene.

Potential Applications

G680 or its equivalogs may be used to alter sugar sensing in plants. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships). Glucose-specific hexose-sensing has been described in plants and implicated in cell division and repression of 'famine' genes (photosynthetic or glyoxylate cycles). The potential utilities of a gene involved in glucose-specific sugar sensing are to alter energy balance, photosynthetic rate, carbohydrate accumulation, biomass production, source-sink relationships, and senescence.

Potential utilities of G680 or its equivalogs also include the regulation of flowering time. An area in which late flowering might be useful include crops where the vegetative portion of the plant is the marketable portion. In this case, it would be advantageous to prevent or delay flowering in order to increase yield. Prevention of flowering would also be useful in these same crops in order to prevent the spread of transgenic pollen and/or to prevent seed set.

A vernalization treatment applied to germinating G680 seedlings will partially overcome the delay in flowering in the G680 overexpressors. Vernalized plants showed an approximate 35% reduction in leaf number on average compared to non-vernalized controls. Various late flowering mutants are partially rescued by GA applications (Chandler et al. (1994) *J. Exp. Bot.* 45: 1279 1288). Thus it is possible that G680 could be used to increase the vegetative phases of development in order to increase yield and then triggered to flower via a cold treatment or a gibberelic acid application.

G682 (SEQ ID NO: 147)
Published Information
G682 was identified from the *Arabidopsis* BAC, AF007269, based on sequence similarity to other members of the Myb family within the conserved domain.
Experimental Observations
The function of G682 was analyzed through its ectopic overexpression in plants. G682 overexpressors were glabrous, had tufts of more root hairs and germinated better under heat stress conditions. Older plants were not more tolerant to heat stress compared to wild-type controls.

RT-PCR analysis of the endogenous levels of G682 transcripts indicated that this gene was expressed in all tissues tested, however, a very low level of transcript was detected in roots and shoots. Array tissue print data indicated that G682 was expressed primarily, but not exclusively, in flower tissue.

An array experiment was performed on one G682 overexpressing line. The data from this one experiment indicated that this gene could be a negative regulator of chloroplast development and/or light dependent development because the gene Albino3 and many chloroplast genes are repressed. Albino3 functions to regulate chloroplast development (Sundberg et al (1997) *Plant Cell* 9:717-730). The gene G682 was itself induced 20-fold. Other than a few additional transcription factors, very few genes are induced as a result of the ectopic expression of G682.

A number of plants transformed with G682 lacked trichomes.

Plants overexpressing paralogs of G682, including G225, G226 and G1816, have similar traits as plants that overexpress G682. These traits include reduction or lack of trichomes and increased root hairs, the latter indicating improved resistance to osmotic stress Plants overexpressing G676 and G1332 also have reduced trichome density. G676 and G1332 share 52% (21 of 40 residues) and 60% (24 of 40 residues) identity with G682, respectively, and 62% (20 of 32 residues) and 68% (22 of 32 residues) with the conserved domain of G682, respectively.

The polypeptide sequence of G682 shares 70% (50 of 71 residues), 66% (37 of 56 residues), and 57% (43 of 75 residues) identity with the conserved domains of G225, G226 and G1816, respectively. The conserved domain of G682 shares 86% (32 of 37 residues), 63% (23 of 36 residues), and 69% (25 of 36 residues) identity with the conserved domains of G225, G226 and G1816, respectively.

In addition to the paralogous sequences disclosed above, orthologous sequences from other plant species were also identified using BLAST analysis. Such orthologous sequences, together with the paralogous sequences were determined to be members of the G682 TF family of Myb-related proteins (equivalogs). The paralogous sequences and the orthologous sequences were aligned using MACVECTOR software (Accelrys, Inc.). The software program also generated an exemplary consensus amino acid residue sequence of the aligned sequences.

As shown in FIGS. 3A and 3B, the orthologous sequences shared a consensus sequence with the conserved domain of G682 (amino acid residues 27-63 of SEQ ID NO:148) and also shared identity with regions flanking the conserved domain (flanking regions). In particular, G682 shared a region of the conserved domain with sequences from soy (*Glycine max*; SEQ ID NOs: 1084, 1085, 1086, 1083, 1087, and 1088), rice (*Oryza sativa*; SEQ ID NOs: 559, 1082, and 1081), and maize (corn) (*Zea mays*; SEQ ID NOs: 1089 and 1090).

An exemplary consensus of the conserved domain of the G682 TF family of Myb-related proteins is Val-Xaa-Met/Phe-Ser/Thr-Gln/Glu-Xaa-Glu-Glu-Asp-Leu-Val-Xaa-Arg-Met-His/Tyr-Lys/Arg-Leu-Val-Gly-Asp/Glu-Arg/Lys-Trp-Glu/Asp-Leu-Ile-Ile-Ala-Gly-Arg-IleVal-Pro-Gly-Arg, where Xaa is any amino acid residue. An alternative exemplary consensus of the conserved domain is Val-Xaa-Met/Phe-Ser/Thr-Gln/Glu-Xaa-Glu-Glu-Asp-Leu-Val-Ser-Arg-Met-His-Arg-Leu-Val-Gly-Asn-Arg-Trp-Glu-Leu-Ile-Ala-Gly-Arg-Ile-Xaa-Gly-Arg, where Xaa is any amino acid residue. A further alternative exemplary consensus of the conserved domain is Val-Xaa-Met/Phe-Ser/Thr-Gln/Glu-Xaa-Glu-Glu-Asp-Leu-Val-Ser-Arg-Met-Tyr-Xaa-Leu-Val-Gly-Asn/Glu-Arg-Trp-Ser-Leu-Ile-Ala-Gly-Arg-Ile-Pro-Gly-Arg, where Xaa is any amino acid residue.
Potential Applications
The potential utility of this gene or its equivalogs is to confer heat tolerance to germinating seeds.

G682 or its equivalogs could be used to alter trichome number and distribution in plants. Trichome glands on the surface of many higher plants produce and secrete exudates, which give protection from the elements and pests such as insects, microbes and herbivores. These exudates may physically immobilize insects and spores, may be insecticidal or ant-microbial or they may allergens or irritants to protect against herbivores. Trichomes have also been suggested to decrease transpiration by decreasing leaf surface air flow, and by exuding chemicals that protect the leaf from the sun.
G715 (SEQ ID NO: 149)
Published Information
G715 is a member of the Hap5 subfamily of CCAAT-box transcription factors. G715 corresponds to Hap5a, and was found to be expressed ubiquitously in *Arabidopsis* (Edwards, et al. (1998) *Plant Physiol.* 117: 1015-1022).
Experimental Observations
The complete sequence of G715 was determined. The function of this gene was analyzed using transgenic plants in which G715 was expressed under the control of the 35S promoter. The expression of G715 appeared to be ubiquitous.

G715 overexpressors had higher seed oil content in the lines tested by NIR.

Potential Applications

G715 or its equivalogs could be used to increase seed oil content, which would be of nutritional value for food for human consumption as well as animal feeds.

G720 (SEQ ID NO: 151)

Published Information

G720 was described as APRR2, for *Arabidopsis* pseudo-response regulator (Makino et al. 2000 *Plant Cell Physiol.* 41:791-803). This designation reflects the fact that the protein contains significant homology to a receiver domain at the N-terminus, but has a glutamate in place of the conserved aspartate residue that is phosphorylated by a histidine kinase or phosphotransmitter protein.

Closely Related Genes from Other Species

G720 showed significant similarity to a drought-induced *M. truncatula* EST, GenBank accession number BG450227, that encodes a pseudo-receiver domain. The sequence similarity is high enough to suggest that the two proteins are orthologs, and the fact that G720 was also drought-induced is consistent with this hypothesis. Other ESTs from tomato and potato (BG642566, BG128919, BG129142, and BG887673) also showed high similarity to G720 and represent potential orthologs.

Experimental Observations

The complete sequence of G720 (SEQ ID NO: 151) was determined. A line homozygous for a T-DNA insertion in G720 and lines overexpressing G720 under the 35S promoter were used to determine the function of this gene. The T-DNA insertion in G720 was approximately half-way into the coding sequence, just before the conserved domain, and therefore should result in a null mutation. G720 knockout mutants were slightly more sensitive to freezing than the wild-type controls when the seedlings were cold-acclimated prior to freezing. G720 overexpressing lines were more tolerant to freezing. When seedlings were frozen at −10° C. for 20 hours, the G720 plants recovered better compared to the wild-type control in two separate experiments. G720 was induced by ABA, salt, osmotic stress, drought, heat, and auxin. The combination of enhanced sensitivity to freezing in the knockout mutants, enhanced resistance in the overexpressing lines, and the induction pattern of G720 comprised strong evidence that G720 functions in regulation of dehydration tolerance, as freezing is a form of dehydration stress.

Plants overexpressing G720 also showed reduced time to flowering in the T1 generation. One third of the 35S::G720 T1 seedlings, from each of two separate batches, flowered markedly earlier (up to 1 week sooner, 24-hour light conditions) than controls plants. All of the T1 lines showed high levels of G720 overexpression (determined by RT-PCR). Three early flowering T1 plants were selected for further study. However, none of these lines flowered early in the T2 generation, suggesting that activity of the transgene might have been reduced between the generations Potential Applications G720 or its equivalogs could be used to increase freezing tolerance in plants, and tolerance to other forms of moisture stress such as drought.

G736 (SEQ ID NO: 153)

Published Information

G736 was discovered as a full length EST clone. It was subsequently localized to BAC AC002341.

Experimental Observations

RT-PCR analysis of the endogenous levels of G736 indicated that this gene was expressed at low to medium levels in all tissues tested. In addition, there was no induction of G736 above its basal level in response to environmental stress treatments.

Two out of three G736 overexpressing lines exhibited a severe late flowering phenotype in both the T1 and T2 generation, the third line was late flowering in the T1 generation but the phenotype was lost in the subsequent generation, most likely due to silencing of the transgene. All three lines exhibited elongated petioles in both generations, and in two of the T1 lines, failure of the siliques to elongate was also observed. This phenotype was lost in the subsequent generation.

Potential Applications

Overexpression of G736 and its equivalog may be used to substantially delay flowering. A wide variety of applications exist for genes that either lengthen or shorten the time to flowering, or for systems of inducible flowering time control. In particular, in species where the vegetative parts of the plants constitute the crop and the reproductive tissues are discarded, it would be advantageous to delay or prevent flowering. Extending vegetative development could bring about large increases in yields. Additionally, a major concern is the escape of transgenic pollen from GMOs to wild species or so-called organic crops. Systems that prevent vegetative transgenic crops from flowering would eliminate this worry.

G748 (SEQ ID NO: 155)

Published Information

A cDNA sequence for G748 was deposited in GenBank by Abbaraju and Oliver on Aug. 4, 1998. G748 encodes a protein containing a D of zinc-finger domain that was found to bind the H-protein promoter. The H protein is a component of the glycine decarboxylase multienzyme complex, that comprises over one-third of the soluble proteins in mitochondria isolated from the leaves of C3 plants (Oliver et al. (1995) *Bioenerg. Biomembr.* 27: 407-414). A published function for G748 is a putative regulatory role in H-protein gene expression, suggested by the promoter-binding data.

Closely Related Genes from Other Species

Close relatives to G748 include a rice gene (GB accession #BAA88190) and a pumpkin gene (GB accession #D45066). In both cases, the similarity extends beyond the conserved DNA-binding domain, which suggests the genes could be orthologs of G748. The pumpkin gene encodes an ascorbate oxidase promoter-binding protein, suggesting that the product of G748 could also bind that promoter.

Experimental Observations

A cDNA sequence was isolated and used to produce transgenic plants overexpressing G748. Overexpression of G748 resulted in a late flowering phenotype. Transgenic plants were generally large and dark green with more rosette leaves. Stems were thicker and more vascular bundles were noticeable in transverse sections. G748 overexpressors also produced more lutein in seeds (consistently observed in three lines). The high lutein phenotype was confirmed in a repeat experiment. The physiology of the plant was similar to that of the controls. In wild-type plants, G748 was constitutively expressed, although at lower levels at the seedling stage. Expression levels were lower upon infection with *E. orontii* and *Fusarium*.

Potential Applications

Experimental data showed that G748 or its equivalogs can be used to delay flowering in transgenic plants.

*Arabidopsis* plants overexpressing G748 produced more lutein in seeds.

Plants transformed with G748 had modified stem morphology and vascular bundles and may be used to affect overall plant architecture.

G779 (SEQ ID NO: 157)

Published Information

G779 has been previously identified; fruits from a ind1 knockout mutant plants do not show cell differentiation in the dehiscence zone (Liljegren et al. (2000) *Abstracts 11th Intl. Conf: Arabidopsis* Res., Madison, Wis., pp. 179). These results suggest that G779 may mediate cell differentiation during *Arabidopsis* fruit development.

Closely Related Genes from Other Species

G779 is closely related to a *Brassica rapa* subsp. *Pekinensis* cDNA isolated from flower bud (acc#AT002234).

Experimental Observations

The function of G779 was analyzed using transgenic plants in which G779 was expressed under the control of the 35S promoter. Morphological analysis of overexpressors indicated that primary transformants of G779 had high levels of anthocyanin in seedlings, produced small plants with disorganized rosettes and short internodes, and many had flower abnormalities. The transformants with flower abnormalities showed conversion of sepals to carpels. The most severely affected had full conversion of sepals to carpels with ovules, stigmatic tissue on petals and stamens, and in some cases showed organ fusions. In the severe case of one T1 line, some inflorescences showed no flowers at all. Plants with a weak phenotype showed only small patches of stigmatic tissue on sepals. The floral phenotypes decreased acropetally. The plants showing the strongest phenotypes were essentially sterile, and did not produce T2 progeny for further analysis.

The phenotype produced by overexpressing G779 and G1499 was similar in the aspects of flower structures. Cluster analysis using basic helix-loop-helix motif revealed that both proteins of G779 and G1499 are closely related. The fact that expression of G779 was induced by auxin treatment in the rosette leaves indicates that G779 may play some kind of role in the auxin signal transduction pathway.

Potential Applications

G779 or its equivalogs could be used to modify plant architecture and development, including flower structure. If expressed under a flower-specific promoter, it might also be useful for engineering male sterility. Because expression of G779 is flower, embryo and silique specific, its promoter could be useful for targeted gene expression in these organs.

G789 (SEQ ID NO: 159)

Published Information

A partial sequence of G789 was identified from an EST clone (GenBank accession number T41998).

Experimental Observations

G789 was initially identified as a public EST (GenBank accession number T41998) and subsequently a full length library clone was identified. The function of G789 was analyzed using transgenic plants in which G789 was expressed under the control of the 35S promoter.

Overexpression of G789 reduced the time to flowering under continuous light conditions; this phenotype was most prevalent in the T2 generation and was noted in all three of the lines analyzed.

Transgenic plants overexpressing G789 were more sensitive to the herbicides glyphosate and acifluorfen and to oxidative stress caused by rose bengal compared to wild-type controls. Furthermore, G789 overexpressing lines were more susceptible to infection with *Sclerotinia sclerotiorum* when tested as mixed lines in two repeat experiments. This disease susceptibility phenotype did not repeat when individual lines were tested. It is well known that oxidative stress is a component of a plant defense response to pathogen and therefore, the disease susceptibility phenotype could thus be related to a general sensitivity to oxidative stress.

Based on the RT-PCR analysis, G789 was constitutively expressed in all tissues; its expression level was unaffected by any of the conditions tested.

Potential Applications

Based on the current analysis of G789 overexpressing plants, G789 or its equivalogs could be used to manipulate flowering time.

Since G789 activity has been shown to be required for the protection of *Arabidopsis* plants against oxidative stress, G789 or its equivalogs could be used to manipulate defenses against abiotic and biotic stresses such as disease, UV-B radiation, ozone pollution and herbicide application.

G801 (SEQ ID NO: 161)

Published Information

A partial sequence for G801 was identified from EST clones (GenBank accession numbers N97289, H36373 and Z32574).

Experimental Observations

G801 is a proprietary sequence initially identified as three partial public ESTs (GenBank accession numbers N97289, H36373 and Z32574). Subsequently, a full length library clone was identified. The function of G801 was analyzed using transgenic plants in which G801 was expressed under the control of the 35S promoter. Morphological analysis revealed that a minority of primary transformants of G801 were dark green and late flowering. However, T2 lines derived from three late-flowering lines showed no flowering time differences from control plants. Plant overexpressing G801 showed more seedling vigor when germinated on media containing high salt compared to wild-type control plants. All three overexpressing lines showed similar degrees of tolerance. In addition, overexpression of G801 in *Arabidopsis* resulted in an increase in seed oil content. This phenotype was observed in a single line.

Potential Applications

The potential utilities of this gene or its equivalogs include the ability to confer salt tolerance during the germination stage of a crop plant. This would most likely impact survivability and yield. Evaporation of water from the soil surface causes upward water movement and salt accumulation in the upper soil layer, where the seeds are placed. Thus, germination normally takes place at a salt concentration much higher than the mean salt concentration in the whole soil profile.

In addition, G801 or its equivalogs may be used to increase seed oil in crop plants.

G849 (SEQ ID NO ID NO: 163)

Published Information

The transcription factor G849 is an *Arabidopsis* homolog of parsley BPF-1, a pathogen inducible DNA-binding protein. BPF-1, Box-P Binding Factor 1, was reported by da Costa e Silva et al. ((1993) *Plant Journal* 4:125-135) to bind specifically to the P-box sequence motif of the phenylalanine ammonia lyase promoter, a key enzyme of the phenylpropanoid metabolism. G849 is found in the sequence of chromosome 3, BAC T2E22 (GenBank AC069474.4 GI:12321944), released by the *Arabidopsis* Genome Initiative. The start and stop codons were correctly predicted.

Experimental Observations

NIR analyses performed on G849 knockout plants revealed increased total combined seed oil and protein content.

RT-PCR analysis of the endogenous level of G849 transcripts revealed high constitutive expression in all tissues examined, with the exception of germinated seed. A detectable but low level of G849 transcripts was observed in germinated seeds. G849 transcript level increased significantly upon auxin, ABA, cold, heat and salt treatment, as well as seven days post-inoculation with *Erysiphe orontii*.
Potential Applications Based on the knockout analyses, G849 or its equivalogs may be used to modify seed oil and protein content.

The null mutant of G849 had altered seed phytosterol composition, a decease in beta-sitosterol, as well as changes in leaf insoluble sugars. Phytosterols are an important source of precursors for the manufacture of human steroid hormones by semisynthesis. Sitosterols and stigmasterols, not campesterol, are the preferred sources from seed crops. Phytosterols and their hydrogenated derivatives phytostanols also have proven cholesterol-lowering properties.
G859 (SEQ ID NO: 165)
Published Information G859 corresponds to MXK3.30 (BAB10332). The high level of sequence similarity between G859 and FLOWERING LOCUS C (FLC; Michaels et al. (1999) *Plant Cell* 11, 949-956; Sheldon et al., (1999) *Plant Cell* 11, 445-458) has been described previously (Ratcliffe et al. (2001) *Plant Physiol.* 126:122-132). G859 has also been referred to as AGL31 (Alvarez-Buylla et al. (2000) *Plant J.* 24:457-466).
Experimental Observations G859 was recognized as a gene highly related to *Arabidopsis* FLC, and to MADS AFFECTING FLOWERING 1. FLC acts as a repressor of flowering (Michaels (1999) *Plant Cell* 11, 949-956; Sheldon et al. (1999) *Plant Cell* 11, 445-458). Similarly, G157/MAF1 can cause a delay in flowering time when overexpressed (Ratcliffe et al. (2001) *Plant Physiol.* 126:122-132).

The function of G859 was studied using transgenic plants in which this gene was expressed under the control of the 35S promoter. Overexpression of G859 modified the timing of flowering, with very high levels of G859 activity delaying the floral transition in the Columbia ecotype. No alterations were detected in 35S::G859 plants in the physiological and biochemical analyses that were performed.

Under continuous light conditions, the majority of 35S::G859 primary transformants (overexpressing a construct containing a full-length cDNA, P1688) were earlier flowering than wild-type controls. This result was observed in multiple independent batches of T1 plants and in either continuous or 12 hour light conditions. However, in each selection of primary transformants, a small number of lines were late flowering. RT-PCR analyses demonstrated that all T1 plants overexpressed the transgene, but that the highest levels of expression were found in the late flowering transformants. Comparable results were also obtained when plants were transformed with a construct (P376) containing a shorter splice-variant of G859. The effects on flowering time caused by overexpression of G859, and the dependence of those effects on the transgene expression levels, mirror results previously obtained for G157/MAF1 (Ratcliffe et al. (2001) *Plant Physiol.* 126:122-132).

Seed was taken for T2 analyses from two late flowering primary transformants, and a T1 plant that had been early flowering. The progeny of the former two lines all appeared markedly late flowering, while the T2 plants from the third line were marginally late flowering. No convincing early flowering was observed in any the three T2 populations. Thus, in the second generation, the predominant effect of G859 activity was delayed flowering. In a follow-up experiment it was found that late flowering 35S::G859 T2 plants were photoperiod responsive, and were not sensitive to extensive vernalization treatments.

Potential Applications

G859 or its equivalogs could be used to alter flowering time.
G864 (SEQ ID NO ID NO: 167)
Published Information G864 was identified in an *Arabidopsis* EST (H37693). G864 appears as gene AT4g23750 in the annotated sequence of *Arabidopsis* chromosome 4 (AL161560).
Experimental Observations G864 was discovered and initially identified as a public *Arabidopsis* EST.

The complete sequence of G864 was determined, and G864 was found to be related to two additional *Arabidopsis* AP2/EREBP genes, G1421 and G1755. The function of G864 was analyzed using transgenic plants in which this gene was expressed under the control of the 35S promoter. G864 overexpressing plants exhibited a variety of phenotypic alterations. They were smaller than wild-type plants, and those with the strongest phenotypes were classified as dwarf. However, G864 overexpressing lines showed more seedling vigor in a heat stress tolerance germination assay compared to wild-type controls. Conversely, G864 overexpressing lines were also somewhat more sensitive to chilling. One of the three T2 lines analyzed showed significant increase in fucose and arabinose levels in leaves.

G864 was ubiquitously expressed, and was not significantly induced under any of the conditions tested.
Potential Applications The germination of many crops is very sensitive to temperature. A gene that would enhance germination in hot conditions such as G864 or its equivalogs would be useful for crops that are planted late in the season or in hot climates.
G867 (SEQ ID NO: 169)
Published Information G867 corresponds to RAV1 (Kagaya et al. (1999) *Nucleic Acids Res.* 27: 470-478). G867/RAV1 belongs to a small subgroup within the AP2/EREBP family of transcription factors, whose distinguishing characteristic is that its members contain a second DNA-binding domain, in addition to the conserved AP2 domain, that is related to the B3 domain of VP1/ABI3 (Kagaya et al. (1999) supra). It has been shown that the two DNA-binding domains of RAV1 can separately recognize each of two motifs that constitute a bipartite binding sequence and together cooperatively enhance its DNA-binding affinity and specificity (Kagaya et al. (1999) supra).
Experimental Observations G867 was discovered and initially identified as a public *Arabidopsis* EST. G867 appeared to be constitutively expressed at medium levels.

G867 was first characterized using a line that contained a T-DNA insertion in the gene. The insertion in that line resided immediately downstream of the conserved AP2 domain, and would therefore be expected to result in a severe or null mutation. G867 knockout mutant plants did not show significant changes in overall plant morphology, significant differences between these plants and control plants have not been detected in any of the assays that have been performed so far.

Subsequently, the function of G867 was analyzed using transgenic plants in which this gene was expressed under the control of the 35S promoter. G867 overexpressing lines were morphologically wild-type and no phenotypic alterations in G867 overexpressing lines were detected in the biochemical assays that were performed. However, G867 overexpressing lines showed increased seedling vigor (manifested by increased expansion of the cotyledons) in germination assays on both high salt and high sucrose containing media, compared to wild-type controls.

The *Arabidopsis* paralogs G1930 (SEQ ID NO: 369) and G9 (SEQ ID NO: 1949) also showed stress related phenotypes. G9 exhibited increased root biomass, and thus could be used to produce better plant growth under adverse osmotic conditions. Genetic and physiological evidence indicates that roots subjected to various stresses, including water deficit, alter the export of specific compounds, such as ACC and ABA, to the shoot, via the xylem Bradford et al. (1980) *Plant Physiol.* 65: 322-326; Schurr et al. (1992) *Plant Cell Environ.* 15, 561-567).

G1930 plants responded to high NaCl and high sucrose on plates with more seedling vigor, and root biomass compared to wild-type control plants; this phenotype was identical to that seen in 35S::G867 lines. These results indicate a general involvement of this clade in abiotic stress responses:

The polypeptide sequences of G1930 and G9 share 72% (249/345 residues) and 64% (233/364 residues) with G867, respectively. The conserved domains of G1930 and G9 are 86% (56/65 residues) and 86% (56/65 residues) identical with the conserved domain of G867, respectively.

In addition to the paralogous sequences disclosed above, orthologous sequences from other plant species were also identified using BLAST analysis. Such orthologous sequences, together with the paralogous sequences were determined to be members of the G867 TF family of AP2 proteins (equivalogs). The paralogous sequences and the orthologous sequences were aligned using MACVECTOR software (Accelrys, Inc.). The software program also generated an exemplary consensus amino acid residue sequence of the aligned sequences.

As shown in FIGS. 4A, 4B, 4C, and 4D, the orthologous sequences shared a consensus sequence with the conserved domain of G867 (amino acid residues 59-116 of SEQ ID NO:170) and also shared identity with regions flanking the conserved domain (flanking regions). In particular, G867 shared a region of the conserved domain with sequences from soy (*Glycine max*; SEQ ID NOs: 1184, 1183, and 1182), rice (*Oryza sativa*; SEQ ID NOs: 1176, 1177, and 1178), and maize (corn) (*Zea mays*; SEQ ID NOs: 1186 and 1185).

An exemplary consensus of the conserved domain of the G867 TF family of AP2 proteins is Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Glu/Asp-Glu-Glu/Asp-Glu/Asp-Ala-AlaVal-Ala-Ala/Ser-Tyr-Asp-Val/Ile-AlaVal-Val/Ala-Xaa-Arg-Phe/Tyr-Arg-Arg/Gly-Arg-Asp-Ala-Val-Thr/Val-Asn-Phe-Lys/Arg, where Xaa is any amino acid residue. An alternative exemplary consensus of the conserved domain is Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Glu/Asp-Glu-Glu/Asp-Ala-Ala-Ala-Arg-Ala-Tyr-Asp-Val/Ile-Ala    Val-Val/Ala-Xaa-Arg-Phe/Tyr-Arg-Arg/Gly-Arg-Asp-Ala-Val-Thr/Val-Asn, where Xaa is any amino acid residue. A further alternative exemplary consensus of the conserved domain is Ser-Ser-Lys/Arg-Tyr-Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Gly-Glu-Ala/Asp-Glu/Asp-Ala-Ala/Val-Arg-Ala-Tyr-Asp-Val-Ala-Ala-Gln-Arg-Phe/Tyr-Arg-Arg/Gly-Arg-Asp-Ala-Val-Thr/Val-Asn-Phe-Arg, where Xaa is any amino acid residue.

Potential Applications

G867 or its equivalogs could be used to increase or facilitate seed germination and seedling growth under adverse environmental conditions, in particular salt stress.

G867 or its equivalogs may also be used to modify sugar sensing.

G869 (SEQ ID NO: 171)

Published Information

A partial cDNA sequence of G869 is available as public ESTs N65486. The sequence of G869 later appeared among the *Arabidopsis* sequences released by the *Arabidopsis* Genome Initiative, in BAC T26J14 (GenBank accession number AC011915).

Experimental Observations

The complete cDNA sequence of G869 was determined. The function of this gene was analyzed using transgenic plants in which G869 was expressed under the control of the 35S promoter. Plants overexpressing G869 were small with spindly bolts. G869 transgenic plants showed alterations in leaf and seed fatty acid composition. In leaves, 16:0 levels decreased and 16:3 levels increased. These changes likely reflected alterations in the desaturation state of chloroplast membranes. In seeds, 18:1 levels increased significantly. The increase in the seed 18:1 fatty acid in two lines was observed in a repeat experiment. A decrease in 18:3 and 20:0 was also noted in these lines.

Alterations in the levels of leaf insoluble sugars were also detected, with the increase in fucose determined to be significant. In addition, G869 overexpressors were more tolerant to infection with a moderate dose of the fungal pathogen *Erysiphe orontii*. The increase in resistance phenotype co-segregated with the dwarf phenotype. G869 plants showed additional morphological alterations, including poor fertility due to underdeveloped anthers.

Potential Applications

G869 or its equivalogs could be useful to manipulate the saturation levels of lipids in seeds. Alteration in seed lipid saturation could be used to improve the heat stability of oils or to improve the nutritional quality of seed oil.

As G869 transgenic plants have an altered response to the fungal pathogen *Erysiphe orontii*, G869 or its equivalogs could be used to manipulate the defense response in order to generate pathogen-resistant plants.

G877 (SEQ ID NO: 173)

Published Information

G877 was identified in an *Arabidopsis* EST (37131). G877 is contained in P1 clone MXK23 (GenBank accession number AB026656).

Closely Related Genes from Other Species

A non-*Arabidopsis* gene closely related to G877 is the tobacco gene NtWRKY4 (GenBank accession number AB026890). Similarity between these two genes extends beyond the conserved WRKY domain.

Experimental Observations

G877 was first discovered and identified as a public *Arabidopsis* EST. The complete sequence of G877 was determined.

A line was identified that contains a T-DNA insertion in the coding sequence of G877. The insertion likely resulted in a null mutation, since it resided upstream of the conserved WRKY domain sequence. Plants that were hemizygous for that insertion segregate 3 viable:1 inviable seeds in the silique, and homozygous G877 knockout mutant plants were never obtained. Therefore, a (null) mutation in G877 results in embryo lethality.

G877 was ubiquitously expressed. G877 is likely to be involved in controlling some essential process(es) required for growth rather than specific aspects of embryo patterning and development. Alternatively, G877 might play different roles throughout the plant life cycle.

Potential Applications

The embryo lethal phenotype of a G877 mutation indicates that the gene is involved in the control of some essential aspect of growth and development. G877 or its equivalogs could therefore constitute an herbicide target, either by itself or by allowing the identification of other genes or processes essential for plant growth.

G881 (SEQ ID NO ID NO: 175)

Published Information

G881 corresponds to gene F28M20.10, first identified in the sequence of BAC clone F28M20 (released by the *Arabidopsis* Genome Initiative; GenBank accession number AL031004).

Experimental Observations

The complete cDNA sequence for G881 was determined. The annotation in GenBank for this gene (BAC AL031004) was found to be inaccurate. G881 was ubiquitously expressed, but appeared to be significantly induced in response to salicylic acid treatment. The function of this gene was analyzed using transgenic plants in which G881 was expressed under the control of the 35S promoter. G881 overexpressors appeared to be more susceptible to infection with a moderate dose of the fungal pathogen *Erysiphe orontii*. Increased susceptibility to *Erysiphe orontii* was confirmed in repeat experiment. The induction of G881 expression by SA also implicated G881 in the disease response.

Potential Applications

Since G881 transgenic plants appear to have an altered response to the fungal pathogen *Erysiphe orontii*, G881 or its equivalogs could be used to manipulate the defense response in order to generate pathogen-resistant plants.

G892 (SEQ ID NO: 177)

Published Information

G892 was identified in the sequence of BAC clone T13D8, GenBank accession number AC004473, released by the *Arabidopsis* Genome Initiative.

Experimental Observations

The complete sequence of G892 was determined. A line homozygous for a T-DNA insertion in G892 was used to determine the function of this gene. The T-DNA insertion of G892 was approximately 70% into the coding sequence of the gene and therefore was likely to result in a null mutation. The phenotype of these transgenic plants was wild-type in all assays performed. G892 appeared to be constitutively expressed at low or moderate levels in all tissues except in roots where expression was much higher. ABA or salt treatment caused a slight increase in the expression of G892.

G892 knockout mutants were found to have increased seed oil and decreased protein content compared to wild-type plants.

Potential Applications

G892 or its equivalogs may be used to alter seed oil and protein content in plants, which may be very important for the nutritional value and production of various food products.

G896 (SEQ ID NO: 179)

Closely Related Genes from Other Species

G896 is very similar to a peppermint EST (AW255156). Since the homology extends beyond the conserved domain, G896 and the mint gene are likely orthologs.

Experimental Observations

A knock-out mutant was isolated, which contains a T-DNA insertion 40 base pairs downstream of the start codon. G896 knock-out plants were more susceptible to *Fusarium oxysporum*. In addition, G896 knockout plants had lower levels of lutein in seeds as compared to wild-type control plants. Otherwise, the knock-out plants had a wild-type morphological phenotype.

In wild-type plants, G896 was mostly expressed in roots. Changes in environmental conditions did not affect its expression.

Potential Applications

Since G896 transgenic plants have an altered response to the fungal pathogen *Fusarium oxysporum*, the gene or its equivalogs could be used to manipulate the defense response in order to generate pathogen-resistant plants.

G910 (SEQ ID NO: 181)

Published Information

G910 was identified as a gene in the sequence of BAC T22E19 (Accession Number AC016447), released by The Institute for Genomic Research.

Experimental Observations

The function of G910 was analyzed using transgenic plants in which G910 was expressed under the control of the 35S promoter.

G910 overexpression produced pleiotropic effects on plant development, but the most marked result was a delay in the transition to flowering. At early stages, 35S::G910 T1 lines appeared normal, but by around 20 days after sowing, most plants were clearly smaller than wild type and often had contorted or serrated leaves with short petioles. Approximately half of the T1 lines bolted at a normal time and produced rather thin inflorescences that yielded relatively few seeds. The remaining half of the T1 lines typically produced flowers between five and 30 days later than wild type. Although such late flowering plants initially appeared small, in many cases, by the time of bolting, they had attained a similar size and produced a much larger number of primary rosette leaves than controls. Two T2 lines showed a similar, but more extreme late flowering phenotype.

G910 was expressed at low levels in shoots and germinating seedlings, and at higher levels in flowers, rosette leaves, embryonic tissue and siliques. The expression of G910 was repressed by cold treatment and induced by NaCl treatment.

Potential Applications

Plants expressing G910 exhibited a delayed flowering time relative to controls. A wide variety of applications exist for genes or their equivalogs that either lengthen or shorten the time to flowering.

G911 (SEQ ID NO: 183)

Closely Related Genes from Other Species An EST (GenBank accession AI352907) induced in the defense response of *Brassica napus* to *Leptosphaeria maculans* has extremely high homology both within and external to the conserved RING H2 domain.

Experimental Observations

The function of G911 was analyzed through its ectopic overexpression in *Arabidopsis*. RT-PCR of endogenous levels of G911 indicated this gene was expressed in all tissues tested. A cDNA array experiment confirmed this tissue distribution data by RT-PCR. Microarray data confirmed that G911 was overexpressed 23 fold. Other genes that were induced when G911 was overexpressed included RHA1b (another RING C2H3C2 transcription factor), pistilata, and a proline rich protein isolog. Plants overexpressing G911 looked healthier and had longer roots when grown on media lacking potassium compared to wild-type plants.

Potential Applications

Plants overexpressing G911 or its equivalogs may be able to be grown with fertilizer lacking or containing low potassium.

G912 (SEQ ID NO: 185)

Published Information

G912 was identified in the sequence of P1 clone MSG15 (GenBank accession number AB015478; gene MSG15.6).

Closely Related Genes from Other Species

G912 is closely related to CBF1, CBF2, and CBF3, and also closely related to the members of the CBF-like subgroup of AP2/EREBP proteins from other plants, like AF084185 *Brassica napus* dehydration responsive element binding protein.

Experimental Observations

G912 was recognized as the AP2/EREBP gene most closely related to *Arabidopsis* CBF1, CBF2, and CBF3 (Stockinger et al (1997) *Proc. Natl. Acad. Sci. USA* 94:1035-1040; Gilmour et al. (1998) *Plant J.* 16:433-442). In fact, G912 is the only other AP2/EREBP transcription factor for which sequence similarity with CBF1, CBF 2, and CBF3 extends beyond the conserved AP2 domain.

The function of G912 was studied using transgenic plants in which this gene was expressed under the control of the 35S promoter. Plants overexpressing G912 were more freezing and drought tolerant than the wild-type controls, but were also small, dark green, and late flowering. There was a positive correlation between the degree of growth impairment and the freezing tolerance. In addition, G912 expression appeared to be induced by cold, drought, and osmotic stress.

In addition, G912 overexpressing plants also exhibited a sugar sensing phenotype: reduced seedling vigor and cotyledon expansion upon germination on high glucose media.

These results mirror the extensive body of work that has shown that CBF1, CBF2, and CBF3 are involved in the control of the low-temperature response in *Arabidopsis*, and that those genes can be used to improve freezing, drought, and salt tolerance in plants (Stockinger et al., (1997) *Proc. Natl. Acad. Sci. USA* 94:1035-1040; Gilmour et al. (1998) *Plant J.* 16:433-442; Jaglo-Ottosen et al. (1998) *Science.* 280:104-106; Liu et al. (1998) *Plant Cell.* 10:1391-1406, Kasuga et al. (1999) *Nat. Biotechnol.* 17:287-291).

The polypeptide sequences of G40, G41, and G42 share 71% (140 of 195 residues), 68% (144 of 211 residues), and 65% (147 of 224 residues) identity with G912, respectively. The conserved domains of G40, G41, and G42 share 94% (64 of 68 residues), 92% (63 of 68 residues), and 94% (64 of 68 residues) identity with G912, respectively.

In addition to the paralogous sequences disclosed above, orthologous sequences from other plant species were also identified using BLAST analysis. Such orthologous sequences, together with the paralogous sequences were determined to be members of the G912 TF family of AP2/EREBP proteins (equivalogs). The paralogous sequences and the orthologous sequences were aligned using MACVECTOR software (Accelrys, Inc.). The software program also generated an exemplary consensus amino acid residue sequence of the aligned sequences.

As shown in FIGS. 5A, 5B, 5C, 5D, 5E, and 5F, the orthologous sequences shared a consensus sequence with the conserved domain of G912 (amino acid residues 51-118 of SEQ ID NO:186) and also shared identity with regions flanking the conserved domain (flanking regions). In particular, G912 shared a region of the conserved domain with sequences from soy (*Glycine max*; SEQ ID NOs: 1238, 1242, 1240, 1241, and 1243), rice (*Oryza sativa*; SEQ ID NOs: 1222, 1223, 1232, 1221, 1231, 1227, 1235, 1230, 1229, and 1228), and maize (corn) (*Zea mays*; SEQ ID NOs: 1246, 1247, 1244, and 1245).

An exemplary consensus of the conserved domain of the G912 TF family of AP2/EREBP proteins is His-Pro-Ile/Val-Tyr/Phe-Arg/Lys-Gly-Val-Arg-Gln/Arg-Arg-Gly/Asn-Xaa$_{(1-3)}$-Lys/Arg-Trp-Val-Cys/Ser-Glu-Val/Leu-Arg-Glu/Val-Pro-Asn-Lys-Xaa$_{(2)}$-Arg-Ile/Leu-Trp-Leu-Gly-Thr-Phe/Tyr-Xaa$_{(2)}$-Ala/Pro-Glu-Met-Ala-Ala-Arg-Ala-His-Asp-Ala-Ala/Met-Leu/Met-Ala-Leu-Arg-Gly-Xaa$_{(1-8)}$-Ala-Cys-Ser-Leu-Asn-Phe-Ala-Asp-Ser-Xaa$_{(1-5)}$-Val/Ile-Pro/Asp, where Xaa is any amino acid residue. An alternative exemplary consensus of the conserved domain is His-Pro-Ile/Val-Tyr/Phe-Arg/Lys-Gly-Val-Arg-Xaa-Arg-Gly/Asn-Xaa$_{(1-3)}$-Lys/Arg-Trp-Val-Cys/Ser-Glu-Val/Leu-Arg-Glu/Val-Pro-Xaa$_{(1-5)}$-Arg-Ile/Leu-Phe-Trp-Leu-Gly-Thr-Phe/Tyr-Xaa$_{(2)}$-Ala/Pro-Glu-Xaa-Ala-Ala-Arg-Ala-His-Asp-Val-Ala-Ala/Met-Leu/Met-Ala-Leu-Arg-Gly-Xaa$_{(1-8)}$-Ala-Cys-Ser-Leu-Asn-Phe-Ala-Asp-Ser-Xaa$_{(1-5)}$-Val/Ile-Pro/Asp, where Xaa is any amino acid residue.

An exemplary flanking region consensus sequence of the G912 TF family of AP2/EREBP proteins is Pro-Lys-Xaa-Xaa-Ala-Gly-Arg (amino acids 37-43 of SEQ ID NO: 186), or Ala-Gly-Arg-Xaa-Lys-Phe (amino acids 41-46 of SEQ ID NO: 186) or Glu-Thr-Arg-His-Pro (amino acids 48-52 of SEQ ID NO: 186), where Xaa is any amino acid residue.

Potential Applications

G912 or its equivalogs could be used to improve plant tolerance to cold, freezing, drought, and salt stress. In addition, G912 or its equivalogs could be used to change a plant's flowering time and size.

G913 (SEQ ID NO: 187)

Published Information

G913 was identified in the sequence of clone MSG15; it corresponds to gene MSG15.10 (GenBank PID BAB11050).

Closely Related Genes from Other Species

G913 is highly similar to a *Brassica napus* protein, encoded by a gene represented by EST AI352878 MB72-11D PZ204.BNlib *Brassica napus* cDNA clone pMB72-11D 5'.

Experimental Observations

The cDNA sequence of G913 was determined. To investigate the function(s) of G913, this gene was expressed under the control of the 35S promoter in transgenic plants. G913 overexpressing plants had dark green leaves that occasionally curled downward. These plants showed a delay in flowering and were also late senescing. Overexpressing G913 lines were more freezing tolerant and more drought tolerant than the wild-type controls.

In an ethylene sensitivity assay where the plants were tested for a triple response phenotype on plates containing ACC, G913 overexpressing plants showed stunting and curling in the hypocotyl region that was more exaggerated than the wild type triple response.

Potential Applications

G913 or its equivalogs could be used to improve plant tolerance to freezing and drought. G913 could also be used to manipulate the ethylene response.

G913 or its equivalogs may be used to delay flowering or senescence in plants. Extending vegetative development could bring about large increases in yields.

Additionally, a major concern is the escape of transgenic pollen from GMOs to wild species or so-called organic crops. Systems that prevent vegetative transgenic crops from flowering would eliminate this worry.

G922 (SEQ ID NO: 189)

Published Information

G922 corresponds to Scarecrow-like 3 (SCL3) first described by Pysh et al. (GenBank accession number AF036301; (1999) *Plant J.* 18: 111-119). Northern blot analysis results show that G922 is expressed in siliques, roots, and to a lesser extent in shoot tissue from 14 day old seedlings. Pysh et al did not test any other tissues for G922 expression. In situ hybridization results showed that G922 was expressed predominantly in the endodermis in the root tissue. This pattern of expression was very similar to that of SCARECROW (SCR), G306. Experimental evidence indicated that the co-localization of the expression is not due to cross-hybridization of the G922 probe with G306. Pysh et al proposed that G922 may play a role in epidermal cell specification and that G922 may either regulate or be regulated by G306.

The sequence for G922 can also be found in the annotated BAC clone F11F12 from chromosome 1 (GenBank accession number AC012561). The sequence for F11F12 was submitted to GenBank by the DNA Sequencing and Technology Center at Stanford University.

Closely Related Genes from Other Species

The amino acid sequence for a region of the *Oryza sativa* chromosome I clone P0466H10 (GenBank accession number AP003259) is significantly identical to G922 outside of the SCR conserved domains. Therefore, the gene represented by this region of the rice clone may be the ortholog of G922.

Experimental Observations

The function of this gene was analyzed using transgenic plants in which G922 was expressed under the control of the 35S promoter. Transgenic plants overexpressing G922 were more salt tolerant than wild-type plants as determined by a root growth assay on MS media supplemented with 150 mM NaCl. Plant overexpressing G922 also were more tolerant to osmotic stress as determined by germination assays in salt-containing (150 mM NaCl) and sucrose-containing (9.4%) media. Morphologically, plants overexpressing G922 had altered leaf morphology, coloration, fertility, and overall plant size. In wild-type plants, expression of G922 was induced by auxin, ABA, heat, and drought treatments. In non-induced wild-type plants, G922 was expressed constitutively at low levels.

Potential Applications

Based upon results observed in plants overexpressing G922, G922 or its equivalogs could be used to alter salt tolerance, tolerance to osmotic stress, and leaf morphology in other plant species. Evaporation from the soil surface causes upward water movement and salt accumulation in the upper soil layer where the seeds are placed. Thus, germination normally takes place at a salt concentration much higher than the mean salt concentration of in the whole soil profile. Increased salt tolerance during the germination stage of a crop plant would impact survivability and yield.

Altered leaf morphology could be desirable in ornamental horticulture.

G926 (SEQ ID NO: 191)

Published Information

G926 is equivalent to Hap2a (Y13720), a member of the CCAAT-box binding transcription factor family. The gene was identified by Edwards et al. ((1998) *Plant Physiol.* 117: 1015-1022), who demonstrated that G926 or AtHap2a were able to functionally complement a Hap2 deficient mutant of yeast suggesting that there is functional conservation between these proteins from diverse organisms. In addition, the AtHap2a gene was shown to be ubiquitously expressed in *Arabidopsis*.

Closely Related Genes from Other Species

G926 is most closely related to a *Brassica napus* protein (AAC49265). Similarity between the two proteins extend beyond the signature motif of the family to a level that would indicate the genes are orthologous. No functional information is available for the *Brassica napus* protein.

Experimental Observations

Consistent with the published expression pattern (Edwards et al. (1998) *Plant Physiol.* 117: 1015-1022), G926 was determined to be ubiquitously expressed and transcript levels appeared to be unaltered by any environmental stress-related condition tested. A line homozygous for a T-DNA insertion in G926 was used to determine the function of this gene.

The G926 knockout mutant line was morphologically wild-type. Physiological analysis revealed that in the presumed absence of G926 function, the plants became more tolerant to high osmotic conditions during germination. This osmotic stress tolerance could be related to the plant's apparent insensitivity to the growth hormone ABA. This was the second instance where a member of a CCAAT-box protein complex altered the plants osmotic stress response and ABA sensitivity during germination.

ABA plays an important regulatory role in the initiation and maintenance of seed dormancy. Lopez-Molina, L. et al. ((2001) *Proc. Natl. Acad. Sci. USA* 98: 4782-4787) describe a bZIP transcription factor, ABI5, that is involved in maintaining seeds in a quiescent state, preventing germination under adverse conditions such as drought stress. It is possible G926 also functions as part of this checkpoint for the germinating seeds and loss of G926 function promotes germination regardless of the osmotic status of the environment.

Potential Applications

G926 or its equivalogs could be used to improve plant tolerance to drought, and salt stress.

Evaporation from the soil surface causes upward water movement and salt accumulation in the upper soil layer where the seeds are placed. Thus, germination normally takes place at a salt concentration much higher than the mean salt concentration of in the whole soil profile. Increased salt tolerance during the germination stage of a crop plant would impact survivability and yield.

G961 (SEQ ID NO: 193)

Published Information

G961 was first identified in the sequence of the BAC clone F19D11, GenBank accession number AC005310, released by the *Arabidopsis* Genome Initiative.

Closely Related Genes from Other Species

The most related gene to G961 is a rice gene in accession number BAA84803.

Experimental Observations

The full length sequence of G961 was experimentally confirmed. The function of this gene was analyzed by knockout analysis. Plants homozygous for a T-DNA insertion in G961 were wild-type for all assays performed.

Gene expression profiling by RT-PCR showed that G961 was primarily expressed in shoots, embryos and siliques at medium levels, and at low levels in flowers. RT-PCR data also indicated an induction of G961 transcripts accumulation upon heat treatment.

G961 knockout mutants were found to have altered seed oil content as compared to wild-type plants.

Potential Applications

G961 or its equivalog knockout mutants may be used to alter seed oil content in plants, which may be very important for the nutritional value and production of various food products.

G971 (SEQ ID NO: 195)

Published Information

G971 corresponds to gene F28P10.30 (CAB41085).

Experimental Observations

The function of G971 was studied using transgenic plants in which the gene was expressed under the control of the 35S promoter.

Overexpression of G971 produced a marked delay in the transition to flowering. The effect was noted, to varying extents, in approximately half of the 35S::G971 primary transformants. These plants flowered between one and three weeks later than controls under continuous light conditions. At later stages, most of the plants also appeared darker green and developed larger leaves than controls. Two of the three T2 populations selected for further study displayed a comparable, but rather more extreme late flowering phenotype to that seen in the parental plants. At early stages, seedlings from these two lines were relatively small, but recovered as development progressed, and eventually became larger than wild type. No alterations were detected in 35S::G971 plants in the physiological and biochemical analyses that were performed.

G971 was ubiquitously expressed and does not appear to be significantly induced by any of the conditions tested.

Potential Applications

G971 or its equivalogs could be used to modify flowering time characteristics. A wide variety of applications exist for systems that either lengthen or shorten the time to flowering.

In species such as sugarbeet where the vegetative parts of the plants constitute the crop and the reproductive tissues are discarded, it would be advantageous to delay or prevent flowering. Extending vegetative development could bring about large increases in yields.

G974 (SEQ ID NO ID NO: 197)

Published Information

G974 was first identified in a BAC-end sequence (B28553; partial G974 sequence). G974 corresponds to gene F16L1.8 (BAC F16L1, AC024228).

Closely Related Genes from Other Species

Several AP2 proteins from a variety of species (*Atriplex hortensis, Lycopersicon esculentum, Glycine max, Populus balsamifera, Medicago truncatula*) exhibited sequence similarity with G974 outside of the signature AP2 domain sequence, and bear nearly identical AP2 domains. These proteins may be related.

Experimental Observations

The complete sequence of G974 (SEQ ID NO: 197) was obtained and G974 was studied using transgenic plants in which G974 was expressed under the control of the 35S promoter. Constitutive expression of G974 produced deleterious effects: the majority of 35S::G974 primary transformants showed a reduction in overall size and developed rather slowly compared to wild-type controls. These phenotypic alterations were not observed in the T2 generation, perhaps indicating silencing of the transgene. The T2 plants were wild-type in the physiological and biochemical analyses performed. G974 was ubiquitously expressed.

35S::G974 overexpressors had altered seed oil content.

Potential Applications

G974 or its equivalogs may be used to alter seed oil content in plants, which may be very important for the nutritional value and production of various food products.

G975 (SEQ ID NO: 199)

Published Information

G975 has appeared in the sequences released by the *Arabidopsis* Genome Initiative (BAC F9L1, GenBank accession number AC007591).

Closely Related Genes from Other Species

The non-*Arabidopsis* gene most highly related to G975 is represented by L46408 BNAF1258 Mustard flower buds *Brassica rapa* cDNA clone F1258. The similarity between G975 and the *Brassica rapa* gene represented by EST L46408 extends beyond the conserved AP2 domain that characterizes the AP2/EREBP family. This *Brassica rapa* gene appeared to be more closely related to G975 than *Arabidopsis* G1387, indicating that EST L46408 may represent a true G975 ortholog. The similarity between G975 and *Arabidopsis* G1387 also extends beyond the conserved AP2 domain.

Experimental Observations

G975 (SEQ ID NO ID NO: 199) was identified as a new member of the AP2/EREBP family (EREBP subfamily) of transcription factors. G975 was expressed in flowers and, at lower levels, in shoots, leaves, and siliques. GC-FID and GC-MS analyses of leaves from G975 overexpressing plants showed that the levels of C29, C31, and C33 alkanes were substantially increased (up to ten-fold) compared with control plants. A number of additional compounds of similar molecular weight, presumably also wax components, also accumulated to significantly higher levels in G975 overexpressing plants. C29 alkanes constituted close to 50% of the wax content in wild-type plants (Millar et al. (1998) *Plant Cell* 11:1889-1902), suggesting that a major increase in total wax content occurred in the G975 transgenic plants. However, the transgenic plants had an almost normal phenotype (although small morphological differences were detected in leaf appearance), indicating that overexpression of G975 was not deleterious to the plant. Overexpression of G975 did not cause the dramatic alterations in plant morphology that had been reported for *Arabidopsis* plants in which the FATTY ACID ELONGATION1 gene was overexpressed (Millar et al. 1998, *Plant Cell* 11:1889-1902). G975 may regulate the expression of some of the genes involved in wax metabolism. One *Arabidopsis* AP2 sequence (G1387) that is significantly more closely related to G975 than the rest of the members of the AP2/EREBP family is predicted to have a function and a use related to that of G975.

Potential Applications

G975 or its equivalogs can be used to manipulate wax composition, amount, or distribution, which in turn can modify plant tolerance to drought and/or low humidity or resistance to insects, as well as plant appearance (shiny leaves).

G975 or its equivalogs can also be used to specifically alter wax composition, amount, or distribution in those plants and crops from which wax is a valuable product.

G979 (SEQ ID NO: 201)

Published Information

G979 was first identified in a BAC-end sequence (B25031; partial G979 sequence). G979 corresponds to gene T12E18_20 (BAC T12E18, AL132971). No information is available about the function(s) of G979.

Experimental Observations

The complete sequence of G979 was obtained. The function of this gene was studied using both transgenic plants in which G979 was expressed under the control of the 35S promoter (April 2001), and a line with a T-DNA insertion in the gene. G979 codes for an AP2 protein of the AP2 subfamily, i.e., it contains two AP2 domains. The T-DNA insertion of the KO line lies in an intron, located in between the exons coding for the second AP2 domain of the protein, and is thus expected to result in a strong or null mutation. Whereas constitutive expression of G979 produced deleterious effects, the analysis of G979 KO mutant plants proved informative about the function of the gene. It was suggested that proteins of the AP2 subfamily were more likely to be involved in developmental processes (Riechmann et al. (1998). *Biol. Chem.* 379: 633-646). Fittingly, seeds homozygous for a T-DNA insertion within G979 showed delayed ripening, slow germination, and developed into small, poorly fertile plants, indicating that G979 is involved in seed development processes.

The difficulty in initially isolating, from heterozygous plants, progeny that was homozygous for the T-DNA insertion raised the possibility that homozygosity for that allele was lethal. Siliques of heterozygous plants were examined for seed abnormalities. Approximately 25% of the seeds contained in young green siliques were pale in coloration. In older, brown siliques, approximately 25% of the seeds were green and appeared slow ripening, whereas the remaining seeds were brown. Thus, it seemed likely that the seeds with altered development were homozygous for the T-DNA insertion, whereas the normal seeds were wild-type and heterozygous segregants.

Furthermore, it was observed that approximately 25% of the seed from G979 knockout heterozygous plants showed impaired (delayed) germination. Upon germination, these seeds produced extremely tiny seedlings that often did not survive transplantation. A few small and sickly looking homozygous plants could be grown, which produced siliques that contained seeds that were small and wrinkled compared to wild type.

A second, different, T-DNA insertion allele for G979 was identified as part of a TAIL PCR screen. Progeny of the heterozygous plant carrying that T-DNA insertion was either wild-type or heterozygous for the mutation, providing additional evidence for the disruption of G979 being the cause of the phenotypic alterations detected.

The initial analysis of the gene was performed using overexpressing lines. 35S::G979 transformants were generally smaller than wild type and developed spindly inflorescences that carried abnormal flowers with compromised fertility.

G979 expression was ubiquitous and not induced under any of the conditions tested.

Potential Applications

On the basis of the results obtained with G979 knockout mutant lines, it is possible that G979 or its equivalogs could be used to alter or modify seed germination, ripening and development properties and performance.

G987 (SEQ ID NO: 203)

Published Information

The genomic sequence of G987 is located on the *Arabidopsis* BAC clone T914 (gene T914.14) (GenBank accession number AC005315).

Experimental Observations

As determined by RT-PCR analysis, G987 was constitutively expressed in all tissues tested. A line homozygous for a T-DNA insertion in G987 was used to determine the function of this gene. The T-DNA insertion in G987 was approximately 4% into the coding sequence of the gene, and therefore is likely to result in a null mutation. G987 mutant plants could only be grown on sucrose-containing medium. Biochemical analyses of leaves from G987 mutants grown on sucrose-containing medium indicate that the mutants had reduced amounts of 16:3 fatty acids, the presence of two xanthophylls which were not present in wild-type leaves, the presence of gamma-tocopherol (which normally accumulates in seed tissue), and reduced levels of chlorophyll a and chlorophyll b.

Potential Applications

The low amount of 16:3 and dramatic reduction in chlorophyll indicated that the gene controls some aspect of thylakoid membrane development. G987 or its equivalogs may control proplastid to chloroplast development. This could be tested by measuring the expression of some of the genes (e.g. LHCP) that are associated with the transition from proplastid to chloroplast. If this were the case, the gene or its equivalogs may be useful for controlling the transition from proplastid to chromoplast in fruits and vegetables. There may also be some applications where it would be desirable to change the expression of the gene or its equivalogs (e.g., prevent cotyledon greening in *Brassica napus* or *campestris* to avoid green oil due to early frost).

G988 (SEQ ID NO: 205)

Published Information

G988 corresponds to a protein annotated as hypothetical in BAC F20N2 (GenBank accession number AC002328) from chromosome 1 of *Arabidopsis*. The sequence for G988 can also be found on the chromosome 1 BAC clone T5A14 and is described in patent application WO 98/46759.

Closely Related Genes from Other Species

The amino acid sequence for the *Capsella rubella* hypothetical protein represented by GenBank accession number CRU303349 was significantly identical to G988 outside of the SCR conserved domains. The *Capsella rubella* hypothetical protein is 90% identical to G988 over a stretch of roughly 450 amino acids. Therefore, it is likely that the *Capsella rubella* gene is an ortholog of G988.

Experimental Observations

G988 (SEQ ID NO ID NO: 205) was analyzed using transgenic plants in which G988 was expressed under the control of the 35S promoter. Plants overexpressing G988 had multiple morphological phenotypes. The transgenic plants were generally smaller than wild-type plants, had altered leaf, inflorescence and flower development, altered plant architecture, and altered vasculature.

Plants overexpressing G988 were found to have decreased seed oil and increased seed protein. In one transgenic line overexpressing G988, an increase in the seed glucosinolate M39489 was observed.

In wild-type plants, G988 was expressed primarily in flower and silique tissue, but was also present at detectable levels in all other tissues tested. Expression of G988 was induced in response to heat treatment, and repressed in response to infection with *Erysiphe*.

Potential Applications

Based on the observed morphological phenotypes of the transgenic plants, G988 or its equivalogs can be used to create plants with larger flowers. This can have value in the ornamental horticulture industry. The reduction in the formation of lateral branches suggests that G988 can have utility on the forestry industry. The *Arabidopsis* plants overexpressing G988 also had reduced fertility. This could actually be a desirable trait in some instances, as it can be exploited to prevent or minimize the escape of GMO (genetically modified organism) pollen into the environment.

G988 may also be used to modify seed oil and protein content.

G1040 (SEQ ID NO: 207)

Published Information

G1040 was identified in the sequence of BAC MFO20, GenBank accession number AB013391, released by the *Arabidopsis* Genome Initiative. G1040 has been published as KAN4, one of a clade of four KANADI genes that are thought to promote abaxial cell fates in lateral organs (Eshed et al. (2001) *Current Biology* 11: 1251-1260).

Experimental Observations

A full-length cDNA corresponding to G1040 was isolated. The function of this gene was analyzed using transgenic plants in which G1040 was expressed under the control of the 35S promoter. Plants overexpressing G1040 were found to produce seeds that were generally smaller and more rounded than control seeds, with a high proportion of irregularly-shaped seeds. No other morphological, physiological, or biochemical alterations were observed in these plants. G1040 may affect embryo development. G1040 was expressed throughout the plant, though at lower levels in shoots and rosette leaves than in other tissues.

Potential Applications

G1040 or its equivalogs could be used to manipulate seed size and shape.

G1047 (SEQ ID NO: 209)

Published Information

G1047 was identified in the sequence of BAC T20K9, GenBank accession number AC004786, released by the *Arabidopsis* Genome Initiative.

Experimental Observations

The boundaries of G1047 were experimentally determined and the function of G1047 was analyzed using transgenic plants in which this gene was expressed under the control of the 35S promoter. G1047 overexpressing lines were more tolerant to infection with a moderate dose of the fungal pathogen *Fusarium oxysporum*. G1047 overexpression did not seem to have consistent a detrimental effect on plant growth or vigor, and the lines tested for resistance were reported as being wild-type morphologically. In addition, no difference was detected between those lines and the corresponding wild-type controls in all the biochemical assays that were performed.

G1047 was ubiquitously expressed, and it was not significantly induced under any of the conditions tested Potential Applications G1047 transgenic plants have an altered response to the fungal pathogen *Fusarium oxysporum*. Therefore, G1047 or its equivalogs could be used to manipulate the defense response in order to generate pathogen-resistant plants.

G1051 (SEQ ID NO: 211)

Published Information

G1051 was initially identified in the sequence of BAC-end B77139 and subsequently the entire sequence of G1051 was disclosed in the sequence of BAC accession number AC005956, released by the *Arabidopsis* genome initiative.

Closely Related Genes from Other Species

G1051 is very similar to a rice bZIP transcription factor, accession number BAA96162, identified as part of the rice genome sequencing project. Homology between G1051 and this rice protein continues beyond the conserved domain, suggesting that they are orthologous.

Experimental Observations

The boundaries of G1051 were experimentally determined and the function of this gene was analyzed using transgenic plants in which G1051 was expressed under the control of the 35S promoter. Plants overexpressing G1051 exhibited a delay in flowering and typically produced flower buds about one week later than controls in continuous light conditions. G1051 was constitutively expressed throughout the plant and not induced by any condition tested.

Potential Applications

G1051 or its equivalogs could be used to manipulate flowering time in plants

G1052 (SEQ ID NO: 213)

Published Information

G1052 was identified in the sequence of BAC F9D24, GenBank accession number AL137081, released by the *Arabidopsis* Genome Initiative.

Closely Related Genes from Other Species

G1052 is similar to a rice gene BAA96162. Homology between G1052 and the rice gene extends beyond the conserved domain, thus the two genes may be orthologous.

Experimental Observations

The boundaries of G1052 in BAC AL137081 were experimentally determined and the function of G1052 was analyzed using transgenic plants in which this gene was expressed under the control of the 35S promoter. Plants overexpressing G1052 exhibited a delay in flowering and typically produced flower buds about one week later than controls in continuous light conditions. Additionally, these plants had larger leaves and were generally more sturdy than wild type.

A line homozygous for a T-DNA insertion in G1052 was also used to determine the function of this gene. The T-DNA insertion of G1052 was approximately one third of the way into the coding sequence of the gene and therefore is likely to result in a null mutation. A decrease in the percentage of lutein and increase in the xanthophyll 1 fraction was detected in one line in two experiments.

Potential Applications

The flowering time phenotype associated with G1052 over-expression indicates a utility for G1052 or its equivalogs as genes that can be used to manipulate flowering time in commercial plants. In addition, if the G1052 can not be transmitted through pollen, G1052 or its equivalogs may be used as a tool for preventing transgenes from escaping from transgenic plants through pollen dispersal.

G1052 or its equivalogs could be used to manipulate seed prenyl lipid composition. Lutein is an important nutraceutical, since lutein-rich diets have been shown to help prevent age-related macular degeneration (ARMD), which is the leading cause of blindness in people over the age of 65. In particular, consumption of dark green leafy vegetables has been shown in clinical studies to reduce the risk of ARMD. In addition, lutein, like other xanthophylls such as zeaxanthin and violaxanthin, is an essential component in the protection of the plant against the damaging effects of excessive light. Specifically, lutein contributes, directly or indirectly, to the rapid rise of nonphotochemical quenching in plants exposed to high light. Crop plants engineered to contain higher levels of lutein could therefore have improved photoprotection, possibly leading to less oxidative damage and better growth under high light.

G1062 (SEQ ID NO: 215)

Published Information

G1062 corresponds to gene MLJ15.14 (BAB01738.1).

Closely Related Genes from Other Species

G1062 protein shares extensive homology in the basic helix loop helix region with a cDNA from developing stem *Medicago truncatula* (AW691174) as well as a tomato shoot/meristem *Lycopersicon esculentum* cDNA (BG123327).

Experimental Observations

G1062 is a proprietary sequence initially identified from a library clone. The function of G1062 was analyzed by knockout analysis. The T-DNA insertion of G1062 was approximately 75% into the coding sequence of the gene and therefore is likely to result in a null mutation.

Homozygotes for a T-DNA insertion in G1062 showed slow growth and produced abnormal seeds. Knockout.G1062 plants displayed a longer leaf plastochron than wild type. Both generated flower buds at the same time, but wild-type plants had produced 9-11 rosette leaves at that point, compared to only 5-9 rosette leaves in the mutant (24 hour light). Following bolting, KO.G1062 inflorescences developed more slowly and were shorter than wild type. Knockout G1062 seeds appeared twisted and wrinkled in comparison to wild-type seed.

Physiological assays revealed that seedlings from a G1062 knockout mutant line have a light grown phenotype in the dark and were more severely stunted in an ethylene insensitivity assay when compared to the wild-type controls. This result indicated that G1062 may be involved in the ethylene triple response pathway. It is well known that ethylene is involved in the seed ripening process and therefore, the abnormal seed phenotype could be related to a general sensitivity to ethylene signal transduction pathway.

RT-PCR analysis indicated that the transcripts of G1062 were predominantly accumulated in the reproductive tissues. Its expression level appeared to be not affected by any treatments tested.

Potential Applications

G1062 or its equivalogs that alter seed shape are likely to provide ornamental applications.

Since G1062 is involved in the ethylene triple response pathway, G1062 could be used to manipulate seed or fruit ripening process, and to improve seed or fruit quality.

G1063 (SEQ ID NO: 217)

Published Information

G1063 corresponds to gene K21H1.2 (BAB10940.1).

Closely Related Genes from Other Species

G1063 protein shared extensive homology in the basic helix loop helix region with a protein sequence encoded by *Glycine max* cDNA clone (AW832545) as well as a tomato root, plants pre-anthesis *Lycopersicon sculentum* cDNA (BE451174).

Experimental Observations

G1063 (SEQ ID NO: 217) is a member of a clade of highly related HLH/MYC proteins that also includes G779, G1499, G2143, and G2557. All of these genes caused similar pleiotropic phenotypic effects when overexpressed, the most striking of which was the production of ectopic carpelloid tissue. These genes can be considered key regulators of carpel development. A spectrum of developmental alterations was observed amongst 35S::G1063 primary transformants and the majority were markedly small, dark green, and had narrow curled leaves. The most severely affected individuals were completely sterile and formed highly abnormal inflorescences; shoots often terminated in pin-like structures, and flowers were replaced by filamentous carpelloid structures. In other cases, flowers showed internode elongation between floral whorls, with a central carpel protruding on a pedicel-like organ. Additionally, lateral branches sometimes failed to develop and tiny patches of carpelloid tissue formed at axillary nodes of the inflorescence. In lines with an intermediate phenotype, flowers contained defined whorls of organs, but sepals were converted to carpelloid structures or displayed patches of carpelloid tissue. In contrast, lines with a weak phenotype developed relatively normal flowers and produced a reasonable quantity of seed. Such plants were still distinctly smaller than wild-type controls. Since the strongest 35S::G1063 lines were sterile, three lines with a relatively weak phenotype, that had produced sufficient seed for biochemical and physiological analysis, were selected for further study. Two of the T2 populations (T2-28,37) were clearly small, darker green and possessed narrow leaves compared to wild type. Plants from one of these populations (T2-28) also produced occasional branches with abnormal flowers like those seen in the T1. The final T2 population (T2-30) displayed a very mild phenotype. Overexpression of G1063 in *Arabidopsis* resulted in a decrease in seed oil content in two T2 lines. No altered phenotypes were detected in any of the physiological assays, except that the plants were noted to be somewhat small and produce anthocyanin when grown in Petri plates. G1063 was expressed at low to moderate levels in roots, flowers, rosette leaves, embryos, and germinating seeds, but was not detected in shoots or siliques. G1063 was induced by auxin Potential Applications G1063 or its equivalogs can be used to manipulate flower form and structure or plant fertility. One application for manipulation of flower structure can be in the production of saffron, which is derived from the stigmas of *Crocus sativus*. G1063 has utility in manipulating seed oil and protein content.

G1064 (SEQ ID NO: 219)

Closely Related Genes from Other Species G1064 protein shares a close homology to an auxin-induced basic helix-loop-helix transcription factor from *Gossypium hirsutum* (PID:5731257) in the bHLH motif region as well as outside of this region. G1064 also has high similarity to a tomato germinating seedlings cDNA clone (AW649873).

Experimental Observations

G1064 was initially identified from a library clone collection. The function of G1064 was analyzed using transgenic plants in which G1064 was expressed under the control of the 35S promoter.

Physiological assays revealed that G1064 overexpressing lines were more susceptible to infection with a low dose of the fungal pathogen *Botrytis cinerea* compared to the wild-type controls.

No morphological and biochemical alterations were observed in the overexpressing transgenic plants when compared to wild-type controls. Furthermore, RT-PCR analyses of the endogenous levels of G1064 indicated that this gene was uniformly expressed in all tissues and under all conditions tested.

Potential Applications

Since G1064 transgenic plants have an altered response to the pathogen *Botrytis cinerea*, G1064 or its equivalogs could be used to manipulate the defense response in order to generate pathogen-resistant plants.

G1069 (SEQ ID NO: 221)

Published Information

The sequence of G1069 was obtained from EU *Arabidopsis* sequencing project, GenBank accession number Z97336, based on its sequence similarity within the conserved domain to other AT-Hook related proteins in *Arabidopsis*.

Closely Related Genes from Other Species

G1069 protein shares a significant homology to a cDNA isolated from *Lotus japonicus* nodule library. Similarity between G1069 and the *Lotus* cDNA extends beyond the signature motif of the family to a level that would suggest the genes are orthologous. Therefore the gene represented by EST AW720668 may have a function and/or utility similar to that of G1069.

Experimental Observations

The sequence of G1069 was experimentally determined and the function of G1069 was analyzed using transgenic plants in which G1069 was expressed under the control of the 35S promoter.

Plants overexpressing G1069 showed changes in leaf architecture, reduced overall plant size, and retarded progression through the life cycle. This is a common phenomenon for most transgenic plants in which AT-HOOK proteins are overexpressed if the gene is predominantly expressed in root in the wild-type background. G1069 was predominantly expressed in roots, based on analysis of RT-PCR results. To minimize these detrimental effects, G1069 may be overexpressed under a tissue specific promoter such as root- or leaf-specific promoter or under inducible promoter.

One of G1069 overexpressing lines showed more tolerance to osmotic stress when they were germinated in high sucrose plates. This line also showed insensitivity to ABA in a germination assay.

Potential Applications

The osmotic stress results indicate that G1069 could be used to alter a plant's response to water deficit conditions and, therefore, the gene or its equivalogs could be used to engineer plants with enhanced tolerance to drought, salt stress, and freezing.

G1069 affects ABA sensitivity, and thus when transformed into a plant the gene or its equivalogs may diminish cold, drought, oxidative and other stress sensitivities, and also be used to alter plant architecture, and yield.

G1073 (SEQ ID NO: 223)

Published Information

G1073 has been identified in the sequence of a BAC clone from chromosome 4 (BAC clone F23E12, gene F23E12.50, GenBank accession number AL022604), released by EU *Arabidopsis* Sequencing Project.

Closely Related Genes from Other Species

G1073 has similarity to *Medicago truncatula* cDNA clones (GenBank accession number AW574000 and AW560824) and *Glycine max* cDNA clones (AW349284 and AI736668) in the database.

Experimental Observations

The function of G1073 was analyzed using transgenic plants in which G1073 was expressed under the control of the 35S promoter. Transgenic plants overexpressing G1073 were substantially larger than wild-type controls, with at least a 60% increase in biomass. The increased mass of 35S::G1073 transgenic plants was attributed to enlargement of multiple organ types including leaves, stems, roots and floral organs. Petal size in the 35S::G1073 lines was increased by 40-50% compared to wild type controls. Petal epidermal cells in those same lines were approximately 25-30% larger than those of the control plants. Furthermore, 15-20% more epidermal cells per petal were produced compared to wild type. Thus, at least in petals, the increase in size was associated with an increase in cell size as well as in cell number. Additionally, images from the stem cross-sections of 35S::G1073 plants revealed that cortical cells are large and that vascular bundles contained more cells in the phloem and xylem relative to wild type Seed yield was increased compared to control plants. 5S::G1073 lines showed an increase of at least 70% in seed yield. This increased seed production was associated with an increased number of siliques per plant, rather than seeds per silique.

Flowering of G1073 overexpressing plants was delayed. Leaves of G1073 overexpressing plants were generally more serrated than those of wild-type plants. Improved drought tolerance was observed in 35S::G1073 transgenic lines.

Potential Applications

Transgenic plants overexpressing G1073 are large and late flowering with serrated leaves. Large size and late flowering produced as a result of G1073 or equivalog overexpression would be extremely useful in crops where the vegetative portion of the plant is the marketable portion (often vegetative growth stops when plants make the transition to flowering). In this case, it would be advantageous to prevent or delay flowering with the use of this gene or its equivalogs in order to increase yield (biomass). Prevention of flowering by this gene or its equivalogs would be useful in these same crops in order to prevent the spread of transgenic pollen and/or to prevent seed set. This gene or its equivalogs could also be used to manipulate leaf shape and drought tolerance.

G1075 (SEQ ID NO: 225)

Published Information

The sequence of G1075 was obtained from the *Arabidopsis* genome sequencing project, GenBank accession number AC004667, based on its sequence similarity within the conserved domain to other AT-Hook related proteins in *Arabidopsis*.

Closely Related Genes from Other Species

G1075 is homologous to a *Medicago truncatula* cDNA clone (acc#AW574000

Experimental Observations

The function of G1075 was analyzed using transgenic plants in which G1075 was expressed under the control of the 35S promoter. Overexpression of G1075 produced very small, sterile plants. Pointed leaves were noted in some seedlings, and twisted or curled leaves and abnormal leaf serrations were noted in rosette stage plants. Bolts were short and thin with short internodes. Flowers from severely affected plants had reduced or absent petals and stamen filaments that partially or completely fail to elongate. Because of the severe phenotypes of these T1 plants, no T2 seed was produced for physiological and biochemical analysis.

RT-PCR analysis indicated that G1075 transcripts are found primarily in roots. The expression of G1075 appeared to be induced by cold and heat stresses.

Potential Applications

G1075 or its equivalogs could be used to modify plant architecture and development, including flower structure. If expressed under a flower-specific promoter, the gene or its equivalogs might also be useful for engineering male sterility. Because expression of G1075 is root specific, its promoter could be useful for targeted gene expression in this tissue.

G1084 (SEQ ID NO: 227)

Published Information

G1084 was discovered as a type 2 bZIP gene in BAC F19F24, accession number AC002392, released by the *Arabidopsis* genome initiative.

Experimental Observations

The boundaries of G1084 were experimentally determined and the function of G1084 was analyzed using transgenic plants in which G1084 was expressed under the control of the 35S promoter.

Plants overexpressing G1084 showed more disease symptoms following inoculation with a low dose of the fungal pathogen *Botrytis cinerea*. G1084 expression appeared to be restricted to flowers and embryos and was not significantly induced by any conditions tested. Interestingly, one of twenty T1 plants showed heritable alterations in flower development. One explanation for this is that this phenotype was caused by silencing of endogenous G1084 in that particular line, causing a phenotype similar to that produced if G1084 was knocked out. No altered phenotypes were detected in any biochemical assay performed.

Potential Applications

G1084 or its equivalogs could be used to manipulate the plant defense response to produce pathogen-resistant plants.

G1089 (SEQ ID NO: 229)

Published Information

G1089 was initially identified as a gene represented by *Arabidopsis* EST H37430. Subsequently, the entire sequence of G1089 was identified in BAC F19K6, GenBank accession number AC037424, released by the *Arabidopsis* genome initiative.

Closely Related Genes from Other Species

The most related gene to G1089 is a rice gene represented by NCBI entry g13124871. Similarity between G1089 and the rice gene extends beyond the signature motif of the family to a level that would suggest the genes are orthologous. Therefore the gene represented by the rice gene may have a function and/or utility similar to that of G1089

Experimental Observations

The boundaries of G1089 were experimentally determined and the function of G1089 was analyzed using transgenic plants in which this gene was expressed under the control of the 35S promoter. G1089 overexpressing plants had reduced seedling vigor and were characterized as being small, yellow and sickly looking. In addition, a T-DNA knockout of G1089 was isolated. G1089 knockout mutant plants showed more tolerance to osmotic stress in a germination assay in two separate experiments. They showed more seedling vigor than wild-type control when germinated on plates containing high sucrose. G1089 appeared to be constitutively expressed.

Potential Applications

The osmotic stress results indicate that G1089 or its equivalogs could be used to alter a plant's response to water deficit conditions and, therefore, may be used to engineer plants with enhanced tolerance to drought, salt stress, and freezing.

G1134 (SEQ ID NO: 231)

Published Information

A partial sequence of G1134 was identified from an EST clone (GenBank accession number AI099951).

Experimental Observations

A partial sequence of G1134 was identified from an EST clone (GenBank accession number AI099951). The 5' end of the G1134 coding sequence was determined by RACE. The function of G1134 was analyzed using transgenic plants in which G1134 was expressed under the control of the 35S promoter. Primary transformants of G1134 were small with strongly curled leaves. In the T2 generation, two lines had narrow, somewhat curled leaves and siliques with altered shape. A third line segregated for small size. Additionally, plants overexpressing G1134 showed an altered response to the growth hormone ethylene. Seeds that were germinated on ACC plates in the dark had longer hypocotyls than the corresponding controls and occasionally lacked the apical hook that is part of a typical ethylene triple response. In addition, seeds from all lines germinated in the dark have a partial light grown phenotype in that their cotyledons are open and the hypocotyl is straight instead of curled.

The results from morphological and physiological analysis indicated that G1134 protein may play important roles in the regulation of ethylene biosynthesis, ethylene signal transduction pathways, or photomorphogenesis. Analysis of G1134 overexpressors revealed no apparent biochemical changes when compared to wild-type control plants. Analysis of the endogenous expression level of G1134, as determined by RT-PCR, revealed that G1134 was predominantly expressed in flower tissues. Expression of G1134 was not induced by any of the environmental conditions or pathogens tested.

Potential Applications

G1134 or its equivalogs could be used to alter how plants respond to ethylene and/or light. For example, it could be used to manipulate fruit ripening.

G1140 (SEQ ID NO: 233)

Published Information

G1140 corresponds to gene AT4g24540 (CAB79364), and has also been referred to as AGL24 (Alvarez-Buylla et al. (2000a) *Proc. Natl. Acad. Sci. USA* 97:5328-5333; Alvarez-Buylla et al. (2000b) *Plant J.* 2000 24:457-466).

Closely Related Genes from Other Species

G1140 shows sequence similarity outside of the conserved MADS domain with a variety of MADS proteins from different plant species, such as gi13448660 (MADS box transcription factor from *Ipomoea batatas*).

Experimental Observations

The function of G1140 was studied using transgenic plants in which the gene was expressed under the control of the 35S promoter.

Overexpression of G1140 produced marked alterations in flower morphology, which were initially observed in a relatively small proportion (6/20 lines) of the T1 plants. Alterations included variations in organ size and number. In particular, increased numbers of petals and sepals were often present, and sometimes small carpel-like outgrowths were fused to the central pair of carpels. Additionally, petals sometimes displayed leaf-like characteristics. It should be noted, however, that these abnormalities were most prevalent in early flowers and that later-arising flowers were sometimes normal. Two of the lines selected for subsequent studies showed these floral phenotypes, which became much more extreme in the T2 populations. Some of the effects resembled those produced by strong apetala1 or apetala2 alleles. Lowermost floral nodes were replaced by shoot-like structures, which became increasingly flower-like towards the top of the inflorescence. In the lower structures, floral organs were not apparent and were replaced by bract-like organs that were not organized into whorls. Later 'flowers' had sepals and petals replaced by bract like organs, but individual 'whorls' could be discerned. Stamens and carpels often had bract-like characteristics and carpels were frequently unfused. Furthermore, internode elongation was commonly observed between floral whorls.

G1140 is a MADS box gene of the MIKC-type, and many members of that subfamily are involved in the control of flower development. Determination of the functions of MADS box genes has often required the characterization of loss-of-function mutants. However, G1140 knockout mutant plants were wild-type in morphology and development, as well as in the physiological and biochemical analyses that were performed. In that mutant line, the T-DNA insertion lies shortly downstream of the conserved MADS domain, within an exon. Within the *Arabidopsis* MADS-box gene family, G1140 is most closely related to G861/SHORT VEGETATIVE PHASE, which is involved in the floral transition (Hartmann et al. (2000) *Plant J.* 21:351-360).

G1140 was expressed in roots, leaves, shoots, and floral tissues. G1140 expression was not detected in embryo, siliques, or germinating seedlings. The expression of the gene did not appear to be significantly induced by any of the conditions tested.

Potential Applications

Based on the phenotypes observed in 35S::G1140 plants, the gene or its equivalogs could be used to manipulate flower structure and development.

G1143 (SEQ ID NO: 235)

Published Information

The sequence of G1143 was obtained from the *Arabidopsis* genome sequencing project, GenBank accession number AL031187, based on its sequence similarity within the conserved domain to other bHLH/Myc related proteins.

Experimental Observations

The function of G1143 was analyzed using transgenic plants in which G1143 was expressed under the control of the 35S promoter. 35S::G143 transgenic plants showed no consistent differences in morphology to wild-type controls. In a first sowing of the T2 populations, it was observed that the plants were possibly early flowering. However, this phenotype was not apparent in either a replant of the T2 lines or in any T1 plants.

As measured by NIR, G1143 overexpressing plants were found to have decreased seed oil content and increased seed protein content compared to wild-type plants.

Potential Applications

G1143 or equivalog overexpression may be used to alter seed oil and seed protein content in plants, which may be very important for the nutritional value and production of various food products.

G1146 (SEQ ID NO: 237)

Published Information

G1146 corresponds to the ZWILLE and PINHEAD/ZWILLE gene described by Moussain et al. ((1998) *EMBO J.* 17: 1799-1809) and Lynn et al. ((1999) *Development* 126: 469-481). Moussain et al. have shown that G1146 is required to establish the central-peripheral organization of the embryo apex and that this step is critical for shoot meristem self-perpetuation. They indicate that G1146 is required to maintain stem cells of the developing shoot meristem in an undifferentiated state during the transition from embryonic development to repetitive post-embryonic organ formation. Based upon the results of Moussain et al from in situ hybridization analysis, G1146 is found in provascular cells at all stages of development.

Lynn et al. describe the phenotype of a plant with a mutation on G1146. Early in development, G146 mutant plants have abnormal embryos, with aberrant division of the upper cells of the suspensor. In young seedling, there is a radially symmetric pin-like structure in the position normally occupied by the shoot apical meristem. As development proceeds, new shoot meristems eventually arise in the axils of the cotyledons. Phenotypes observed in older plants include trumpet-shaped leaves and abnormalities in the primary inflorescence. Based upon their results from northern blot analysis, G1146 expression can be detected in roots, leaves, siliques and inflorescences of developing and mature plants. In the developing embryo, G1146 expression is found in the embryo proper and in the uppermost cell of the suspensor, as determined by in situ hybridization analysis.

Closely Related Genes from Other Species

The amino acid sequence for a region of the *Oryza sativa* chromosome 6 clone OJ1057_A09 (GenBank accession number AP003986) is significantly identical to G1146 outside of the PAZ conserved domains. Therefore, the gene represented by this region of the rice clone may be the ortholog of G1146.

Experimental Observations

The function of this gene was analyzed using transgenic plants in which G1146 was expressed under the control of the 35S promoter. Transgenic plants overexpressing G1146 had leaves that had a severe inward curl. The phenotype of these transgenic plants was wild-type in all other assays performed. G1146 expression was detected in all tissues tested, with expression being highest in flowers, rosette tissue, developing seeds and siliques. Expression of G1146 was not induced by any of the environmental or stress conditions tested.

Potential Applications

On the basis of analyses performed to date, G1146 or its equivalogs can be used in ornamental horticulture to create plants with altered leaf morphology.

G1196 (SEQ ID NO: 239)

Published Information

G1196 was identified by amino acid sequence similarity to ankyrin repeat proteins. G1196 is found in the sequence of the 4, BAC clone T16H5 (GenBank AL024486.1 GI:3250673), released by the *Arabidopsis* Genome Initiative. The start and stop codons were correctly predicted. The closest homologous *Arabidopsis* protein is NPR1, which is required for development of systemic acquired resistance in plants (Cao et al. (1997) *Cell* 88:57-63).

Experimental Observations

RT-PCR analysis of the endogenous level of G196 transcripts revealed low constitutive expression in all tissue examined. G1196 transcript levels increased upon auxin, ABA, cold, heat and salt treatment, as well as 7 days post-inoculation with *Erysiphe orontii*. Plants treated with SA showed moderate accumulation of G1196 transcripts. The physiological analysis of a G1196 null mutant line revealed increased susceptibility to a low dose inoculum of *Botrytis cinerea*. This finding indicated that G1196 may play a similar role to NPR1 in disease pathways. Apart from disease susceptibility, the functional characterization of the G196 null mutant revealed no significant changes in the biochemical profile, the morphology and development, or the response to biotic/abiotic stress treatments in comparison to the wild-type controls.

Potential Applications

Lack of G196 activity in a null mutant has been shown to affect the onset of disease following inoculation with *Botrytis cinerea*. Therefore, G1196 or its equivalogs could be used to manipulate the defense response in order to generate pathogen-resistant plants.

G1198 (SEQ ID NO: 241)

Published Information

The entire sequence of G1198 was reported in BAC T23G18, accession number AC011438, released by the *Arabidopsis* genome initiative.

Closely Related Genes from Other Species

G198 is very similar to the tobacco bZIP transcription factor TGA2.2 (accession number AF031487). Similarity extends well beyond the conserved domain, suggesting that G1198 and TGA2.2 have similar functions.

Experimental Observations

The boundaries of G1198 were experimentally determined and the function of G1198 was analyzed using transgenic plants in which this gene was expressed under the control of the 35S promoter. G1198 overexpressing plants were reduced in size with smaller, narrower leaves and had significantly increased levels of a glucosinolate as compared to wild type. G1198 did not appear to be expressed in rosette leaves, but was expressed in other tissues.

G1198 overexpressing plants were found to have increased seed oil content, as compared to wild-type plants.

Potential Applications

G198 or equivalog overexpression maybe used to alter seed oil content in plants, which may be very important for the nutritional value and production of various food products.

G1225 (SEQ ID NO: 243)

Published Information

The sequence of G1225 was obtained from *Arabidopsis* genomic sequencing project, GenBank accession number AB016882, based on its sequence similarity within the conserved domain to other bHLH related proteins in *Arabidopsis*.

Experimental Observations

The complete sequence of G1225 was determined. G1225 expression was detected in rosette leaves, flowers, embryos and siliques. No expression was detected in shoots, roots or germinating seeds. G1225 was not induced by any condition tested. It may possibly be repressed by cold and *Erysiphe* infection.

The function of this gene was analyzed using transgenic plants in which G1225 was expressed under the control of the 35S promoter. G1225 overexpressors showed greener cotyledons and longer roots on high sucrose and glucose containing media compared to wild-type controls. This effect was seen in two of the three lines tested. G1225 may thus be involved in sugar sensing. Plants overexpressing G1225 were also found to flower earlier than control plants. 35S::G1225 transformants from two independent T2 lines produced visible flower buds several days earlier than controls, in each of two separate plantings. A similar decrease in flowering time was also seen in thirteen out of twenty T1 lines. In fact, 35S::G1225 seedlings appeared to develop rather more rapidly than wild type and progressed through the lifecycle at a faster rate. Overexpression of G1225 in *Arabidopsis* did not result in any biochemical phenotypic alteration.

The sugar sensing phenotype of G1225 overexpressing plants may be related to the early flowering phenotype. Sugars are central regulatory molecules that control several aspects of plant physiology, metabolism, and development, including flowering.

Potential Applications

G1225 or its equivalogs may be useful for accelerating flowering time.

The sugar sensing phenotype of G1225 indicates that this gene or its equivalogs may be also useful for altering source-sink relationships or other sugar regulated processes.

G1226 (SEQ ID NO: 245)

Experimental Observations

The function of this gene was studied using transgenic plants in which G1226 was expressed under the control of the 35S promoter. Approximately 50% of 35S::G1226 primary transformants flowered earlier than wild-type controls under continuous light conditions. However, no correlation was noted between transgene expression level (determined by RT-PCR, not shown) and this phenotype; some T1 plants that appeared wild-type clearly expressed the transgene. Marginally early flowering was noted in one of three T2 lines, but the other two lines appeared wild-type. Kanamycin segregation data indicated that all three lines contained single locus transgene insertions. RT-PCR analysis indicates that G1226 was constitutively expressed in all tissues, with the exception of roots.

As measured by NIR, G1226 overexpressors had increased seed oil content compared to wild-type plants.

Potential Applications

G1226 or equivalog overexpression may be used to alter seed oil content, which may be very important for the nutritional value and production of various food products G1226 or its equivalogs could be used to manipulate the flowering time.

G1229 (SEQ ID NO: 247)

Experimental Observations

RT-PCR analysis indicated that G1229 was expressed in all tissues except roots. Its expression level was increased by auxin treatment and repressed by *Erysiphe* treatment.

The function of G1229 was studied using transgenic plants in which this gene was expressed under the control of the 35S promoter. Overexpression of G1229 strongly influenced plant development. G1229 T1 overexpressing plants were consistently small, paler in color, had rounder leaves, and were slower growing than wild type. These effects were attenuated to some extent in the T2 generation, but were still apparent in two of the three lines analyzed. Physiological assays revealed that G1229 overexpressing lines had reduced seed germination and seedling vigor compared to wild-type plants when grown on MS plates. Plants from G1229 overexpressing lines also showed an ethylene sensitive phenotype when germinated in the dark on media containing ACC. However, because germination was generally poor, the interpretation of this phenotype is difficult.

A single line showed a number of additional phenotypic differences; in this line flower structure was altered and abnormal seed was produced that appeared darker and more wrinkled than wild-type seed. Seeds from this line showed a significant decrease in oil content as measured by NIR. This observation has been repeated. It is possible that these multiple phenotypes could be due to disruption of an endogenous gene by the transgene insertion, rather than to overexpression of G1229.

Potential Applications

Based on the current analysis of G1229 overexpressing plants, potential utilities for G1229 or its equivalogs are decrease seed oil contents in crop plants.

G1255 (SEQ ID NO: 249)

Published Information

G1255 was identified as a gene in the sequence of BAC AC079281, released by the *Arabidopsis* Genome Initiative.

Closely Related Genes from Other Species

G1255 showed strong homology to a putative rice zing finger protein represented by sequence AC087181_3. Sequence identity between these two proteins extends beyond the conserved domain, and therefore, these genes can be orthologs.

Experimental Observations

The sequence of G1255 (SEQ ID NO: 249) was experimentally determined and G1255 was analyzed using transgenic plants in which G1255 was expressed under the control of the 35S promoter. Plants overexpressing G1255 had alterations in leaf architecture, a reduction in apical dominance, an increase in seed size, and showed more disease symptoms following inoculation with a low dose of the fungal pathogen *Botrytis cinerea*. G1255 was constitutively expressed and not significantly induced by any conditions tested Potential Applications On the basis of the phenotypes produced by overexpression of G1255, G1255 or its equivalogs can be used to manipulate the plant's defense response to produce pathogen resistance, alter plant architecture, or alter seed size.

G1266 (SEQ ID NO: 251)

Published Information

G1266 corresponds to ERF1, 'ethylene response factor 1' (GenBank accession number AF076277) (Solano et al. (1998) *Genes Dev.* 12: 3703-3714). ERF1 was isolated in a search for *Arabidopsis* EREBP-like genes using a PCR-based approach. ERF1 expression was shown to be rapidly induced by ethylene, and to be dependent on the presence of functional EIN3 (ETHYLENE-INSENSITIVE3), as no expression was detected in ein3-1 mutants (Solano et al. (1998) supra). Furthermore, ERF1 mRNA showed constitutive high-level expression in 35S::EIN3-expressing transgenic plants, and EIN3 was shown to bind to sequences in the ERF1 promoter in a sequence-specific manner (Solano et al. (1998) supra). All these results indicated that ERF1 is downstream of EIN3 in the ethylene signaling pathway, and that both proteins act sequentially in a cascade of transcriptional regulation initiated by ethylene gas (Solano et al. (1998) supra). ERF1 binds specifically to the GCC element, which is a particular type of ethylene response element that is found in the promoters of genes induced upon pathogen attack (Solano et al., (1998) supra). 35S::ERF1-expressing transgenic plants displayed phenotypes similar to those observed in the constitutive ethylene response mutant ctrl or in wild-type plants exposed to ethylene; however, expression of only a partial seedling triple response in these lines indicated that ERF1 mediates only a subset of the ethylene responses (Solano et al. (1998) supra). At the adult stage, 35S::ERF1-expressing transgenic plants showed a dwarf phenotype, and some ethylene-inducible genes, like basic-chitinase and PDF1.2 were constitutively activated in those lines (Solano et al. (1998) supra). All these results showed that ERF1 is a downstream ethylene signaling pathway gene.

Closely Related Genes from Other Species

The sequences of *Nicotiana tabacum* S25-XP1 (GenBank accession number AAB38748) and G1266 are very similar, with similarity between the two proteins extending beyond the conserved AP2 domain.

Experimental Observations

The function of G1266 was further analyzed using transgenic plants in which this gene was expressed under the control of the 35S promoter. As expected from the previously published work, G1266 overexpressing plants showed a dwarf phenotype. In physiological assays, it was shown that G1266 overexpressing plants were more tolerant to infection with a moderate dose of the fungal pathogen *Erysiphe orontii*.

The resistance phenotype to the fungal pathogen *Erysiphe orontii* has been repeated. This phenotype might be a consequence of ERF1 being a downstream ethylene signaling pathway gene. Constitutive expression of G1266 might accelerate leaf senescence, which in turn might impair infection by *Erysiphe orontii*.

In addition, when analyzed for leaf insoluble sugar composition, three lines showed alterations in rhamnose, arabinose, xylose, and mannose, and galactose when compared with wild-type plants.

Potential Applications

G1266 has been shown to be a downstream ethylene signaling pathway gene, and experiments implicate this gene in the plant response to the fungal pathogen *Erysiphe orontii*. G1266 or its equivalogs could therefore be used to engineer plants with a modulated response to that and other pathogens, for example, plants showing increased resistance.

G1275 (SEQ ID NO: 253)

Published Information

G1275 was first identified in the sequence of BAC T19G15 (GenBank accession number AC005965).

Experimental Observations

The cDNA sequence of G1275 was determined. G1275 was ubiquitously expressed, although expression levels differed among tissues. It is possible that G1275 expression is induced by several stimuli, including infection by *Erysiphe*, *Fusarium*, and SA treatment.

The function(s) of G1275 were investigated using both knock-out mutants and overexpressing plants in which this gene was expressed under the control of the 35S promoter.

Primary transformants of G1275 were small with reduced apical dominance. The inflorescence stems produced by these plants did not elongate normally. The plants were fertile, but seed yield was reduced because the plants were severely dwarfed.

In the knock-out mutant, the T-DNA insertion in G1275 was localized in the second intron of the gene, which is located within the conserved WRKY-box. Such insertion would result in a null mutation (unless the large fragment of exogenous sequence is perfectly spliced out from the transcribed G1275 pre-mRNA). G1275 knock-out mutant plants were indistinguishable from wild-type controls in all assays performed.

Potential Applications

G1275 or its equivalogs might be used to alter plant development or architecture.

G1305 (SEQ ID NO: 255)

Published Information

G1305 is a member of the (R1)R2R3 subfamily of myb transcription factors. G1305 corresponds to the gene MYB10 (Kranz et al. (1998) *Plant J.* 16: 263-276).

Experimental Observations

The function of G1305 was analyzed using transgenic plants in which the gene was expressed under the control of the 35S promoter. Overexpression of G1305 in *Arabidopsis* resulted in seedlings that were more tolerant to heat in a germination assay. Seedlings from G1305 overexpressing transgenics were greener than the control seedlings under high temperature conditions. In a repeat experiment, two lines showed the heat tolerant phenotype. In addition, plants from two of the 35S::G1305 T2 lines flowered several days earlier than wild type in each of two independent sowings (24 hour light conditions). The plants had rather flat leaves compared to controls and formed slightly thin inflorescences in some cases.

According to RT-PCR, G1305 was expressed ubiquitously and expression of the gene was unaltered in response to the environmental stress-related conditions tested.

Potential Applications

On the basis of the analyses performed to date, the potential utility of G1305 or its equivalogs is to regulate a plant's time to flower.

G1305 or its equivalogs may also be used to improve heat tolerance at germination. The germination of many crops is very sensitive to temperature. A gene that would enhance germination in hot conditions may be useful for crops that are planted late in the season or in hot climates.

G1322 (SEQ ID NO: 257)

Published Information

G1322 is a member of the (R1)R2R3 subfamily of myb transcription factors. G1322 corresponds to Myb57, a gene identified by Kranz et al. ((1998) *Plant J.* 16: 263-276). The authors used a reverse-Northern blot technique to study the expression of this gene in a variety of tissues and under a variety of environmental conditions. They were unable to detect the expression of G1322 in any tissue or treatments tested (Kranz et al. (1998) *Plant J.* 16: 263-276).

Closely Related Genes from Other Species

G1322 shows sequence similarity with known genes from other plant species within the conserved Myb domain.

Experimental Observations

G1322 (SEQ ID NO: 257) was analyzed using transgenic plants in which the gene was expressed under the control of the 35S promoter. 35S::G1322 transgenic plants were wild-type in phenotype with respect to the biochemical analyses performed. Overexpression of G1322 produced changes in overall plant size and leaf development. At all stages, 35S::G1322 plants were distinctly smaller than controls and developed curled dark-green leaves. Following the switch to flowering, the plants formed relatively thin inflorescence stems and had a rather poor seed yield. In addition, overexpression of G1322 resulted in plants with an altered etiolation response as well as enhanced tolerance to germination under chilling conditions. When germinated in the dark, G1322 overexpressing transgenic plant lines had open, slightly green cotyledons. Under chilling conditions, all three transgenic lines displayed a similar germination response, seedlings were slightly larger and had longer roots. In addition, an increase in the leaf glucosinolate M39480 was observed in all three T2 lines. According to RT-PCR analysis, G1322 was expressed primarily in flower tissue.

Potential Applications

The utilities of G1322 or its equivalogs include altering a plant's chilling sensitivity and altering a plant's light response. The germination of many crops is very sensitive to cold temperatures. A gene that will enhance germination and seedling vigor in the cold has tremendous utility in allowing seeds to be planted earlier in the season with a higher survival rate.

G1322 or its equivalogs can also be useful for altering leaf glucosinolate composition. Increases or decreases in specific glucosinolates or total glucosinolate content are desirable depending upon the particular application. Modification of glucosinolate composition or quantity can therefore afford increased protection from predators. Furthermore, in edible crops, tissue specific promoters can be used to ensure that these compounds accumulate specifically in tissues, such as the epidermis, which are not taken for consumption.

G1323 (SEQ ID NO: 259)

Published Information

Kranz et al. ((1998) *Plant J.* 16: 263-276) published a partial cDNA sequence corresponding to G1323, naming it MYB58. Reverse-Northern data indicates that this gene is expressed primarily in leaf tissue.

Experimental Observations

The complete sequence of G1323 was determined. As determined by RT-PCR, G1323 was highly expressed in embryos, and was expressed at significantly lower levels in the other tissues tested. G1323 expression was not induced by any stress-related treatments. The function of this gene was analyzed using transgenic plants in which G1323 was expressed under the control of the 35S promoter. Primary transformants of G1323 were uniformly small and dark green, and a few were late flowering. According to the biochemical analysis of G1323 overexpressors, two had higher seed protein. The higher seed protein and lower seed oil content was observed in a repeated experiment.

Potential Applications

G1323 or its equivalogs could be used to alter seed protein and oil amounts and/or composition, which is very important for the nutritional value and production of various food products.

G1330 (SEQ ID NO: 261)

Published Information

G1330 is a member of the R2-R3 subfamily of Myb transcription factors. Kranz et al. ((1998) *Plant J.* 16: 263-276) published a partial cDNA sequence corresponding to G1330, naming it MYB78. Expression of this gene was not detected by Reverse-Northern analysis in any tissue or under any environmental treatment tested.

Closely Related Genes from Other Species

G1330 is closely related to a family of novel myb-related genes (Cpm5, 7 and 10) from the resurrection plant *Craterostigma plantagineum* are specifically expressed in callus and roots in response to ABA or desiccation (Iturriaga et al. (1996) *Plant Mol. Biol.* 32: 707-716) as well as to myb genes from several other crop species. The most related gene to G1330 is a tomato gene represented by EST EST276215. Similarity between G1330 and the tomato gene extends beyond the signature motif of the family to a level that would suggest the genes are orthologous. Therefore the gene represented by EST 276215 and the cpm genes may have a function and/or utility similar to that of G1330.

Experimental Observations

The complete sequence of G1330 was determined. The function of this gene was analyzed using transgenic plants in which G1330 was expressed under the control of the 35S promoter. Overexpression of G1330 produced changes in plant growth and development. 35S::G1330 primary transformants were consistently small with abnormal phyllotaxy, and often developed spindly inflorescences that yielded few seeds. These effects were also observed in the T2 generation; all three lines appeared markedly small at the seedling stage and often did not survive the transfer from agar plates to soil. High anthocyanin levels were also noted in the T2 (and T3) seedlings of one line. At later stages, T2 plants appeared spindly and had very poor seed yield. Kanamycin segregation data were consistent with 35S::G1330 having deleterious effects; all three lines had a deficit of resistant plants, indicating that the transgene might be lethal above a certain threshold dosage.

Plants from G1330 overexpressing lines showed an ethylene insensitive phenotype when germinated in the dark on media containing ACC. Seedlings from the three lines tested lacked components of the triple response including the apical hook and to some degree, stunting of the hypocotyl. In addition, plants from the three overexpressing lines had open cotyledons in the dark, which indicated this gene is involved in a light dependent response, As determined by RT-PCR, G1330 was highly expressed in roots, and was expressed at significantly lower levels in flowers, embryos and seedlings. No expression of G1330 was detected shoots, rosette leaves or siliques. G1330 expression was repressed in rosette leaves by cold, and osmotic stress treatments and by infection with the phytopathogen *Erysiphe orontii*.

Potential Applications

Because anti-oxidants such as tocopherols and carotenoids are reported to have anti-cancer and other nutritional properties, G1330 or its equivalogs could be used to manipulate the nutritional qualities of plants.

G1330 or its equivalogs could be used to alter how plants respond to ethylene. For example, it could be used to manipulate fruit ripening.

G1331 (SEQ ID NO: 263)

Published Information

G1331 is a member of the (R1)R2R3 subfamily of myb transcription factors. G1331 corresponds to Myb79, a gene identified by Kranz et al. ((1998) *Plant J.* 16: 263-276). The authors used a reverse-Northern blot technique to study the expression of this gene in a variety of tissues and under a variety of environmental conditions. Kranz et al were unable to detect the expression of G1331 in any tissue or treatments tested (supra).

Closely Related Genes from Other Species

G1331 shows sequence similarity with a protein from alfalfa (BF644787).

Experimental Observations

The function of G1331 was analyzed using transgenic plants in which the gene was expressed under the control of the 35S promoter. Overexpression of G1331 in *Arabidopsis* did not result in any biochemical phenotypic alteration. However, G1331 overexpression produced highly pleiotropic developmental effects including; changes in leaf morphology, anthocyanin accumulation, inflorescence abnormalities, and a reduction in overall plant size. In addition, overexpression of G1331 also resulted in seedlings with an altered response to light. In a germination assay conducted in darkness, G1331 seedlings showed opened cotyledons in all three lines.

G1331 was expressed at low levels in shoots, roots, rosette leaves, and siliques. G1331 was induced by heat and SA.

Potential Applications

G1331 modifies light response and thus this gene or its equivalogs may be useful for modifying plant growth or development, for example, photomorphogenesis in poor light, or accelerating flowering time in response to various light intensities, quality or duration to which a non-transformed plant would not similarly respond. Elimination of shading responses may allow increased planting densities with subsequent yield enhancement.

G1332 (SEQ ID NO: 265)

Published Information

G1332 is a member of the (R1)R2R3 subfamily of myb transcription factors. G1332 corresponds to the gene MYB82 (Kranz et al. (1998) *Plant J.* 16: 263-276).

Experimental Observations

The function of G1332 was analyzed using transgenic plants in which the gene was expressed under the control of the 35S promoter. Overexpression of G1332 produced a reduction in trichome density on leaf surfaces and inflorescence stems in *Arabidopsis*. No other phenotypic alterations were observed in the G1332 overexpressors.

G1332 was expressed ubiquitously and may have been repressed by *Erysiphe* infection.

Potential Applications

The potential utility of this gene or its equivalogs is to alter trichome initiation and number in a plant. It would be of great agronomic value to have plants that produce greater numbers of glandular trichomes that produce valuable essential oils for the pharmaceutical and food industries, as well as oils that protect plants against insect and pathogen attack.

G1363 (SEQ ID NO: 267)

Published Information

G1363 was identified based on its similarity to other members of the Hap2-like CCAAT-box binding factors. The gene was found in the sequence of BAC MDC16, GenBank accession number AB019229, released by the *Arabidopsis* Genome Initiative.

Experimental Observations

The complete sequence of G1363 was determined. The function of this gene was then analyzed using transgenic plants in which G1363 was expressed under the control of the 35S promoter. Transformants were morphologically indistinguishable from wild-type plants. Biochemical analysis of one line indicated the seeds had higher 16:0 in fatty acid content. In addition, plants overexpressing G1363 showed fewer disease symptoms following infection with the necrotrophic fungal pathogen *Fusarium oxysporum* compared to control plants. The experiment was repeated on individual lines, and all three lines showed the phenotype. Wild-type control plants were smaller in the repeat experiment, which could affect the disease severity of these plants and accentuate the degree of tolerance in the overexpressors.

RT-PCR analyses of the endogenous levels of G1363 indicated that this gene was expressed in all tissues and under all conditions tested.

Potential Applications

Since G1363 activity has been shown to affect the response of transgenic plants to the fungal pathogen *Fusarium oxysporum*, G1363 or its equivalogs could be used to manipulate the defense response in order to generate pathogen-resistant plants.

G1411 (SEQ ID NO: 269)

Published Information

G1411 was identified in the sequence of TAC clone K22G18 (GenBank accession number AB022212).

Experimental Observations

The complete sequence of G1411 was determined. The function of G1411 was analyzed using transgenic plants in which this gene was expressed under the control of the 35S promoter. G1411 overexpressing plants were smaller than wild-type controls and showed reduced apical dominance: axillary shoots develop prematurely amongst primary rosette leaves, resulting in a bushy plant. G1411 overexpressing plants behaved like the corresponding wild-type controls in all physiological and biochemical assays that were performed.

Potential Applications

G1411 or its equivalogs could be used to manipulate plant architecture.

G1417 (SEQ ID NO: 271)

Published Information

G1417 corresponds to gene AT4g01720 (CAB77742).

Closely Related Genes from Other Species

G1417 shows sequence similarity, outside of the conserved WRKY domain, with a rice protein (gi8467950).

Experimental Observations

The function of G1417 was studied using a line homozygous for a T-DNA insertion in the gene. The T-DNA insertion lies immediately upstream of the conserved WRKY domain coding sequence, and was expected to result in a null mutation. G1417 knockout mutant plants showed reduced seedling vigor during germination. The G1417 knockout showed alterations in seed fatty acid composition. An increase in 18:2 fatty acid and a decrease in 18:3 fatty acid were observed in two seed batches.

G1417 was ubiquitously expressed and did not appear to be significantly induced by any of the conditions tested.

Potential Applications

G1417 or its equivalogs could be useful to manipulate the saturation levels of lipids in seeds. Alteration in seed lipid saturation could be used to improve the heat stability of oils or to improve the nutritional quality of seed oil.

G1419 (SEQ ID NO: 273)

Published Information

G1419 was identified in the sequence of P1 clone MWD22; it corresponds to gene MWD22.13 (GenBank PID BAA97381).

Closely Related Genes from Other Species

G1419 is most closely related to some non-*Arabidopsis* AP2/EREBP proteins that have been suggested to be involved in the ethylene response, like tobacco EREBP-4.

Experimental Observations

To investigate the function(s) of G1419, this gene was expressed under the control of the 35S promoter in transgenic plants. G1419 overexpressing plants were essentially indistinguishable from wild-type controls in all assays performed. Two T2 lines showed altered biochemical phenotypes that were different in each one of them: One line had higher 16:0 when assayed for seed frames, and another line had higher seed protein.

G1419 appeared to be ubiquitously expressed.

Potential Applications

G1419 or its equivalogs could be used to increase seed protein, which is very important for the nutritional value and production of various food products.

G1449 (SEQ ID NO: 275)

Published Information

G1449 is annotated in the sequence of genomic clone MKP6, GenBank accession number AB022219, released by the *Arabidopsis* Genome Initiative.

Experimental Observations

A cDNA clone corresponding to G1449 was isolated from an embryo cDNA library. It was later identified in the sequence of genomic clone MKP6, GenBank accession number AB022219, released by the *Arabidopsis* Genome Initiative.

G1449 was expressed at high levels in embryos and siliques, and at significantly lower levels in roots and seedlings. It was induced by auxin in leaf tissue. Plants overexpressing G1449 showed floral abnormalities. Primary transformants showed changes in floral organ number and identity. Large petals were noted in one plant. Affected lines were also somewhat smaller than controls. These plants produced little seed and it was necessary to bulk seed for analysis. One T3 line produced flowers that were somewhat larger than control flowers with petals that were more open. These flowers often had extra petals. G1449 mutant plants did not show any other phenotypic alterations in any of the physiological or biochemical assays performed.

Potential Applications

Because larger and more open petals are produced in some G1449 overexpressing plants, G1449 or its equivalogs may be useful for modifying flower form and size in ornamental plants. The promoter of G1449 may also be useful to drive gene expression in seeds and seed pods or fruits.

G1451 (SEQ ID NO: 277)

Published Information

G1451 is ARF8, a member of the ARF class of proteins with a VP1-like N-terminal domain and a C-terminal domain with homology to Aux/IAA proteins. ARF8, like several other ARFs, contains a glutamine-rich central domain that can function as a transcriptional activation domain (1). ARF8 was shown to bind to an auxin response element (2). It was also shown that a truncated version of ARF8 lacking the DNA binding domain but containing the activation domain and the C-terminal domain could activate transcription on an auxin responsive promoter, presumably through interactions with another factor bound to the auxin response element (1). ARF8 is closely related in sequence to ARF6 (2).

Experimental Observations

G1451 was expressed throughout the plant, with the highest expression in flowers. Transcripts of G1451 were induced in leaves by a variety of stress conditions. A line homozygous for a T-DNA insertion in G1451 was used to determine the function of this gene. The T-DNA insertion of G1451 is approximately one-fifth of the way into the coding sequence of the gene and therefore is likely to result in a null mutation.

As measured by NIR, G1451 knockout mutants had increased total combined seed oil and seed protein content compared to wild-type plants.

Potential Applications

G1451 or its equivalogs may be used to alter seed oil and protein content, which may be very important for the nutritional value and production of various food products G1451 or its equivalogs could also be used to increase plant biomass. Large size is useful in crops where the vegetative portion of the plant is the marketable portion since vegetative growth often stops when plants make the transition to flowering.

G1452 (SEQ ID NO: 279)

Published Information

G1452 was identified in the sequence of clones T22O13, F12K2 with accession number AC006233 released by the *Arabidopsis* Genome Initiative.

Experimental Observations

The function of G1452 was analyzed using transgenic plants in which the gene was expressed under the control of the 35S promoter. Overexpression of G1452 produced changes in leaf development and markedly delayed the onset of flowering. 35S::G1452 plants produced dark green, flat, rounded leaves, and typically formed flower buds between 2 and 14 days later than controls. Additionally, some of the transformants were noted to have rather low trichome density on leaves and stems. At later stages of life cycle, 35S::G1452 appeared to develop slowly and senesced considerably later than wild-type controls. In addition, G1452 overexpressors were more tolerant to osmotic stress, and were insensitive to ABA in separate germination assays.

G1452 expression was not detected in any tissue tested by RT-PCR and was not induced by any environmental stress-related condition tested.

Potential Applications

On the basis of the analyses performed to date, G1452 or its equivalogs could be use to alter plant growth and development.

In addition, G1452 or its equivalogs could be used to alter a plant's response to water deficit conditions and therefore, could be used to engineer plants with enhanced tolerance to drought and salt stress.

G1463 (SEQ ID NO: 281)

Published Information

G1463 was identified in the sequence of BAC T13D8 with accession number AC004473 released by the *Arabidopsis* Genome Initiative.

Experimental Observations

The function of G1463 was analyzed using transgenic plants in which the gene was expressed under the control of the 35S promoter. In later stage plants, overexpression of G1463 resulted in premature senescence of rosette leaves. Under continuous light conditions, the most severely affected plants started to senesce approximately 10 days earlier than wild-type controls, at around 30 days after sowing. Additionally, 35S::G1463 plants formed slightly thin inflorescence stems and showed a relatively low seed yield. However, it is possible that such features directly resulted from the loss of photosynthetic capacity caused by premature senescence. 35S::G1463 transgenic plants were wild-type in phenotype with respect to the physiological and biochemical analyses performed.

G1463 expression could not be detected in any tissue or in response to environmental stress-related conditions tested using RT-PCR.

Potential Applications

On the basis of the analyses performed to date, the potential utilities of G1463 or its equivalogs could be used to manipulate senescence in plant tissues. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. Delayed flower senescence may also generate plants that retain their blossoms longer and this may be of potential interest to the ornamental horticulture industry.

G1471 (SEQ ID NO: 283)

Published Information

G1471 was identified in the sequence of P1 clone MDK4, GenBank accession number AB010695, released by the *Arabidopsis* Genome Initiative.

Experimental Observations

The function of this gene was analyzed using transgenic plants in which G1471 was expressed under the control of the 35S promoter. All 35S::G1471 primary transformants were markedly small, had narrow curled leaves and formed thin inflorescence stems. Flowers from many T1 plants were extremely poorly developed, and often had organs missing, reduced in size, or highly contorted. Due to such defects, the fertility was very low, and approximately one third of the lines were tiny and completely sterile. Plants from one T2 generation line displayed wild-type morphology, indicating that the transgene might have become silenced. Two lines, however, were small, had narrow curled leaves and flowered marginally earlier than controls. The phenotype of these transgenic plants was wild-type in all other assays performed. G1471 appeared to be expressed at medium levels in siliques and embryos.

G1471 overexpressing plants were found to have increased seed oil content compared to wild-type plants.

Potential Applications

G1471 or equivalog overexpression may be used to increase seed oil content in plants.

Because expression of G1471 is embryo and silique specific, its promoter could be useful for targeted gene expression in these tissues.

G1478 (SEQ ID NO: 285)

Published Information

G1478 was identified as a gene in the sequence of BAC Z97338, released by the *Arabidopsis* Genome Initiative.

Closely Related Genes from Other Species

G1478 shows some homology to non-*Arabidopsis* proteins within the conserved domain.

Experimental Observations

The sequence of G1478 (SEQ ID NO: 285) was determined and G1478 was analyzed using transgenic plants in which G1478 was expressed under the control of the 35S promoter. Plants overexpressing G1478 had a general delay in progression through the life cycle, in particular a delay in flowering time. Plants overexpressing G1478 also showed a increase in seed oil and an decrease in seed protein.

G1478 was expressed at higher levels in flowers, rosettes and embryos but otherwise expression was constitutive.

Potential Applications

G1478 or its equivalogs can be used to manipulate the rate at which plants grow, and flowering time.

G1478 can also be used to manipulate seed oil and protein, which can be very important from a nutritional standpoint.

G1482 (SEQ ID NO: 287)

Published Information

G1482 was identified as a gene in the sequence of BAC AC006434, released by the *Arabidopsis* Genome Initiative.

Experimental Observations

The sequence of G1482 was experimentally determined. The data presented for this gene are from plants homozygous for a T-DNA insertion in G1482. The T-DNA insertion of G1482 is in coding sequence and therefore this knockout mutant is likely to contain a null allele. Homozygous plants harboring a T-DNA insertion in G1482 displayed significantly more root growth on MS control plates as well as on different stresses in three separate experiments. G1482 was constitutively expressed and significantly induced by auxin, ABA and osmotic stress.

The function of G1482 was studied using transgenic plants in which the gene was expressed under the control of the 35S promoter. Plants overexpressing G1482 contained high levels of anthocyanins.

Potential Applications

Based on the phenotypes produced when this gene is knocked out, G1482 or its equivalogs could be used to manipulate root growth, particularly in response to environmental stresses such as drought and low nutrients.

G1482 or its equivalogs could also be used to alter anthocyanin production. The potential utilities of this gene includes alterations in pigment production for horticultural purposes, and possibly increasing stress resistance in combination with another transcription factor. Flavonoids have antimicrobial activity and could be used to engineer pathogen resistance. Several flavonoid compounds have health promoting effects such as the inhibition of tumor growth and cancer, prevention of bone loss and the prevention of the oxidation of lipids. Increasing levels of condensed tannins, whose biosynthetic pathway is shared with anthocyanin biosynthesis, in forage legumes is an important agronomic trait because they prevent pasture bloat by collapsing protein foams within the rumen. For a review on the utilities of flavonoids and their derivatives, see Dixon et al. (1999) *Trends Plant Sci.* 10: 394-400.

G1488 (SEQ ID NO: 289)

Published Information

G1488 was identified as a gene in the sequence of BAC F18A17 (Accession Number AC005405), released by the Cold Spring Harbor Laboratory.

Experimental Observations

The function of G1488 was analyzed using transgenic plants in which G1488 was expressed under the control of the 35S promoter. Plants from two of the three 35S::G1488 T2 populations were rather small at early stages, formed slightly rounded leaves, and produced thin bushy inflorescence stems that were shorter than those of controls. This phenotype was verified when the populations were re-grown. However, in the second sowing, plants from both lines also flowered early. Overexpression of G1488 in *Arabidopsis* also resulted in seedlings with an altered response to light. In a germination assay conducted in darkness, G1488 seedlings showed opened cotyledons in all three lines.

G1488 was expressed in all tissues, although it was expressed at higher levels in embryonic tissue and siliques. G1488 was slightly induced in response to ABA treatment or heat stress.

G1488 overexpressors were found to have increased seed protein content compared to wild-type plants.

Potential Applications

G1488 modified light response and thus it or its equivalogs may be useful for modifying plant growth or development, for example, photomorphogenesis in poor light, or accelerating flowering time in response to various light intensities, quality or duration to which a non-transformed plant would not similarly respond. Elimination of shading responses may allow increased planting densities with subsequent yield enhancement.

G1488 or its equivalogs could also be used to manipulate plant architecture.

G1488 or its equivalogs might be used to engineer crops with earlier flowering times. Most modern crop varieties are the result of extensive breeding programs. Many generations of backcrossing may be required to introduce desired traits. Systems that accelerate flowering could have valuable applications in such programs since they allow much faster generation times. Additionally, in some instances, a faster generation time might allow additional harvests of a crop to be made within a given growing season.

G1488 or equivalog overexpression may be used to alter seed protein content in plants

G1494 (SEQ ID NO: 291)

Published Information

The sequence of G1494 was obtained from *Arabidopsis* genomic sequencing project, GenBank accession number AC006224, based on its sequence similarity within the conserved domain to other bHLH related proteins in *Arabidopsis*.

Experimental Observations

The complete sequence of G1494 was determined. G1494 was expressed in all tissues tested except in roots.

The function of this gene was analyzed using transgenic plants in which G1494 was expressed under the control of the 35S promoter. Overexpression of G1494 produced pleiotropic effects similar to those caused by shade avoidance responses or deficiencies in light regulated development. In particular, the 35S::G1494 phenotype was very similar to that described for plants mutant in multiple different phytochrome genes (Devlin et al. (1999) *Plant Physiol.* 119: 909-916), indicating that G1494 might have a role regulating or responding to light perception. Following germination, 35S::G1494 seedlings formed very long hypocotyls and displayed elongated cotyledon petioles. Rosette leaves were generally very pale, narrow, upward pointing, and had long petioles. Such effects were observed in either 12-hour or 24-hour photoperiodic conditions, and in both cases, the plants switched to flowering much earlier than wild-type controls. In 24-hour light, 35S::G1494 plants formed flower buds after making 2-4 leaves (wild type typically made 12-14 leaves), whereas in 12-hour conditions 4-7 leaves were formed (wild type typically made 25-30 leaves). In addition to this, in 35S::G1494 plants, internodes between rosette leaves extended, making a defined rosette difficult to discern. It should be noted that the inflorescences produced by these plants were uniformly extremely thin and spindly and generated very few siliques.

Additionally, the seeds from one of these T2 populations were consistently large and pale compared to controls.

The morphological alterations in the 35S::G1494 plants were somewhat similar to those in the 35S::G2144 plants.

Alterations in leaf prenyl composition were consistently detected in the three 35S::G1494 lines analyzed, which could be predicted because of the morphological phenotype of 35S::G1494 overexpressors.

Potential Applications

G1494 or its equivalogs could be used to alter how plants respond to light. For example, it could be used to manipulate plant appearance, growth and development, and flowering time.

G1496 (SEQ ID NO: 293)

Published Information

The genomic sequence of G1496 has been determined as part of the *Arabidopsis* Genome Initiative (BAC clone T30D6, GenBank accession number AC006439).

Experimental Observations

As determined by RT-PCR, G1496 was highly expressed in rosette leaves and germinating seeds. Expression of G1496 was not induced by any stress-related treatment tested. The function of G1496 was analyzed using transgenic plants in which G1496 was expressed under the control of the 35S promoter.

*Arabidopsis* plants overexpressing G1496 produce more seed oil than wild-type plants.

Potential Applications

Based on the current analysis of G1496 or equivalog overexpressing plants, potential utilities for G1496 are to increase oil contents in crop plants.

G1499 (SEQ ID NO: 295)

Published Information

The sequence of G1499 was obtained from the *Arabidopsis* genome sequencing project, GenBank accession number AB020752, based on its sequence similarity within the conserved domain to other bHLH related proteins in *Arabidopsis*.

Closely Related Genes from Other Species

The similarity between G1499 and *Brassica rapa* subsp. *pekinensis* flower bud cDNA (acc#AT002234) is significant not only in the conserved bHLH domains but also outside of the domains.

Experimental Observations

The function of G1499 was analyzed using transgenic plants in which G1499 was expressed under the control of the 35S promoter. A range of phenotypes was observed in primary transformants of G1499. The most severely affected plants were smaller than controls, dark green, with strongly curled leaves, and produced bolts that terminated without an inflorescence. In some cases, flowers were replaced with filamentous structures or carpelloid structures. Less severely affected lines produced flowers where sepals were converted to carpelloid tissue. Petals and stamens were absent or reduced in size and number. Mildly affected T1 plants that were small in size but produced normal flowers were taken to the T2 generation. Three T2 lines produced plants that were smaller than controls, darker green, and had narrower leaves.

G1499 overexpressors were similar to their wild-type counterparts in all physiological and biochemical assays.

G1499 was predominantly expressed in the reproductive tissues such as flower, embryo and silique. Lower levels of expression were also detected in roots and germinating seeds. It's expression level was unaffected by any of the environmental conditions tested.

Phenotypes produced by overexpressing G1499 and G779 were similar in the aspects of flower structures. Cluster analysis using basic helix-loop-helix motif revealed that both proteins of G1499 and G779 are closely related.

Potential Applications

G1499 or its equivalogs could be used to modify plant architecture and development, including flower structure. If expressed under a flower-specific promoter, it might also be useful for engineering male sterility. Because expression of G1499 is flower and embryo specific, its promoter could be useful for targeted gene expression in these tissues.

Potential utilities of this gene or its equivalogs also include increasing chlorophyll content, allowing more growth and productivity in conditions of low light. With a potentially higher photosynthetic rate, fruits could have higher sugar content. Increased carotenoid content could be used as a nutraceutical to produce foods with greater antioxidant capability.

G1519 (SEQ ID NO: 297)

Published Information

G1519 corresponds to PEX10, which encodes a peroxisome assembly protein (Schumann et al. (1999) *Plant Physiol.* 119: 1147.

Closely Related Genes from Other Species

G1519 has a homolog in tomatoes (Accession # BE436-498).

Experimental Observations

The function of G1519 was analyzed by knockout analysis. Plants heterozygous for a knockout mutation in G1519 segregate 3 viable:1 inviable seeds in the silique. Homozygous G1519 knockout plants could not be obtained, due to the embryo lethality of the mutation, so no physiology or biochemistry assays could be done. G1519 is an essential gene that is necessary for embryo development.

Potential Applications

Because a knockout mutation in G1519 results in embryo lethality, the gene or its equivalogs are potentially useful as herbicide targets.

G1526 (SEQ ID NO: 299)

Published Information

The transcription regulator G1526 was identified by amino acid sequence similarity to proteins of the SWI/SNF family of chromatin remodeling factors. G1526 is found in the sequence of the chromosome 5 P1 clone MDJ22 (GenBank AB006699.1 GI:2351064), released by the *Arabidopsis* Genome Initiative. The translational stop codon was incorrectly predicted.

Experimental Observations

RT-PCR analysis of the endogenous level of G1526 transcripts reveals that G1526 was expressed constitutively in all *Arabidopsis* tissues, except in germinating seeds where no G1526 is detectable. The G1526 null mutant had higher seed oil content.

Potential Applications

G1526 or its equivalogs may be used to increase seed oil in plant seed, which might be used to increase seed oil yield, and increase the caloric content of food for humans and animal feeds.

G1540 (SEQ ID NO: 301)

Published Information

G1540 is the *Arabidopsis* WUSCHEL (WUS) gene and encodes a novel subclass of homeodomain protein (Mayer et al. (1998) *Cell* 95:805-815).

WUS is a key developmental protein that has a core role in regulating the fate of stem cells within *Arabidopsis* apical meristems. The central zone of an apical meristem contains a pool of undifferentiated pluripotent stems cells. These stem cells are able to both maintain themselves and supply cells for incorporation into new organs on the periphery of the meristem (shoot meristems initiate leaves whereas flower meristems initiate whorls of floral organs).

Defects are visible in the shoots and flowers of wus mutants (Laux et al. (1996) *Development* 122: 87-96; Endrizzi et al. (1996) *Plant J.* 10:967-979). Wus mutants fail to properly organize a shoot meristem in the developing embryo. Postembryonically, wus shoot meristems become flattened and terminate growth prematurely. Leaf primordia and secondary shoots often initiate ectopically across the surface of these terminated structures. The leaf primordia usually develop into a disorganized bunch and a secondary shoot meristem takes over growth. This secondary meristem then terminates and the developmental pattern is repeated, leading to a plant with no clear main axis of growth and clusters of leaves at the tips of shoots. Wus floral meristems exhibit a comparable phenotype to the shoot meristem; development often ceases prematurely such that flowers either lack the innermost whorls of organs, or possess a single stamen in place of the inner whorls.

The mutant phenotype indicates that wus is required to maintain the identity of the central zone within apical meristems and prevent those cells from becoming differentiated. In situ expression patterns of WUS RNA support such a conclusion; WUS is first observed in the embryonic shoot meristem at the 16-cell stage. Later, expression becomes confined to small groups of cells (in shoot and floral meristems) at the base of the central zone where it specifies the fate of overlying cells as stem cells. WUS is thought to be expressed, and act, independently of another homeobox gene, SHOOT MERISTEMLESS (STM), G431, which has a related function (Long et al. (1996) Development 125:3027-3035). STM is initially required for the establishment of the shoot meristem during embryogenesis. Later STM is expressed throughout the whole meristem dome where, together with an antagonist, CLAVATA1, it regulates transition of cells from the central zone towards differentiation and organ formation at the meristem periphery (Clarke et al. (1996) *Development* 122: 1565-1575; Endrizzi et al. (1996) *Plant J.* 10:967-979). A current hypothesis is that WUS specifies the identity of central stem cells whereas STM allows the progeny of those cells to proliferate before being partitioned into organ primordia (Mayer et al. (1998) *Cell* 95:805-815).

The effects of WUS over-expression have not yet been published. However, based on the present model for WUS function, its ectopic expression might be expected to induce formation of ectopic meristematic stem cells.

Experimental Observations

Over-expressers for G1540 (WUSCHEL) formed callus-like structures on leaves, stems and floral organs. These observations correlate with the proposed role of WUS in specifying stem cell fate in meristems. In T1 over-expressers, cells took on characteristics of stem cells at inappropriate locations, indicating that WUS was sufficient to specify stem cell identity.

Potential Applications

The over-expression phenotype indicates that G1540 is sufficient to confer stem cell identity on plant cells, and thereby prevent them from differentiating. The gene or its equivalogs might be of utility in the maintenance of plant cell lines grown in vitro, where the differentiation of those lines creates difficulties. The gene or its equivalogs might also be applied to transformation systems for recalcitrant species, where generation of callus is currently problematic but is required as part of the transformation procedure.

G1543 (SEQ ID NO: 303)

Published Information

G1543 was identified as a novel homeobox gene within section 3 of 255 from the complete sequence of Chromosome II (GenBank accession number AC005560, released by the *Arabidopsis* Genome Initiative).

Closely Related Genes from Other Species

The G1543 protein is related to a number of HD-ZIP proteins from other species, including OSHOX3 (AAD37696) from rice, with which sequence identity extends beyond the conserved homeodomain.

Experimental Observations

The ends of G1543 were determined by RACE and a full-length cDNA was isolated by PCR from mixed cDNA. The encoded 275 amino acid product was found to be a member of the HD-ZIP class II group of HD proteins. The public annotation for this gene was incorrect; the protein predicted in the BAC report was only 162 amino acids in length.

RT-PCR analysis revealed that G1543 was expressed ubiquitously but was up-regulated in response to auxin applications.

The function of G1543 was analyzed using transgenic plants in which the gene was expressed under the control of the 35S promoter. 35S::G1543 *Arabidopsis* plants exhibited a range of phenotypes; most consistently, however, the plants possessed dark green leaves and an altered branching pattern that led to a shorter more compact stature. These morphological phenotypes, along with the expression data, implicate G1543 as a component of a growth or developmental response to auxin.

Biochemical assays reflected the changes in leaf color noted during morphological analysis. All three T2 lines examined displayed increased levels of leaf chlorophylls and carotenoids. Additionally, one of three lines had a decrease in seed oil combined with an increase in seed protein. A repeat experiment verified the altered seed oil and protein composition in two lines.

Physiological assays identified no clear differences between 35S::G1543 and wild-type plants.

Potential Applications

The altered levels of chlorophylls, carotenoids, seed oils, and proteins that resulted from overexpression of the gene in *Arabidopsis* indicate that G1543 or its equivalogs or its equivalogs might used to manipulate the composition of these substances in seed, with applications toward the improvement in the nutritional value of foodstuffs (for example, by increasing lutein).

Enhanced chlorophyll and carotenoid levels could also improve yield in crop plants. For instance lutein, like other xanthophylls such as zeaxanthin and violaxanthin, is an essential component in the protection of the plant against the damaging effects of excessive light. Specifically, lutein contributes, directly or indirectly, to the rapid rise of non-photochemical quenching in plants exposed to high light. Crop plants engineered to contain higher levels of lutein could therefore have improved photo-protection, possibly leading to less oxidative damage and better growth under high light. Additionally, elevated chlorophyll levels might increase photosynthetic capacity.

G1543 or its equivalogs might be applied to modify plant stature. This could be used to produce crops that are more resistant to damage by wind and rain, or more amenable to harvest. Plants with altered stature might also be of interest to the ornamental plant market.

This gene or its equivalogs may also be used to alter oil production in seeds, which may be very important for the nutritional quality and caloric content of foods

G1634 (SEQ ID NO: 305)

Published Information

G1634 was identified in the sequence of BAC MJJ3, GenBank accession number AB005237, released by the *Arabidopsis* Genome Initiative.

Experimental Observations

The complete sequence of G1634 was determined. cDNA microarray analyses of the endogenous levels of G1634 indicated that this gene was primarily expressed in root and silique tissues. In addition, G1634 expression was not altered significantly in response to any of the stress-related treatments tested. The function of this gene was analyzed using transgenic plants in which G1634 was expressed under the control of the 35S promoter. The phenotype of these transgenic plants was wild-type in all assays performed.

G1634 overexpressors were found to have altered seed protein content compared to wild-type plants.

Potential Applications

G1634 or its equivalogs could be used to alter seed protein amounts which is very important for the nutritional value and production of various food products.

G1637 (SEQ ID NO: 307)

Published Information

G1637 is a member of the myb-related subfamily of Myb transcription factors. G1637 was identified in BAC clone K11J9, accession number AB012239, release by the *Arabidopsis* sequencing project.

Closely Related Genes from Other Species

The most related gene to G1637 is a soybean gene represented by EST AW760127.

Experimental Observations

The complete sequence of G1637 was determined. The function of this gene was analyzed using transgenic plants in which G1637 was expressed under the control of the 35S promoter. The phenotype of these transgenic plants was wild-type in all assays performed.

RT-PCR analysis of the endogenous levels of G1637 indicated that this gene was expressed in all tissues and was induced by ABA, drought, and disease-related treatments.

G1637 overexpressors had increased seed oil and decreased seed protein content compared to wild-type plants.

Potential Applications

G1637 or equivalog overexpression may be used to alter seed protein content, which may be very important for the nutritional value and production of various food products

G1640 (SEQ ID NO: 309)

Published Information

G1640 was identified in the sequence of BAC K21P3, GenBank accession number AB016872, released by the *Arabidopsis* Genome Initiative.

Experimental Observations

The annotation of G1640 in BAC AB016872 was experimentally confirmed. The function of this gene was then analyzed using transgenic plants in which G1640 was expressed under the control of the 35S promoter. The transgenic plants were morphologically indistinguishable from wild-type plants. They were wild-type in all physiological assays performed. Biochemical analysis indicated that overexpression of G1640 in *Arabidopsis* results in an increase in seed oil content and a decrease in seed protein content.

As determined by RT-PCR, G1640 was expressed in leaves, flowers, embryos and siliques. No expression of G1640 was detected in the other tissues tested, nor was the gene induced in rosette leaves by any stress-related treatment.

Potential Applications

G1640 or its equivalogs could be used to decrease seed protein and increase seed oil amounts and/or composition which is very important for the nutritional value, caloric content and production of various food products.

G1645 (SEQ ID NO: 311)

Published Information

G1645 is a member of the (R1)R2R3 subfamily of MYB transcription factors. G1645 was identified in the sequence of BAC T24P13, GenBank accession number AC006535, released by the *Arabidopsis* Genome Initiative.

Closely Related Genes from Other Species

G1645 shows extensive sequence similarity to MYB proteins from other plant species including tomato (AW624217), and alfalfa (AQ917084).

Experimental Observations

The function of G1645 was analyzed using transgenic plants in which the gene was expressed under the control of the 35S promoter. Overexpression of G1645 produced marked changes in *Arabidopsis* leaf, flower and shoot development. These effects were observed, to varying extents, in the majority of 35S::G1645 primary transformants.

At early stages, many 35S::G1645 T1 lines appeared slightly small and most had rather rounded leaves. However, later, as the leaves expanded, in many cases they became misshapen and highly contorted. Furthermore, some of the lines grew slowly and bolted markedly later than control plants. Following the switch to flowering, 35S::G1645 inflorescences often showed aberrant growth patterns, and had a reduction in apical dominance. Additionally, the flowers were frequently abnormal and had organs missing, reduced in size, or contorted. Pollen production also appeared poor in some instances. Due to these deficiencies, the fertility of many of the 35S::G1645 lines was low and only small numbers of seeds were produced.

Overexpression of G1645 resulted in a low germination efficiency when germinated on the 32 C heat stress.

As determined by RT-PCR, G1645 was expressed in flowers, embryos, germinating seeds and siliques. No expression of G1645 was detected in the other tissues tested. G1645 expression appeared to be repressed in rosette leaves infected with the phytopathogen *Erysiphe orontii*.

Potential Applications

G1645 or its equivalogs could be used to alter inflorescence structure, which may have value in production of novel ornamental plants.

G1645 or equivalog activity could be used to alter a plant's response to heat stress.

G1646 (SEQ ID NO: 313)

Published Information

G1646 was identified in the BAC sequence with GenBank accession number AB007649, released by the *Arabidopsis* Genome Initiative.

Experimental Observations

The complete sequence of G1646 was determined. The function of this gene was analyzed using transgenic plants in which G1646 was expressed under the control of the 35S promoter. G1646 was constitutively expressed at medium levels in all tissues and environmental conditions tested.

As measured by NIR, G1646 overexpressors had altered seed oil content compared to wild-type plants.

Potential Applications

G1646 overexpression may be used to alter seed oil content, which may be very important for the nutritional value and production of various food products

G1652 (SEQ ID NO: 315)

Published Information

The sequence of G1652 was obtained from the *Arabidopsis* genomic sequencing project, GenBank accession number AC005617, based on its sequence similarity within the conserved domain to other bHLH related proteins in *Arabidopsis*.

Experimental Observations

The complete sequence of G1652 was determined. No expression of G1652 was detected in any of the untreated tissues tested. G1652 may be induced by cold treatment and *Fusarium* infection.

The function of this gene was analyzed using transgenic plants in which G1652 was expressed under the control of the 35S promoter. 35S::G1652 transformants were distinctly smaller and slower developing than wild-type controls, and formed rounded dark-green leaves, and short, thin, inflorescence stems. This phenotype was apparent in the majority of primary transformants and two of the three T2 lines. Small size was also noted in the physiological assays.

G1652 overexpressors had increased seed protein content compared to wild-type plants.

Potential Applications

G1652 or equivalog overexpression may be used to alter seed protein content, which may be very important for the nutritional value and production of various food products G1652 or its equivalogs may also be useful to regulate some aspect of plant growth and development.

G1672 (SEQ ID NO: 317)

Published Information

G1672 was first identified in the sequence of the P1 clone MIK19, GenBank accession number AB013392, released by the *Arabidopsis* Genome Initiative.

Closely Related Genes from Other Species

The most related gene to G1672 is a rice gene P0710E05.22 in accession BAA99435.

Experimental Observations

The full length sequence of G1672 was experimentally confirmed. The function of G1672 was analyzed using transgenic plants in which G1672 was expressed under the control of the 35S promoter.

RT-PCR analysis was used to determine the endogenous levels of G1672 in a variety of tissues and under a variety of environmental stress-related conditions. G1672 was primarily expressed at low levels in shoots, roots, flowers, embryos and siliques. No expression was detected in rosette leaves and germinated seedlings. G1672 did not show any induction under any of the different environmental conditions tested.

As measured by NIR, G1672 overexpressors had altered seed oil content compared to wild-type plants.

Potential Applications

G1672 or equivalog overexpression may be used to alter seed oil content, which may be very important for the nutritional value and production of various food products

G1677 (SEQ ID NO: 319)

Published Information

G1677 was identified in the sequence of P1 clone:MKM21, GenBank accession number AB016876, released by the *Arabidopsis* Genome Initiative.

Closely Related Genes from Other Species

G1677 shows extensive sequence similarity to a protein from rice (AP004114).

Experimental Observations

The function of G1677 was analyzed using transgenic plants in which the gene was expressed under the control of the 35S promoter. The phenotype of the 35S::G1677 transgenics was wild-type in morphology.

RT-PCR analysis of the endogenous levels of G1677 indicated that this gene was expressed in most tissues tested, although at very low levels. This gene was not induced in leaf tissue in response to any stress-related condition tested.

G1677 overexpressing plants were found to have decreased seed oil and increased seed protein content compared to wild-type plants.

Potential Applications

G1677 or equivalog overexpression may be used to alter oil and seed protein content in plants.

G1749 (SEQ ID NO: 321)

Published Information

G1749 corresponds to gene At2g20350 (AAD21753).

Experimental Observations

The function of G1749 was studied using transgenic plants in which the gene was expressed under the control of the 35S promoter.

Overexpression of G1749 induced chlorosis and death of large patches of tissue in the aerial part of the plant, indicating that it might be influencing programmed cell death, perhaps in pathways that are usually part of senescence or of the disease response. At early stages of development, 35S::G1749 seedlings appeared normal. However, towards the end of the rosette phase, these plants showed disorganized phyllotaxy and displayed rather broad flat leaves with short petioles. Randomly distributed yellow specks and patches of chlorotic tissue became visible at around this time; later these patches frequently developed into sizeable senesced regions covering large portions of the leaves. Additionally, similar effects were noted in the inflorescence, affecting cauline leaves, flower buds, and siliques. In severely affected plants, the entire inflorescence tips became brown and withered away without producing seeds. These effects were displayed by almost all of the T1 plants, and were visible in two independent batches of transformants, grown several months apart in separate locations.

Lines with the strongest phenotypes were completely infertile and senesced without setting seed. Three lines with a milder phenotype, which had produced some seed, were therefore selected for further analysis. All three T2 populations displayed the phenotypes to some extent, but these were weaker than were those shown by the majority of T1 plants.

G1749 was specifically expressed in flower and silique tissues, and was not ectopically induced by any of the conditions tested.

Potential Applications

G1749 or its equivalogs could be used to trigger cell death, and therefore to influence or control processes in which cell death plays a role. For example, if G1749 is an effective and rapid switch for cell death programs, it could be used to block pathogen infection by triggering it in infected cells and block spread of the disease.

G1749 or its equivalogs could also be used to either accelerate or slow senescence of different plant organs. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. Delayed flower senescence may also generate plants that retain their blossoms longer and this may be of potential interest to the ornamental horticulture industry.

G1750 (SEQ ID NO: 323)

Published Information

G1750 was identified in the sequence of BAC clone T13J8; it corresponds to gene At4g27950.

Experimental Observations

The function of G1750 was studied using transgenic plants in which the gene was expressed under the control of the 35S promoter. Overexpression of G1750 resulted in a significant increase in oil content in seeds, as measured by NIR. The increase in seed oil content was observed in two independent T2 lines, and was not accompanied by a substantial decrease in seed protein content. Otherwise, G1750 overexpressors behaved similarly to wild-type controls in all biochemical assays performed. No alterations were detected in the T2 35S::G1750 plants in the physiological analyses that were performed.

However, overexpression of G1750 caused alterations in plant growth and development. 35S::G1750 T1 plants showed a reduction in size, and approximately 50% were extremely tiny, infertile, and sometimes had premature leaf senescence. Seed was obtained from only the T1 plants with a weaker phenotype. Given the detrimental effects of G1750 overexpression, transgenics in which the gene is regulated by a tissue specific promoter, in particular a seed specific one, could be particularly useful to study the gene's functions and utilities.

G1750 was ubiquitously expressed. G1750 expression levels may have been altered by a variety of environmental or physiological conditions including SA.

Potential Applications

G1750 or its equivalogs could be used to increase seed oil content in crop plants.

G1756 (SEQ ID NO: 325)

Published Information

G1756 corresponds to gene AT4g23550 (CAB79310).

Closely Related Genes from Other Species

G1756 shows sequence similarity with known genes from other plant species within the conserved WRKY domain.

Experimental Observations

G1756 (SEQ ID NO:325) was studied using transgenic plants in which the gene was expressed under the control of the 35S promoter. Overexpression of G1756 caused alterations in plant growth and development, reducing overall plant size and fertility. In addition, 35S::G1756 overexpressing lines showed more disease symptoms following inoculation with a low dose of the fungal pathogen *Botrytis cinerea* compared to the wild-type controls. G1756 was ubiquitously expressed and transcript levels were altered by a variety of environmental or physiological conditions; G1756 expression can be induced by auxin, cold, and *Fusarium*.

Potential Applications

As G1756 is likely to be involved in the disease response, it or its equivalogs could be used to manipulate this response.

G1765 (SEQ ID NO: 327)

Published Information

G1765 was first identified in the sequence of the BAC clone F23E6, GenBank accession number AC006580, released by the *Arabidopsis* Genome Initiative.

Closely Related Genes from Other Species

A cDNA clone NF085A08EC from elicited cell culture of *Medicago truncatula* is closely related to G1765.

Experimental Observations

The full length sequence of G1765 was experimentally confirmed. The function of G1765 was analyzed using transgenic plants in which G1765 was expressed under the control of the 35S promoter. The phenotype of these transgenic plants was wild-type in all assays performed with the exception of biochemical assays. Alterations in the leaf cell wall polysaccharide composition were observed in plants that overexpress G1765. In one line, an increase in the percentage of rhamnose was detected. In another line, an increase in the percentage of mannose was detected. Otherwise, G1765 overexpressors behave similarly to wild-type controls in all biochemical assays performed.

RT-PCR analysis was used to determine the endogenous levels of G1765 in a variety of tissues and under a variety of environmental stress-related conditions. G1765 was primarily expressed at low levels in roots, flowers and rosette leaves. No expression was detected in shoots, embryos, siliques and germinated seedlings. RT-PCR data also indicated a moderate induction of G1765 transcripts accumulation upon auxin and *Fusarium* treatments.

As measured by NIR, G1765 overexpressors had altered seed oil content compared to wild-type plants.

Potential Applications

G1765 or its equivalogs overexpression may be used to alter seed oil content, which may be very important for the nutritional value and production of various food products

G1777 (SEQ ID NO: 329)

Published Information

G1777 was identified as a gene in the sequence of *Arabidopsis* chromosome II, section 93 using clone F7H1 (Accession Number AC007134), released by The Institute for Genomic Research.

Closely Related Genes from Other Species

G1777 shows some homology to non-*Arabidopsis* proteins within the conserved RING finger domain.

Experimental Observations

G1777 (SEQ ID NO: 329) was analyzed using transgenic plants in which G1777 was expressed under the control of the 35S promoter. Overexpression of G1777 in *Arabidopsis* resulted in an increase in seed oil content and a decrease in seed protein content in two T2 lines. G1777 was expressed in all examined tissue of *Arabidopsis*. G1777 was induced by auxin and ABA treatment, and by heat stress.

Potential Applications

G1777 or its equivalogs have utility in manipulating seed oil and protein content.

G1792 (SEQ ID NO: 331)

Published Information

G1792 was identified in the sequence of BAC clone K14B15 (AB025608, gene K14B15.14).

Closely Related Genes from Other Species

G1792 shows sequence similarity, outside the conserved AP2 domain, with a portion of a predicted protein from tomato, represented by EST sequence AI776626 (AI776626 EST257726 tomato resistant, Cornell *Lycopersicon esculentum* cDNA clone cLER19A14, mRNA sequence).

Experimental Observations

G1792 (SEQ ID NO: 331) was studied using transgenic plants in which the gene was expressed under the control of the 35S promoter. 35S::G1792 plants were more tolerant to the fungal pathogens *Fusarium oxysporum* and *Botrytis cinerea* and showed fewer symptoms after inoculation with a low dose of each pathogen. This result was confirmed using individual T2 lines. The effect of G1792 overexpression in increasing tolerance to pathogens received further, incidental confirmation. T2 plants of two 35S::G1792 lines had been growing in a room that suffered a serious powdery mildew infection. For each line, a pot of six plants was present in a flat containing nine other pots of lines from unrelated genes. In either of the two different flats, the only plants that were free from infection were those from the 35S::G1792 line. This observation suggested that G1792 overexpression might be used to increase resistance to powdery mildew. Additional experiments confirmed that 35S::G1792 plants showed increased tolerance to *Erysiphe*. G1792 was ubiquitously expressed, but appeared to be induced by salicylic acid.

35S::G1792 overexpressing plants also showed more tolerance to growth under nitrogen-limiting conditions. In a root growth assay under conditions of limiting N, 35S::G1792 lines were slightly less stunted. In a germination assay that monitored the effect of C on N signaling through anthocyanin production on high sucrose plus and minus glutamine the 35S::G1792 lines made less anthocyanin on high sucrose plus glutamine, suggesting that the gene can be involved in the plants ability to monitor their carbon and nitrogen status.

G1792 overexpressing plants showed several mild morphological alterations: leaves were dark green and shiny, and plants bolted, subsequently senesced, slightly later than wild-type controls. Among the T1 plants, additional morphological variation (not reproduced later in the T2 plants) was observed: many showed reductions in size as well as aberrations in leaf shape, phyllotaxy, and flower development.

Potential Applications

G1792 or its equivalogs can be used to engineer pathogen-resistant plants. In addition, it can also be used to improve seedling germination and performance under conditions of limited nitrogen.

Potential utilities of this gene or its equivalogs also include increasing chlorophyll content allowing more growth and productivity in conditions of low light. With a potentially higher photosynthetic rate, fruits could have higher sugar content. Increased carotenoid content could be used as a nutraceutical to produce foods with greater antioxidant capability.

G1792 or its equivalogs could be used to manipulate wax composition, amount, or distribution, which in turn could modify plant tolerance to drought and/or low humidity or resistance to insects, as well as plant appearance (shiny leaves). In particular, it would be interesting to see what the effect of increased wax deposition on leaves of a plant like cotton would do to drought resistance or water use efficiency. A possible application for this gene might be in reducing the wax coating on sunflower seeds (the wax fouls the oil extraction system during sunflower seed processing for oil). For this purpose, antisense or co-suppression of the gene in a tissue specific manner might be useful

G1793 (SEQ ID NO: 333)

Published Information

G1793 corresponds to gene MOE17.15 (BAB02492).

Experimental Observations

The function of G1793 was studied using transgenic plants in which the gene was expressed under the control of the 35S promoter. Overexpression of G1793 produced alterations in cotyledon morphology and a mild reduction in overall plant size. Eight 35S::G1793 primary transformants were obtained. Initially, these plants displayed abnormal long, elongated cotyledons. At later stages, the plants were all rather small, and in some cases slow growing, compared to controls. Inflorescences were often thin and, in 2/8 lines, carried flowers with many non-specific abnormalities, including changes in organ size and number, and poor pollen production. All T1 plants showed moderate levels of transgene expression (determined by RT-PCR).

G1793 overexpressors produced more seed oil than control plants.

G1793 expression was detected in a variety of tissues (root, flower, embryo, silique, and germinating seedling), and, except for heat stress, did not appear to be significantly induced by any of the conditions tested.

Potential Applications

G1793 or its equivalogs may be used to increase seed oil in plant seeds, which might be used to increase seed oil yield, and increase the caloric content of food for humans and animal feeds.

G1794 (SEQ ID NO: 335)

Published Information

G1794 corresponds to gene MVP7.8 (BAB10308.1).

Experimental Observations

The function of G1794 was studied using transgenic plants in which the gene was expressed under the control of the 35S promoter.

Overexpression of G1794 caused multiple alterations in plant growth and development, as well as in the plant's behavior in some of the physiological analyses that were performed.

35S::G1794 plants showed modified branching patterns, and a reduction in apical dominance, which resulted in them having a shorter, more bushy stature than wild type. Additionally, G1794 overexpression produced changes in hypocotyl development. The loss of apical dominance was noticeable at the switch to flowering, when large numbers of secondary shoots developed prematurely from axils of primary rosette leaves. In the most extreme cases, the shoots had very short internodes, giving the inflorescence a very bushy appearance. These shoots were often very thin and flowers were relatively small and poorly fertile. At later stages, many plants appeared very small and had a low seed yield compared to wild type. Similar effects on inflorescence development were noted in each of three T2 populations examined. Additionally, the T2 seedlings were noted to have long thick hypocotyls and a decrease in root length compared to controls.

Overexpression of G1794 in *Arabidopsis* resulted in an increase in leaf glucosinolate M39480 in three T2 lines.

In the physiological analyses, it was noted that 35S::G1794 T2 seedlings exhibited an altered hypocotyl structure, an altered light response phenotype, and an enhanced sensitivity to osmotic stress and nitrogen depletion. All G1794 overexpressing transgenic lines showed thick, bulbous hypocotyls in the seedling stage as well as partially de-etiolated phenotype, the seedling displaying open and slightly expanded cotyledons when grown in the dark. The enhanced sensitivity to osmotic stress was observed in all three G1794 transgenic lines following a root growth assay performed on high PEG containing media. Similarly, all three G1794 transgenic lines appear more sensitive to growth on nitrogen depleted media. However, in all cases the G1794 transgenic seedlings grew less vigorously than the wild-type controls and that could contribute to their enhanced sensitivity to stress in the root growth assays.

The branching and plant architecture phenotypes observed in 35S::G1794 lines resembled phenotypes observed for three other AP2/EREBP genes: G865, G1411, and G2509. These three genes form a small clade within the large AP2/EREBP family, and G1794, although not belonging to the clade, is one of the AP2/EREBP genes closest to it in the phylogenetic tree. It is thus possible that all these genes are related in function.

G1794 was ubiquitously expressed, and was induced by several stress conditions, in particular by osmotic stress.

Potential Applications

G1794 or its equivalogs could be used to manipulate plant architecture and development.

G1794 or its equivalogs could be used to alter a plant's response to water deficit conditions and therefore, could be used to engineer plants with enhanced tolerance to drought, salt stress, and freezing.

Overexpression of G1794 or its equivalogs may also induce changes in glucosinolate content.

G1794 modified light response and thus it or its equivalogs may be useful for modifying plant growth or development, for example, photomorphogenesis in poor light, or accelerating flowering time in response to various light intensities, quality or duration to which a non-transformed plant would not similarly respond. Elimination of shading responses may allow increased planting densities with subsequent yield enhancement.

G1804 (SEQ ID NO: 337)

Published Information

G1804 was identified in the sequence of BAC F9C22, GenBank accession number AC006921, released by the *Arabidopsis* Genome Initiative. During the course of its functional analysis, the G1804 sequence was published as the *Arabidopsis* ABI5 gene, which, when knocked out, causes pleiotropic effects on responses to the hormone abscisic acid (Finkelstein et al. (1990) *Plant Cell* 12: 599-609). In addition, G1804 was deposited in the NCBI database as DPBF1.

DPBF1 is an *Arabidopsis* embryo bZIP transcription factor that interacts with the late embryogenesis Dc3 gene promoter of sunflower (Kim et al: (1991) Unpublished deposit in the NCBI database).

ABI5 can be induced by ABA, drought and high salt stress in embryos (Lopez-Molina, et al (2001) *Proc. Natl. Acad. Sci. USA* 98: 4782-4787). Its overexpression causes ABA hypersensitivity and delayed germination (Lopez-Molina, et al (2001) *Proc. Natl. Acad. Sci. USA* 98: 4782-4787), and it is postulated but not shown that ABI5 could be used to engineer drought hardiness into seeds or plants.

Closely Related Genes from Other Species

G1804 is likely to be a homolog of the sunflower Dc3 promoter-binding factor-1 (DPBF-1; accession number AF001453) which also interacts with the Dc3 gene promoter of sunflower (Kim et al, 1991).

Experimental Observations

The boundaries of G1804 were experimentally determined and the function of G1804 was analyzed using transgenic plants in which this gene was expressed under the control of the 35S promoter. Plants overexpressing G1804 were later flowering and more sensitive to glucose in a germination assay. G1804 appeared to be preferentially expressed in embryos and flowers, and induced by auxin treatment. The expression pattern and annotation of G1804 correlated well with the information regarding DPB1 in the NCBI database and published information on ABI5.

Potential Applications

G1804 or its equivalogs may be used to modify sugar sensing and source-sink relationships in plants.

Manipulating the sugar signal transduction pathway may lead to altered gene expression to produce plants with desirable traits. In particular, manipulation of sugar signal transduction pathways could be used to alter source-sink relationships in seeds, tubers, roots and other storage organs leading to increase in yield.

G1804 or its equivalogs may also have a utility in modifying flowering time, and the promoter of G1804 may have some utility as an embryo specific promoter.

G1818 (SEQ ID NO: 339)

Published Information

G1818 is a member of the Hap5-like subfamily of CCAAT-box binding transcription factors. G1818 was identified in the sequence of P1 clone:MBA10, GenBank accession number AB025619, released by the *Arabidopsis* Genome Initiative.

Experimental Observations

The complete sequence of G1818 was determined. The function of this gene was analyzed using transgenic plants in which G1818 was expressed under the control of the 35S promoter. The phenotype of these transgenic plants was wild-type in all physiological assays performed. However, overexpression of G1818 delayed the timing of flowering and produced alterations in leaf shape. The leaves appeared to be flatter than wild-type leaves at all stages of development. In addition, G1818 overexpression resulted in higher seed protein content in two out of the three lines.

G1818 expression was detected in embryo, flower and silique tissue by RT-PCR. Expression of G1818 was also detected In leaf tissue following cold and auxin treatments. However, no cold related phenotypes were observed.

Potential Applications

G1818 or its equivalogs may be used to manipulate flowering time.

Additionally, a major concern is the escape of transgenic pollen from GMOs to wild species or so-called organic crops. Genes such as G1818 or its equivalogs that prevent vegetative transgenic crops from flowering would eliminate this worry.

G1818 or its equivalogs could also be used to increase seed protein amounts and/or alter seed protein composition, which could impact yield as well as the nutritional value and production of various food products. An increase in storage proteins is desirable for example in corn seeds to increase the nutritional value of the meal. Seed proteins play a central role in human and animal diets and represent a multibillion dollar market worldwide.

G1820 (SEQ ID NO: 341)

Published Information

G1820 is a member of the Hap5 subfamily of CCAAT-box-binding transcription factors. G1820 was identified as part of the BAC clone MBA10, accession number AB025619 released by the *Arabidopsis* Genome sequencing project.

Closely Related Genes from Other Species

G1820 is closely related to a soybean gene represented by EST335784 isolated from leaves infected with *Colletotrichum trifolii*. Similarity between G1820 and the soybean gene extends beyond the signature motif of the family to a level that would suggest the genes are orthologous. Therefore the gene represented by EST335784 may have a function and/or utility similar to that of G1820.

Experimental Observations

The complete sequence of G1820 was determined. The function of this gene was analyzed using transgenic plants in which G1820 was expressed under the control of the 35S promoter. G1820 overexpressing lines showed more tolerance to salt stress in a germination assay. They also showed insensitivity to ABA, with the three lines analyzed showing the phenotype. The salt and ABA phenotypes could be related to the plants increased tolerance to osmotic stress because in a severe water deprivation assay, G1820 overexpressors are, again, more tolerant.

Interestingly, overexpression of G1820 also consistently reduced the time to flowering. Under continuous light conditions at 20-25 C, the 35S::G1820 transformants displayed visible flower buds several days earlier than control plants. The primary shoots of these plants typically started flower initiation 1-4 leaf plastochrons sooner than those of wild type. Such effects were observed in all three T2 populations and in a substantial number of primary transformants.

When biochemical assays were performed, some changes in leaf frames were detected. In one line, an increase in the percentage of 18:3 and a decrease in 16:1 were observed. Otherwise, G1820 overexpressors behaved similarly to wild-type controls in all biochemical assays performed. As determined by RT-PCR, G1820 was highly expressed in embryos and siliques. No expression of G1820 was detected in the other tissues tested. G1820 expression appeared to be induced in rosette leaves by cold and drought stress treatments, and overexpressing lines showed tolerance to water deficit and high salt conditions.

One possible explanation for the complexity of the G1820 overexpression phenotype is that the gene is somehow involved in the cross talk between ABA and GA signal transduction pathways. It is well known that seed dormancy and germination are regulated by the plant hormones abscisic acid (ABA) and gibberellin (GA). These two hormones act antagonistically with each other. ABA induces seed dormancy in maturing embryos and inhibits germination of seeds. GA breaks seed dormancy and promotes germination. It is conceivable that the flowering time and ABA insensitive phenotypes observed in the G1820 overexpressors are related to an enhanced sensitivity to GA, or an increase in the level of GA, and that the phenotype of the overexpressors is unrelated to ABA. In *Arabidopsis*, GA is thought to be required to promote flowering in non-inductive photoperiods. However, the drought and salt tolerant phenotypes would indicate that ABA signal transduction is also perturbed in these plants. It seems counterintuitive for a plant with salt and drought tolerance to be ABA insensitive since ABA seems to activate signal transduction pathways involved in tolerance to salt and dehydration stresses. One explanation is that ABA levels in the G1820 overexpressors are also high but that the plant is unable to perceive or transduce the signal.

G1820 overexpressors also had decreased seed oil content and increased seed protein content compared to wild-type plants Potential Applications G1820 affects ABA sensitivity, and thus when transformed into a plant this transcription factor or its equivalogs may diminish cold, drought, oxidative and other stress sensitivities, and also be used to alter plant architecture, and yield.

The osmotic stress results indicate that G1820 or its equivalogs could be used to alter a plant's response to water deficit conditions and can be used to engineer plants with enhanced tolerance to drought, salt stress, and freezing. Evaporation from the soil surface causes upward water movement and salt accumulation in the upper soil layer where the seeds are placed. Thus, germination normally takes place at a salt concentration much higher than the mean salt concentration of in the whole soil profile. Increased salt tolerance during the germination stage of a crop plant would impact survivability and yield.

G1820 or its equivalogs could also be used to accelerate flowering time.

G1820 or its equivalogs may be used to modify levels of saturation in oils.

G1820 or its equivalogs may be used to seed protein content.

The promoter of G1820 could be used to drive seed-specific gene expression.

Potential Applications

G1820 or equivalog overexpression may be used to alter seed protein content, which may be very important for the nutritional value and production of various food products

G1836 (SEQ ID NO: 343)

Published Information

G1836 was identified in the sequence of BAC F14123, GenBank accession number AC007399, released by the *Arabidopsis* Genome Initiative.

Experimental Observations

The complete sequence of G1836 was determined. The function of this gene was analyzed using transgenic plants in which G1836 was expressed under the control of the 35S promoter. Morphologically, the plants were somewhat more pale than the wild-type controls. This observation did not translate into a detectable difference in the chlorophyll a or chlorophyll b content in these transgenics (see biochemistry data). Overexpression of G1836 affected the plants' ability to tolerate high concentrations of salt in a germination assay. All of the lines showed greater expansion of the cotyledons when seeds are germinated on MS media containing high concentrations of NaCl, indicating they had more tolerance to salt stress compared to the wild-type controls. There was no enhanced tolerance to high salt in older seedlings in a root growth assay. This was not unexpected because salt tolerance in the two developmental stages in often uncoupled in nature indicating mechanistic differences.

G1836 overexpression also resulted in plants that were more drought tolerant than wild-type control plants.

Expression of G1836 was also repressed by *Erysiphe orontii* infection.

Potential Applications

G1836 or its equivalogs could be used to increase plant tolerance to drought tolerance and soil salinity during germination, or at the seedling stage.

G1838 (SEQ ID NO: 345)

Published Information

G1838 corresponds to gene K21L13.1 (BAA98170).

Experimental Observations

The function of G1838 was studied using transgenic plants in which the gene was expressed under the control of the 35S promoter. Overexpression of G1838 caused alterations in plant growth and development: 35S::G1838 plants were smaller than wild type, often possessed curled, darker green leaves, and showed reduced fertility. 35S::G1838 primary transformants frequently displayed seedling abnormalities such as elongated cotyledons. Later, many of the lines were small, grew slowly and formed highly abnormal leaves. These structures were often narrow, darker green, contorted, or had strange horn like growths on their surfaces. Inflorescences were typically short, poorly developed, and carried infertile flowers that had small, contorted, or missing organs. Due to these deficiencies, the many of T1 plants formed very few seeds. Three lines that showed a relatively weak phenotype were selected for further study. Plants overexpressing G1838 were found to produce more seed oil than wild-type plants.

G1838 was ubiquitously expressed, and did not appear to be significantly induced by any of the conditions tested.

G1838 belongs to the AP2 subfamily of the AP2/EREBP family. It was hypothesized that genes of this subfamily would be involved in plant developmental processes (Riechmann et al. (1998) *Biol. Chem.* 379:633-646) which could thus explain the pleiotropic nature of the phenotypes observed in 35S::G1838 plants.

Potential Applications

G1838 or its equivalogs may be used for increasing seed oil production in plants, which would be of nutritional value for food for human consumption as well as animal feeds.

G1841 (SEQ ID NO: 347)

Published Information

G1841 corresponds to gene MPF21.9 (BAB10294). No information is available about the function(s) of G1841.

Experimental Observations

The function of G1841 was studied using transgenic plants in which the gene was expressed under the control of the 35S promoter.

Most significantly, overexpression of G1841 markedly reduced the time to flowering. This early flowering phenotype was consistently observed over multiple plantings for each of the three T2 lines, and in a majority of primary transformants. 35S::G1841 plants appeared slightly pale and had rather flat leaves compared to wild-type controls, but no other obvious morphological alterations. In continuous light conditions, 35S::G1841 plants produced flower buds up to five days earlier than wild-type controls. Interestingly, in repeat sowings, the plants actually appeared to grow slightly faster than controls: although they switched to making flower buds several days early, they had a similar number of primary rosette leaves to wild type.

In addition to showing accelerated flowering under 24 hours light, plants from all three T2 populations produced flowers up to 2 weeks earlier than controls under a 12 hour photoperiod. 35S::G1841 seed also showed a slight tolerance to heat in a germination assay compared to wild-type controls.

G1841 appeared to be specifically expressed in floral tissues (including embryo and silique), and to be ectopically induced by heat stress. That G1841 was specifically expressed in floral tissues but yet can consistently influence the floral transition when overexpressed, might appear paradoxical, but this is a phenomenon that has already been observed for other transcription factor genes, for example the *Arabidopsis* homeobox gene FWA (Soppe et al. (2000) *Mol. Cell.* 6: 791-802). That G1841 expression was induced by heat lends support to the result that G1841 overexpression can improve germination under heat stress.

Potential Applications

G1841 or its equivalogs could be used to modify flowering time (accelerating the switch to flowering by overexpression), as well as to improve seed germination under heat stress. The promoter of G1841 could be used to direct heat inducible gene expression in transgenic plants. In general, a wide variety of applications exist for systems that either lengthen or shorten the time to flowering.

G1842 (SEQ ID NO: 349)

Published Information

G1842 corresponds to F15O5.2 (BAA97510). The high level of sequence similarity between G1842 and FLOWERING LOCUS C (Michaels and Amasino, 1999; Sheldon et al., 1999) has been previously described (Ratcliffe et al. (2001) *Plant Physiol.* 126:122-132).

Experimental Observations

G1842 was recognized as a gene highly related to *Arabidopsis* FLOWERING LOCUS C (FLC; Michaels et al. (1999) *Plant Cell* 11, 949-956; Sheldon et al. (1999) *Plant Cell* 11, 445-458), and to MADS AFFECTING FLOWERING 1 (Ratcliffe et al. (2001) *Plant Physiol.* 126:122-132). FLC acts as a repressor of flowering (Michaels et al. (1999) *Plant Cell* 11, 949-956; Sheldon et al. (1999) *Plant Cell* 11, 445-458). Similarly, G157/MAF1 can cause a delay in flowering time when overexpressed (Ratcliffe et al. (2001) *Plant Physiol.* 126:122-132.

The function of G1842 was studied using transgenic plants in which this gene was expressed under the control of the 35S promoter. Overexpression of G1842 reduced the time to flowering in the Columbia background. No consistent alterations were detected in 35S::G1842 plants in the physiological and biochemical analyses that were performed.

Early flowering was observed in 13/21 35S::G1842 primary transformants: under continuous light conditions, these plants produced flower buds approximately 1 week earlier than controls. A comparable phenotype was also noted in the T2 populations from each of the three lines examined. In a separate experiment, the 35S::G1842 transgene was transformed into Stockholm (a late flowering, vernalization-sensitive ecotype). A comparable result was observed to that seen for Columbia: approximately 50% of 35S::G1842 Stockholm plants flowered earlier than wild-type controls.

Although G1842 is highly related in sequence to G157, G859, and FLC, its overexpression reduced the time to flowering, whereas overexpression of G157, G859, and FLC often caused a delay in flowering. In other words, whereas the function of G157, G859, and FLC appeared to repress flowering, G1842 was an activator of that process.

Potential Applications

G1842 or its equivalogs could be used to alter flowering time.

G1843 (SEQ ID NO: 351)

Published Information

G1843 corresponds to F15O5.3 (BAA97511). There is no literature published on G1843, except our own (Ratcliffe et al. (2001) *Plant Physiol.* 126:122-132). G1843 belongs to a group of five *Arabidopsis* MADS-box genes that are highly related to FLC (G1759), a repressor of the floral transition, and that we have called MADS AFFECTING FLOWERING 1-5 (Ratcliffe et al. (2001) *Plant Physiol.* 126:122-132). The published report describes functional data for only MAF1 (G157), but the sequence similarity among all the members of the group is noted.

Experimental Observations

The function of G1843 was studied using transgenic plants in which the gene was expressed under the control of the 35S promoter. Overexpression of G1843 caused alterations in plant growth and development, in particular a severe reduction in overall plant size, premature senescence, and early flowering. That G1843 caused an effect in flowering time was expected because of its sequence similarity to G1759 (FLC), G157 (MAF1), and G859, G1842, and G1844. However, in contrast to all these other genes, which when overexpressed can alter flowering time (either delay or accelerate, depending on the gene) without severe side effects on the plant, overexpression of G1843 was severely detrimental.

Primary transformants for 35S::G1843 were consistently small, showed stunted growth, and formed poorly developed inflorescences that yielded relatively few seeds. The most severely affected of these plants were very small, and died at early stages of development. Approximately 50% of the 35S::G1843 transformants were also markedly early flowering and displayed visible flower buds 1-7 days earlier than any of the wild-type controls. Most notably, the leaves of 35S::G1843 transformants frequently senesced prematurely. A total of six T2 lines were morphologically examined; all exhibited (to varying extents) comparable phenotypes to those observed in the T1 generation, showing premature senescence and stunted growth. Due to these deleterious effects, however, an accurate determination of flowering time was difficult to make in the T2 generation.

The deleterious effects caused by G1843 overexpression were also noted in the physiological analyses that were performed: in general, the G1843 overexpressing lines showed reduced seedling vigor and were pale compared to wild-type controls. 35S::G1843 plants behaved otherwise like wild-type controls in the physiological assays.

No alterations were detected in 35S::G1843 plants in the biochemical analyses that were performed.

G1843 was ubiquitously expressed and did not appear to be significantly induced by any of the conditions tested.

Potential Applications

G1843 or its equivalogs could be used to manipulate flowering time.

G1852 (SEQ ID NO: 353)

Published Information

G1852 was identified by amino acid sequence similarity to plant and mammalian ankyrin-repeat proteins. It is found in the sequence of the chromosome 4 BAC F15P23 (GenBank accession number AF128392.1 GI:4325336), released by the *Arabidopsis* Genome Initiative. The translational start and stop codons were correctly predicted. G1852 has no distinctive features other than the presence of a 33-aa repeated ankyrin element known for protein-protein interaction, in the C-terminus of the predicted protein.

Closely Related Genes from Other Species

A comparison of the amino acid sequence of G1852 with entries available from GenBank shows strong similarity with plant ankyrins of several species (*Malus domestica, Solanum tuberosum, Oryza sativa, Gossypium arboreum, Medicago truncatula, Glycine max, Lycopersicon esculentum, Pinus taeda, Lotus japonicus* and *Gossypium hirsutum*).

Experimental Observations

G1852 (SEQ ID NO:353) was analyzed through its ectopic overexpression in plants. Analysis of the endogenous level of G1852 transcripts by RT-PCR revealed expression in all tissues tested. G1852 expression was induced in response to ABA, heat and drought treatment. 35S::G1852 overexpressor plants were more tolerant to osmotic stress in a root growth assay on PEG (polyethylene glycol)-containing media compared with wild-type controls. Seedlings were larger and had more root growth.
Potential Applications
G1852 or its equivalogs can be used to alter a plant's response to water deficit conditions and therefore, be used to engineer plants with enhanced tolerance to drought, salt stress, and freezing.
G1863 (SEQ ID NO: 355)
Published Information
G1863 was identified by amino acid sequence similarity to the rice Growth-regulating-factor1 (GRF1), with a potential role in the regulation of stem growth in rice (Knapp et al (2000) Plant Physiol. 122: 695-704) It is found in the sequence of chromosome II section 199 of 255 (GenBank accession AC006919.5 GI:6598632), released by the Arabidopsis Genome Initiative. The transcription start/stop codon was correctly predicted.
Experimental Observations
Tissue distribution of G1863 transcripts reveals that this gene was expressed constitutively, but with a reduced expression level in shoots. No changes in G1863 expression was observed in the biotic/abiotic treatments examined. Physiological analysis of G1863 null mutant showed an increase in sensitivity to germination in high salt condition. The reduction in germination and seedling vigor was specific to NaCl-treated plants. G1863 null mutants responded like wild-type control in drought and osmotic essays. This phenotype was confirmed in a follow-up experiment. G1863 mutation had no apparent effect on plant development and morphology or biochemical profile.
Potential Applications
G1863 or its equivalogs could be used to modify plant tolerance to soil salinity during the germination stage.
G1880 (SEQ ID NO: 357)
Published Information
G1880 was identified in the sequence of Chromosome 2, GenBank accession number AC006532, released by the Arabidopsis Genome Initiative
Closely Related Genes from Other Species
Closely related sequences to G1880 include a putative zinc finger protein in rice (GenBank accession number 10934090), a predicted protein in tomato (9858780), and a cDNA sequence from M. truncatula (AW685627). Similarity between G1880 and these genes extends beyond the signature motif of the family to a level that would suggest the genes are orthologous.
Experimental Observations
G1880 was expressed throughout the plant, with significantly lower levels of expression in siliques. It was induced by auxin, ABA, heat, and salt, and possibly repressed by Erysiphe infection. A line homozygous for a T-DNA insertion in G1880 was used to determine the function of this gene. These plants showed fewer disease symptoms following inoculation with a low dose of the fungal pathogen Botrytis cinerea in two separate experiments. No altered phenotypes were observed in any morphological or biochemical assay.
Potential Applications
Since G1880 activity has been shown to affect the response of transgenic plants to the fungal pathogen Botrytis cinerea, G1880 could be used to manipulate the defense response in order to generate pathogen-resistant plants.
G1895 (SEQ ID NO: 359)
Published Information
G1895 was identified as a gene in the sequence of the BAC T24P13 (Accession Number AC006535), released by the Arabidopsis thaliana Genome Center.

Experimental Observations
The function of G1895 was analyzed using transgenic plants in which G1895 was expressed under the control of the 35S promoter. Overexpression of G1895 delayed the onset of flowering in Arabidopsis by around two to three weeks under continuous light conditions, although this phenotype was observed only at low frequency. In all other physiological and biochemical assays, 35S::G1895 plants appeared identical to controls. G1895 was expressed in all tissues and the highest levels of expression were found in flowers, rosette leaves, and embryos. In rosette leaves, G1895 was be induced by auxin, ABA, and by cold stress.
Potential Applications
G1895 or its equivalogs might be used to engineer plants with a delayed flowering time.
G1902 (SEQ ID NO: 361)
Published Information
G1902 corresponds to the Arabidopsis adof2 gene (Accession number AB017565).
Experimental Observations
The function of G1902 was analyzed using transgenic plants in which G1902 was expressed under the control of the 35S promoter. Overexpression of G1902 produced deleterious effects on plant growth and development. All 35S::G1902 primary transformants appeared markedly small throughout the life cycle, produced thin inflorescence stems, and showed poor fertility compared to wild type. Comparable effects were observed, to varying extents, in each of the three T2 populations examined. Additionally, plants from one of the T2 populations showed aberrant flowers with narrow perianth organs and short stamens. It is noteworthy that all three T2 populations showed an apparent deficit of kanamycin resistant seedlings, indicating that G1902 expression may have been lethal at high dosages, or that the NPT marker gene was being silenced.
35S::G1902 plants produced more seed oil than wild-type plants. G1902 was expressed in all tissues, and was induced by auxin, ABA, heat and drought stress.
Potential Applications
G1902 or its equivalogs may be used for increasing seed oil production in plants, which would be of nutritional value for food for human consumption as well as animal feeds.
G1903 (SEQ ID NO: 363)
Published Information
G1903 was identified from the Arabidopsis genomic sequence, GenBank accession number AC021046, based on its sequence similarity within the conserved domain to other DOF related proteins in Arabidopsis.
Experimental Observations
The function of this gene was analyzed using transgenic plants in which G1903 was expressed under the control of the 35S promoter. Two lines showed a significant decrease in seed protein content and an increase in seed oil content as assayed by NIR, otherwise the phenotype of these transgenic plants was wild-type in all other assays performed.
Gene expression profiling using RT/PCR showed that G1903 was expressed predominantly in flowers, however it was almost undetected in roots and seedlings. Furthermore, there was no significant effect on expression levels of G1903 after exposure to environmental stress conditions.
Potential Applications
Seed proteins play a central role in human and animal diets and represent a multibillion dollar market worldwide. G1903 or its equivalogs could be used to alter seed protein amounts and/or composition which could impact yield as well as the caloric content and the nutritional value and production of various food products. An increase in storage proteins is desirable for example in corn seeds to increase the nutritional value of the meal.

G1919 (SEQ ID NO: 365)

Published Information

G1919 was identified as a gene in the sequence of the P1 clone MBK5 (Accession Number AB005234), released by the Kazusa DNA Research Institute (Chiba, Japan).

Experimental Observations

The function of G1919 was analyzed using transgenic plants in which G1919 was expressed under the control of the 35S promoter. 35S::G1919 transformants displayed wild-type morphology at all stages of development. However, plants overexpressing G1919 showed a greater tolerance to the fungal pathogen *Botrytis cinerea* than control plants. This phenotype has been confirmed by repeated experiment. No other altered phenotypes were observed in any of the physiological or biochemical assays. G1919 was expressed at low levels in flowers, and at higher levels in embryos and siliques. G1919 was not significantly induced by any condition tested.

Potential Applications

Since G1919 activity has been shown to affect the response of transgenic plants to the fungal pathogen *Botrytis cinerea*, G1919 or its equivalogs could be used to manipulate the defense response in order to generate pathogen-resistant plants.

G1927 (SEQ ID NO: 367)

Published Information

G1927 was identified in the sequence of BAC F23M19, GenBank accession number AC007454, released by the *Arabidopsis* Genome Initiative.

Closely Related Genes from Other Species

G1927 showed extensive sequence similarity to a NAC protein from tomato (BG350410).

Experimental Observations

G1927 (SEQ ID NO: 367) was analyzed using transgenic plants in which the gene was expressed under the control of the 35S promoter. Overexpression of G1927 in *Arabidopsis* resulted in plants that had an altered response to pathogen. Plants overexpressing G1927 showed fewer disease symptoms following infection with the fungal pathogen *Sclerotinia sclerotiorum* compared with control plants. The experiment was repeated on individual lines, and all three lines showed the enhanced pathogen tolerance phenotype. G1927 expression appeared to be ubiquitous according to RT-PCR analysis.

Potential Applications

G1927 or its equivalogs can be used to manipulate the defense response in order to generate pathogen-resistant plants.

G1930 (SEQ ID NO: 369)

Published Information

G1930 was identified in the sequence of P1 clone K13N2 (gene K13N2.7, GenBank protein accession number BAA95760).

Closely Related Genes from Other Species

G1930 shows sequence similarity, outside of the conserved AP2 and ABI3 domains, to a predicted rice protein (GenBank accession number BAB21218).

Experimental Observations

The function of G1930 was studied using transgenic plants in which this gene was expressed under the control of the 35S promoter. G1930 overexpressors were more tolerant to osmotic stress conditions. The plants responded to high NaCl and high sucrose on plates with more seedling vigor compared to wild-type control plants. In addition, an increase in the amount of chlorophylls a and b in seeds of two T2 lines was detected. However, constitutive expression of G1930 also produced a variety of morphological, physiological, and biochemical alterations. 35S::G1930 T1 plants were generally small and developed spindly inflorescences. The fertility of these plants was low and flowers often failed to open or pollinate.

G1930 was ubiquitously expressed and did not appear to be induced by any of the conditions tested.

Potential Applications

G1930 or its equivalogs could be used to increase germination under adverse osmotic stress conditions, which could impact survivability and yield. This gene could also be used to regulate the levels of chlorophyll in seeds.

G1936 (SEQ ID NO: 371)

Published Information

The sequence of G1936 was obtained from the *Arabidopsis* genome sequencing project, GenBank accession number AB010072, based on its sequence similarity within the conserved domain to other PCF related proteins in *Arabidopsis*.

Experimental Observations

The function of G1936 was studied using a line homozygous for a T-DNA insertion in the gene. The DNA insertion lies shortly before the ATG start site of the coding sequence in the 5' UTR region and is expected to result in a null mutation.

G1936 knockout mutant plants showed more disease symptoms following inoculation with the fungal pathogen *Sclerotinia sclerotiorum*. They also showed more disease symptoms after inoculation with a low dose of *Botrytis cinerea* compared to control plants.

As determined by RT-PCR, G1936 was uniformly expressed in all tissues with exception of germinating seeds. Expression level of G1936 was unchanged by any of the environmental conditions or pathogens infections tested.

Potential Applications

Since G1936 transgenic plants have an altered response to the pathogens *Sclerotinia sclerotiorum* and *Botrytis cinerea*, G1936 or its equivalogs could be used to manipulate the defense response in order to generate pathogen-resistant plants

G1944 (SEQ ID NO: 373)

Published Information

The sequence of G1944 was obtained from EU *Arabidopsis* sequencing project, GenBank accession number AL049638, based on its sequence similarity within the conserved domain to other AT-Hook related proteins in *Arabidopsis*.

Closely Related Genes from Other Species

G1944 protein shares a significant homology to *Glycine max* cDNA clones. Similarity between G1944 and the *Glycine max* cDNA clones extends beyond the signature motif of the family to a level that would suggest the genes are orthologous. Therefore the gene represented by cDNA clones BE822274 and BE555817 may have a function and/or utility similar to that of G1944. No further information is available about the cDNA clones BE822274 and BE555817.

Experimental Observations

The sequence of G1944 was experimentally determined and the function of G1944 was analyzed using transgenic plants in which G1944 was expressed under the control of the 35S promoter.

Overexpression of G1944 reduced overall plant size and resulted in premature senescence of rosette leaves.

Physiological assays revealed that seedlings from G1944 overexpressor lines were more severely stunted in an ethylene insensitivity assay when compared to the wild-type controls. This result indicated that G1944 is involved in the ethylene signal transduction pathway. It is well known that ethylene is involved in the senescence process and therefore, the phenotype of premature senescence of rosette leaves could be related to a general sensitivity to ethylene signal transduction pathway.

As determined by RT-PCR, G1944 was expressed in most of tissues tested. Expression level of G1944 appeared to be induced by auxin and salicylic acid treatments.

Potential Applications

G1944 or its equivalogs, because of its effect on plant size and leaf senescence may be used to modify plant growth and development.

G1944 or its equivalogs could be used to alter senescence of different plant organs. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. Delayed flower senescence may also generate plants that retain their blossoms longer and this may be of potential interest to the ornamental horticulture industry.

G1946 (SEQ ID NO: 375)

Published Information

The heat shock transcription factor G1946 is a member of the class-A HSFs (Nover et al. (1996) *Cell Stress Chaperones* 1: 215-223) characterized by an extended HR-A/B oligomerization domain. G1946 is found in the sequence of the chromosome 1, BAC F5D14 (GenBank accession AC007767.3 GI:7549621), released by the *Arabidopsis* Genome Initiative. The translational start codon was incorrectly predicted.

Closely Related Genes from Other Species

A comparison of the amino acid sequence of G1946 with sequences available from GenBank showed strong similarity with plant HSFs of several species (*Lycopersicon peruvianum, Medicago truncatula, Lycopersicon esculentum, Glycine max, Solanum tuberosum, Oryza sativa* and *Hordeum vulgare* subsp. *Vulgare*).

Experimental Observations

G1946 (SEQ ID NO:375) was studied using transgenic plants in which the gene was expressed under the control of the 35S promoter. Overexpression of G1946 resulted in accelerated flowering, with 35S::G1946 transformants producing flower buds up to a week earlier than wild-type controls (24-hour light conditions). These effects were seen in 12/20 primary transformants and in two independent plantings of each of the three T2 lines. Unlike many early flowering *Arabidopsis* transgenic lines, which are dwarfed, 35S::G1946 transformants often reached full-size at maturity, and produced large quantities of seeds, although the plants were slightly pale in coloration and had slightly flat leaves compared to wild type. In addition, 35S::G1946 plants showed an altered response to phosphate deprivation. Seedlings of G1946 overexpressors showed more secondary root growth on phosphate-free media, when compared to wild-type control. In a repeat experiment, all three lines showed the phenotype. Overexpression of G1946 in *Arabidopsis* also resulted in an increase in seed glucosinolate M39501 in two T2 lines. An increase in seed oil and a decrease in seed protein were also observed in these two lines. G1946 was ubiquitously expressed, and did not appear to be significantly induced or repressed by any of the biotic and abiotic stress conditions tested, with the exception of cold, which repressed G1946 expression.

Potential Applications

G1946 or its equivalogs can be used to modify flowering time, as well as to improve the plant's performance in conditions of limited phosphate, and to alter seed oil, protein, and glucosinolate composition.

G1947 (SEQ ID NO: 377)

Published Information

The heat shock transcription factor G1947 is a member of the class-A HSFs (Nover et al. (1996) *Cell Stress Chaperones* 1: 215-223) characterized by an extended HR-A/B oligomerization domain. G1947 is found in the sequence of the chromosome 5 P1 clone MQD19 (GenBank accession AB026651.1 GI:4757407), released by the *Arabidopsis* Genome Initiative. The start codon was incorrectly predicted in the public annotation.

Experimental Observations

Analysis of the endogenous level of G1947 transcripts by RT-PCR revealed a constitutive expression, with the highest expression levels in rosette leaves and the lowest in shoots and roots. G1947 expression appeared to be induced by a variety of physiological or environmental conditions (auxin, ABA, heat, drought and osmotic stress).

A line homozygous for a T-DNA insertion in G1947 was used to analyze the function of this gene. The insertion point is 163 nucleotides downstream from the initiation codon of G1947, and therefore should result in a null mutation.

G1947 mutant plants formed inflorescences that grew for an extended period of time, and continued to generate flowers for substantially longer than wild-type controls. In G1947 mutant plants, silique development was generally poor: they were very short and contained only a few irregularly shaped seeds. Thus, the extended phase of flower production observed in G1947 knockout mutant plants might have been the result of poor fertility, because extended production of flowers and delayed floral organ abscission is often seen in sterile *Arabidopsis* mutants. The basis for the reduced fertility of G1947 knockout plants was not apparent from the morphology of their flowers. In addition, some inconsistent effects on seedling size were noted for G1947 knockout mutants. No size differences were noted between rosette stage G1947 knockout plants and controls, although at late stages the G1947 knockout plants appeared bushier than controls, probably due to continued growth of the inflorescence stems.

No altered phenotypes were observed for G1947 knockout plants in any of the physiological or biochemical assays performed.

Potential Applications

G1947 or its equivalogs could be used to engineer infertility in transgenic plants. G1947 may also have utility in engineering plants with longer-lasting flowers for the horticulture industry.

G1948 (SEQ ID NO: 379)

Published Information

G1948 was identified by amino acid sequence similarity to plant and mammalian ankyrin-repeat proteins. It is found in the sequence of the chromosome 2, clones T8113, T30B22 (GenBank accession number AC002535.2 GI:6598379), released by the *Arabidopsis* Genome Initiative. G1948 has also been referred to as CHAOS (CAO), acronym for CHLOROPHYLL A/B BINDING PROTEIN HARVESTING-ORGANELLE SPECIFIC (Klimyuk et al. (1999) Plant Cell. 11(1):87-99). The CAO protein contains ankyrin repeats in its central region, and a chromodomain in its carboxy terminal part. Chromodomains are usually found in chromatin-related proteins. However, the CAO protein was shown to be a plant-specific component of the chloroplast signal recognition particle pathway that is involved in LHCP targeting (Klimyuk et al. (1999) *Plant Cell* 11:87-99).

Experimental Observations

The function of G1948 was analyzed through its ectopic overexpression in plants. Expression analysis by RT-PCR revealed a low/moderate expression level of G1948 in all above-ground tissues, in agreement with previously published observations (Klimyuk et al. (1999) *Plant Cell* 11:87-99). G1948 expression was not altered by any of the and biotic/abiotic treatments examined.

The characterization of G1948 overexpressor lines revealed increased seed oil content relative to wild-type plants.

Potential Applications

G1948 or its equivalogs could used to increase seed oil content, which would be of value for modifying the nutritional value and caloric content of food for human consumption as well as animal feeds, and may be of value in improving seed storage characteristics.

G1950 (SEQ ID NO: 381)

Published Information

G1950 was identified by amino acid sequence similarity to plant and mammalian ankyrin-repeat proteins. G1950 is found in the sequence of the chromosome 2 BAC T4M8 (GenBank accession number AC006284.3; nid=6598551), released by the *Arabidopsis* Genome Initiative. G1950 has no distinctive features other than the presence of a 33-aa repeated ankyrin element known for protein-protein interaction, in the C-terminus of the predicted protein. Amino acid sequence comparison shows similarity to *Arabidopsis* NPR1.

Experimental Observations

The 5' and 3' ends of G1950 were experimentally determined by RACE, and found to correspond to the prediction in GenBank. The analysis of the endogenous expression level of G1950, as determined by RT-PCR, revealed that expression was specific to embryos, siliques and germinating seeds (young seedlings). G1950 expression was induced upon auxin treatment, which indicated that G1950 plays an important role in seed/embryo development or other processes specific to seeds (stress-related or desiccation-related).

The function of G1950 was analyzed in transgenic plants overexpressing G1950 under the control of the 35S promoter. When compared to wild-type controls, plants overexpressing G1950 were more tolerant to infection with the necrotrophic fungal pathogen *Botrytis cinerea*. The experiment was confirmed using mixed and individual lines. This result indicated that G1950, an *Arabidopsis* ankyrin protein with similarity to NPR1, may play a similar role to NPR1 in disease pathways. Transformants were morphologically indistinguishable from wild-type plants, and showed no biochemical changes in comparison to controls.

Potential Applications

35S::G1950 overexpression in *Arabidopsis* or ectopic expression in leaves has been shown to affect the onset of disease following inoculation with *Botrytis cinerea*. Therefore, G1950 or its equivalogs could be used to manipulate the defense response in order to generate pathogen-resistant plants. Furthermore, seed or embryo-specific expression of G1950 may indicate a potential function for this gene or its equivalogs in seed development. The G1950 promoter could be useful for targeted gene expression in seeds.

G1958 (SEQ ID NO: 383)

Published Information

G1958 was identified in the sequence of BAC T5F17, GenBank accession number AL049917, released by the *Arabidopsis* Genome Initiative.

G1958 has also been published as PHR1. Mutants in PHR1 show reduced growth under conditions of phosphate starvation and fail to induce genes normally regulated by low phosphate concentration (Rubio et al. (2001) *Genes Devel.* 15: 2122-2133).

Closely Related Genes from Other Species

G1958 is a member of a subclass of GARP family members that contains a second conserved domain with a somewhat regularly spaced pattern of glutamine residues. Members of this subclass are apparent in many other plant species. A potential ortholog of G1958 is a putative transcription factor from tobacco, WREBP-1 (accession number BAA75684). G1958 is the closest *Arabidopsis* relative of this tobacco gene, and similarity between G1958 and WREBP-1 extends beyond the signature motifs of the family to a level that would suggest the genes are orthologous. Therefore, WREBP-1 may have a function and/or utility similar to that of G1958.

Experimental Observations

The full-length coding sequence of G1958 was determined. G1958 was found to be expressed throughout the plant with highest expression in rosette leaves, flowers, and embryos, and was induced by auxin and heat. A line homozygous for a T-DNA insertion in G1958 was used to determine the function of this gene. The T-DNA insertion of G1958 was approximately 90% into the coding sequence of the gene, within a region of amino acid sequence conservation that seems to define a subfamily of GARP proteins, and therefore is likely to result in a null mutation. The phenotype of these knockout plants was wild-type in all assays performed, except that they were smaller and showed less root growth than control plants when grown on plates. This phenotype may have been environmentally influenced as it was accentuated when seedlings were transferred to stress conditions, while in contrast, small size was not noted in the soil-grown plants. G1958 was apparently necessary for optimum growth and development. However, the subtle phenotype indicated that G1958 could be partially redundant. G1958 is a member of a small GARP subfamily with high sequence similarity, so it is possible that other homologs might have overlapping function.

G1958 knockout mutants had increased seed oil and decreased seed protein content compared to wild-type plants.

Potential Applications

G1958 or its equivalogs may be used to alter seed protein content, which may be very important for the nutritional value and production of various food products G1958 or its equivalogs could also be used to manipulate plant growth, in particular root growth.

G2007 (SEQ ID NO: 385)

Published Information

G2007 belongs to the MYB-(R1)R2R3 family of transcription factors. G2007 corresponds to the previously described gene Myb42 (Stracke and Weisshaar, 1999; direct submission of the sequence to GenBank).

Closely Related Genes from Other Species

A myb gene from *Pimpinella brachycarpa* (AAF22256) is related to G2007. Similarity between G2007 and this *Pimpinella* myb extends beyond the signature motif of the family to a level that would suggest the genes are orthologous.

Experimental Observations

The complete sequence of G2007 was determined. The function of this gene was analyzed using transgenic plants in which G2007 was expressed under the control of the 35S promoter. The phenotype of these transgenic plants was wild-type in all biochemical and physiological assays performed. However, overexpression of G2007 resulted in a delayed switch to flowering. Under continuous light conditions, 35S::

G2007 plants produced approximately twice as many primary rosette leaves as controls, and formed flower buds up to two weeks late. As a consequence of this delay in flowering, the plants also senesced later than wild type. All the plants from two independent T2 lines exhibited this phenotype, in both an initial and a repeat planting. Late flowering was also noted amongst some of the primary transformants, but the T1 generation showed considerable morphological variation, making this trait more difficult to discern.

G2007 appeared to be constitutively expressed at moderate levels in all tissues tested except germinating seeds where no expression was detected. There was no induction of G2007 in response to any environmental condition tested.

Potential Applications

G2007 or its equivalogs may be used to delay flowering in plants. In species such as sugarbeet where the vegetative parts of the plants constitute the crop and the reproductive tissues are discarded, it would be advantageous to delay or prevent flowering. Extending vegetative development could bring about large increases in yields.

Additionally, a major concern is the escape of transgenic pollen from GMOs to wild species or so-called organic crops. Genes such as G2007 or its equivalogs that prevent vegetative transgenic crops from flowering would eliminate this worry.

G2010 (SEQ ID NO: 387)

Published Information

G2010 is a member of the SBP family of transcription factors and corresponds to sp14 (Cardon et al., 1999). Expression of sp14 is up-regulated during development under both long day and short day conditions and is highly expressed in the inflorescence tissue. Expression of G2010 is localized to the rib meristem and inter-primordial regions of the inflorescence apex (Cardon et al (1999) Gene 237:91-104).

Closely Related Genes from Other Species

A gene related to G2010 is squamosa-promoter binding protein 1 from *Antirrhinum majus*.

Experimental Observations

The complete sequence of G2010 was determined. The function of this gene was analyzed using transgenic plants in which G2010 was expressed under the control of the 35S promoter. Overexpression of G2010 resulted in a clear reduction in time to flowering. Under continuous light conditions, at 20-25° C., three independent T2 lines of 35S::G2010 plants flowered approximately one week earlier than wild-type controls. The primary shoot of 35S::G2010 plants switched to reproductive growth after producing 5-6 rosette leaves, compared with 8-10 rosette leaves in controls. Flower buds were first visible 12-14 days after sowing in 35S::G2010 plants compared with approximately 20 days for wild type. 35S::G2010 transformants were also observed to begin senescence sooner than controls. Otherwise, plants overexpressing G2010 are wild-type in phenotype.

Expression of G2010 was not detected by RT-PCR in any of the tissues tested. G2010 was slightly induced in rosette leaves in response to heat and cold stress treatments as well as salicylic acid treatment. The expression profile for G2010 indicated that this gene is involved in a plant's transition to flowering normally and in response to stressful environmental conditions.

Potential Applications

The potential utility of a gene such as G2010 or its equivalogs is to accelerate flowering time.

G2053 (SEQ ID NO: 389)

Published Information

G2053 was identified in the sequence of BAC T27C4, GenBank accession number AC022287, released by the *Arabidopsis* Genome Initiative.

Experimental Observations

The function of G2053 was analyzed using transgenic plants in which the gene was expressed under the control of the 35S promoter. Overexpression of G2053 in *Arabidopsis* resulted in plants with altered osmotic stress tolerance. In a root growth assay on media containing high concentrations of PEG, G2053 overexpressors showed more root growth compared to wild-type controls.

Potential Applications

Based on the altered stress tolerance induced by G2053 overexpression, this transcription factor or its equivalogs could be used to alter a plant's response water deficit conditions and, therefore, could be used to engineer plants with enhanced tolerance to drought, salt stress, and freezing.

G2059 (SEQ ID NO: 391)

Published Information

G2059 corresponds to gene AT4g13620 (CAB78404).

Experimental Observations

The function of G2059 was studied using transgenic plants in which the gene was expressed under the control of the 35S promoter. 35S::G2059 plants did not show major alterations in morphology and development, and were wild-type in the physiological and biochemical analyses that were performed. However, subtle changes in rosette leaf morphology were detected in 35S::G2059 transformants: rosette leaves were slightly darker green and rather narrow compared to controls.

G2059 expression was detected by RT-PCR in root tissue, and it appeared to be ectopically induced by heat stress.

As measured by NIR, G2059 overexpressors had decreased seed oil content and increased seed protein content compared to wild-type plants.

Potential Applications

G2059 or equivalog overexpression may be used to alter seed oil content, which may be very important for the nutritional value and production of various food products

G2085 (SEQ ID NO: 393)

Published Information

G2085 was identified as a gene in the sequence of BAC AL078637, released by the *Arabidopsis* Genome Initiative.

Experimental Observations

The sequence of G2085 was experimentally determined and the data presented for this gene were from plants homozygous for a T-DNA insertion in G2085. The T-DNA insertion of this gene was found to be in coding sequence and therefore this knockout mutant was likely to contain a null allele of G2085.

Although G2085 was constitutively expressed throughout the plant, its expression was markedly repressed by a variety of stress conditions such as ABA, cold, osmotic stress and *Erysiphe*, indicating that it may be a negative regulator of stress responses in *Arabidopsis*.

Seed of these G2085 knockout mutants had increased size and altered color.

Potential Applications

G2085 or its equivalogs could be used to modify seed size and/or morphology, which could have an impact on yield and appearance

G2105 (SEQ ID NO: 395)

Published Information

G2105 was discovered as a gene in BAC T22K18, accession number AC010927, released by the *Arabidopsis* genome initiative.

Closely Related Genes from Other Species

G2105 has similarity within the conserved domain of non-*Arabidopsis* proteins.

Experimental Observations

The ORF boundary of G2105 (SEQ ID NO: 395) was determined and G2105 was analyzed using transgenic plants in which G2105 was expressed under the control of the 35S promoter. Two of four T2 lines examined appeared dark green and were smaller than wild type at all stages of development. Additionally, the adaxial leaf surfaces from these plants had a somewhat 'lumpy' appearance caused by trichomes being raised-up on small mounds of epidermal cells. Two lines of G2105 overexpressing plants had larger seed. G2105 expression was root specific and induced in leaves by auxin, abscisic acid, high temperature, salt and osmotic stress treatments.

Potential Applications

On the basis of the analyses, G2105 or its equivalogs can be used to manipulate some aspect of plant growth or development, particularly in trichome development.

In addition, G2105 or its equivalogs can be used to modify seed size and/or morphology, which can have an impact on yield.

The promoter of G2105 can have some utility as a root specific promoter.

G2110 (SEQ ID NO: 397)

Published Information

G2110 corresponds to gene F6A14.5 (AAF27095).

Closely Related Genes from Other Species

G2110 shows sequence similarity, outside of the conserved WRKY domain, with other proteins of the family from several plant species, such as AC007789_9 putative WRKY DNA binding protein (gi5042446), from rice.

Experimental Observations

The function of G2110 was studied using transgenic plants in which the gene was expressed under the control of the 35S promoter. Overexpression of G2110 resulted in plants with an altered salt stress response. In a root growth assay on media containing high concentrations of NaCl, G2110 overexpressing lines showed more seedling vigor, less bleaching and more root growth compared to wild-type control plants. In repeat experiments, all three lines showed the salt tolerance phenotype.

No consistent alterations in plant morphology resulted from G2110 overexpression, and 35S::G2110 plants were wild-type in the biochemical analyses that were performed.

G2110 was expressed in a variety of tissues, including flower, shoot, embryo, silique, and germinating seedling samples; its expression was not detected in leaf and root tissues. G2110 expression may have been altered by several physiological conditions, and, was ectopically induced by auxin and by heat.

Potential Applications

G2110 or its equivalogs could be used to improve plant performance under conditions of salt stress. Evaporation from the soil surface causes upward water movement and salt accumulation in the upper soil layer where the seeds are placed. Thus, germination normally takes place at a salt concentration that is higher than the mean salt concentration in the whole soil profile. Increased salt tolerance during the germination stage of a crop plant would impact survivability and yield.

G2114 (SEQ ID NO: 399)

Published Information

G2114 corresponds to gene F28P22.24 (AAF21171).

Closely Related Genes from Other Species

G2114 shows sequence similarity, outside of the conserved AP2 domain, with other proteins of the family from several plant species, such as the one from *Glycine max* represented by EST AW780688 s175e07.y1 Gm-c1027 *Glycine max* cDNA clone GENOME SYSTEMS CLONE ID: Gm-c1027-7165.

Experimental Observations

The function of G2114 was studied using transgenic plants in which the gene was expressed under the control of the 35S promoter. Seeds from one of the T2 populations were larger than controls. This effect was apparent in seed from this population's primary transformant, but was not noted in the other T2 populations.

35S::G2114 plants were wild-type in the physiological and biochemical analyses that were performed.

G2114 expression was primarily detected in embryo, silique, and germinating seedling tissue. G2114 was not ectopically induced by any of the biotic and abiotic stress conditions tested.

Potential Applications

G2114 or its equivalogs could be used to modify seed size and/or morphology, which could have an impact on yield and appearance

G2117 (SEQ ID NO: 401)

Published Information

G2117 was identified in the sequence of BAC T6L1, GenBank accession number AC011665, released by the *Arabidopsis* Genome Initiative.

Experimental Observations

The function of G2117 was analyzed using transgenic plants in which the gene was expressed under the control of the 35S promoter.

Plants overexpressing G2117 had altered leaf morphology, coloration, and smaller overall plant size and were generally small with short, rounded, dark green leaves that became curled later in development. These plants generated thin inflorescence stems developed a rather bushy appearance, and had reduced fertility. Overexpression of G2117 in *Arabidopsis* also resulted in an increase in seed glucosinolate M39497 in two T2 lines. No other phenotypic alterations were observed.

G2117 appeared to be highly expressed in roots compared to all other tissues tested.

G2117 overexpressors had increased seed protein content compared to wild-type plants.

Potential Applications

G2117 or its equivalogs may be useful for altering seed glucosinolate composition.

G2117 or equivalog overexpression may also be used to alter seed protein content, which may be very important for the nutritional value and production of various food products.

G2123 (SEQ ID NO: 403)

Published Information

G2123 corresponds to a predicted putative 14-3-3 protein in annotated BAC clone T11I11 (AC012680), from chromosome 1 of *Arabidopsis*.

Closely Related Genes from Other Species

Because there is a high degree of similarity among all GF14 proteins, there are several GF14 proteins from other plant species, which are closely related to G2123.

Experimental Observations

G2123 corresponds to a predicted putative 14-3-3 protein in annotated BAC clone T11I11 (AC012680), from chromosome 1 of *Arabidopsis*.

G2123 (SEQ ID NO: 403) was analyzed using transgenic plants in which G2123 was expressed under the control of the 35S promoter. The phenotype of these transgenic plants was wild-type in all assays performed. G2123 was expressed primarily in developing seeds and silique tissue in wild-type plants.

G2123 overexpressors produced more seed oil than wild-type plants.
Potential Applications
G2123 or its equivalogs could used to increase seed oil content, which would be of value for modifying the nutritional value and caloric content of food for human consumption as well as animal feeds, and may be of value in improving seed storage characteristics.

G2130 (SEQ ID NO: 405)
Published Information
G2130 was identified in the sequence of BAC clone F15G16 (AL132959, gene F15G16.20).
Closely Related Genes from Other Species
G2130 shows sequence similarity, outside of the conserved AP2 domain, with a protein from *Medicago truncatula*, represented by EST sequence AW685524.
Experimental Observations
The function of G2130 was studied using transgenic plants in which the gene was expressed under the control of the 35S promoter. 35S::G2130 plants showed a variety of morphological and physiological alterations. Overexpression of G2130 reduced overall plant size, resulted in premature senescence, and compromised fertility. 35S::G2130 plants were smaller than wild-type controls throughout development. At around the time of bolting, leaves developed yellow patches of senesced tissue. The inflorescences from these plants were generally very thin and carried flowers with poorly developed stamens. Many flowers senesced without pollination and failed to develop a silique.

G2130 overexpressing lines showed more seedling vigor in a heat stress tolerance germination assay compared to wild-type controls. However, no difference was detected in the heat stress response assay, which is performed on older seedlings, indicating that the phenotype could be specific for germination. G2130 overexpressing lines are also somewhat more sensitive to chilling: the plants are more chlorotic and stunted when grown at 8° C. compared to the wild-type controls. They also showed more disease symptoms following inoculation with a low dose of the fungal pathogen *Botrytis cinerea*.

G2130 was ubiquitously expressed and did not appear to be significantly induced by any of the conditions tested.
Potential Applications
G2130 or its equivalogs could be used to improve seed germination under heat stress.

G2133 (SEQ ID NO: 407)
Published Information
G2133 corresponds to gene F26A9.11 (AAF23336).
Closely Related Genes from Other Species
G2133 shows sequence similarity with known genes from other plant species within the conserved AP2/EREBP domain.
Experimental Observations
G2133 (SEQ ID NO: 407) was studied using transgenic plants in which the gene was expressed under the control of the 35S promoter. Overexpression of G2133 caused a variety of alterations in plant growth and development: delayed flowering, altered inflorescence architecture, and a decrease in overall size and fertility. At early stages, 35S::G2133 transformants were markedly smaller than controls and displayed curled, dark-green leaves. Most of these plants remained in a vegetative phase of development substantially longer than controls, and produced an increased number of leaves before bolting. In the most severely affected plants, bolting occurred more than a month later than in wild type (24-hour light). In addition, the plants displayed a reduction in apical dominance and formed large numbers of shoots simultaneously, from the axils of rosette leaves. These inflorescence stems had short internodes, and carried increased numbers of cauline leaf nodes, giving them a very leafy appearance. The fertility of 35S::G2133 plants was generally very low. In addition, G2133 overexpressing lines were more resistant to the herbicide glyphosate. In a repeat experiment, two lines were more tolerant while one line was wild type. G2133 expression was detected in a variety of tissues: flower, leaf, embryo, and silique samples. Its expression was altered by several conditions, including auxin treatment, osmotic stress, and *Fusarium* infection.
Potential Applications
G2133 or its equivalogs can be used for the generation of glyphosate resistant plants, and to increase plant resistance to oxidative stress.
G2133 or its equivalogs may also be used to delay flowering in plants.

G2138 (SEQ ID NO: 409)
Published Information
G2138 corresponds to gene F23N20.12 (AAF26022).
Experimental Observations
The function of G2138 was studied using transgenic plants in which the gene was expressed under the control of the 35S promoter. 35S::G2138 plants were wild-type in morphology and development. G2138 overexpressors produced more seed oil than wild-type plants.
Potential Applications
G2138 or its equivalogs could used to increase seed oil content, which would be of value for modifying the nutritional value and caloric content of food for human consumption as well as animal feeds, and may be of value in improving seed storage characteristics.

G2140 (SEQ ID NO: 411)
Published Information
The sequence of G2140 was obtained from *Arabidopsis* genomic sequencing project, GenBank accession number AC011665, based on its sequence similarity within the conserved domain to other bHLH related proteins in *Arabidopsis*. G2140 corresponds to gene F14K14.8 (AAG52041).
Closely Related Genes from Other Species
G2140 proteins show extensive sequence similarity with a tomato ovary cDNA, TAMU *Lycopersicon esculentum* (AI488313) and a *Glycine max* cDNA clone (BE020519).
Experimental Observations
The complete sequence of G2140 (SEQ ID NO: 411) was determined. G2140 was expressed throughout the plant. It showed repression by salicylic acid and *Erysiphe* infection. Overexpressing G2140 in *Arabidopsis* resulted in seedlings that were more tolerant to osmotic stress conditions. In germination assays where seedlings were exposed to high concentrations of sucrose or NaCl, all three lines tested showed better cotyledon expansion and seedling vigor. Additionally, G2140 overexpressing plants showed insensitivity to ABA in a germination assay. In general, G2140 overexpressing plants were small and sickly with short roots when grown in Petri plates. The combination of ABA insensitivity and resistance to osmotic stress at germination had also been observed for other genes, for example, G1820 and G926. Significantly, the ABA resistance was detected in a germination assay. ABA is involved in maintaining seed dormancy, and it is possible that ABA insensitivity at the germination stage promotes germination despite unfavorable conditions.

When grown in soil, G2140 overexpressing plants displayed marked changes in *Arabidopsis* leaf and root morphology. All twenty of the 35S::G2140 primary transformants displayed, to various extents, leaves with upcurled margins. In the most severe cases, the leaves became highly contorted and the plants were slightly small and grew more slowly than controls. Three T1 lines that showed substantial levels of G2140 overexpression (determined by RT-PCR) were chosen for further study. The T2 seedlings from each of these lines exhibited stunted roots compared with controls. Seedlings from two of these lines also showed upcurled cotyledons. At later stages, however, some T2-plants appeared wild type. Plants from some T2-populations were rather varied in size and showed hints of leaf curling later in development. However, this effect was less severe than that seen in the T1 lines. To verify the leaf-curling phenotype, two further T2 populations were morphologically examined; seedlings from one line were found to be extremely tiny with thickened hypocotyls and short stunted roots. Such plants were too small for transfer to soil. However, another line of T2-18 showed slightly contorted cotyledons and formed severely upcurled leaves, confirming the effects seen in the T1 generation.

Potential Applications

G2140 affects ABA sensitivity, and thus when transformed into a plant this transcription factor or its equivalogs may diminish cold, drought, oxidative and other stress sensitivities, and also be used to alter plant architecture, and yield.

G2140 or its equivalogs are useful for creating plants that germinate better under conditions of high salt. Evaporation from the soil surface causes upward water movement and salt accumulation in the upper soil layer where the seeds are placed. Thus, germination normally takes place at a salt concentration much higher than the mean salt concentration in the whole soil profile. Increased salt tolerance during the germination stage of a crop plant will impact survivability and yield. In addition, G2140 or its equivalogs can be used to alter a plant's response to water deficit conditions and, therefore, can be used to engineer plants with enhanced tolerance to drought, and freezing.

G2143 (SEQ ID NO: 413)

Published Information

The sequence of G2143 was obtained from *Arabidopsis* genomic sequencing project, GenBank accession number AL132976, based on its sequence similarity within the conserved domain to other bHLH related proteins in *Arabidopsis*. G2143 corresponds to gene F11C1_170 (CAB62312).

Closely Related Genes from Other Species

G2143 protein shared extensive homology in the basic helix loop helix region with a protein encoded by *Glycine max* cDNA clones (AW832545, BG726819 and BG154493) and a *Lycopersicon esculentum* cDNA clone (BE451174). There was lower homology outside of the region.

Experimental Observations

G2143 (SEQ ID NO: 413) is a member of a clade of highly related HLH/MYC proteins that also includes G779, G1063, G1499, and G2557. All of these genes caused similar pleiotropic phenotypic effects when overexpressed, the most striking of which was the production of ectopic carpelloid tissue. These genes can be considered key regulators of carpel development. Twelve out of twenty 35S::G2143 T1 lines showed a very severe phenotype; these plants were markedly small and had narrow, curled, dark-green leaves. Such individuals were completely sterile and formed highly abnormal inflorescences; shoots often terminated in pin-like structures, and flowers were replaced by filamentous carpelloid structures, or a fused mass of carpelloid tissue. Furthermore, lateral branches usually failed to develop, and tiny patches of stigmatic tissue often formed at axillary nodes of the inflorescence. Strongly affected plants displayed the highest levels of transgene expression (determined by RT-PCR). The remaining T1 plants showed lower levels of G2143 overexpression; these plants were still distinctly smaller than wild type, but had relatively normal inflorescences and produced seed.

Since the strongest 35S::G2143 lines were sterile, three lines with a relatively weak phenotype, that had produced sufficient seed for biochemical analysis, were selected for further study. T2-11 plants displayed a very mild phenotype and had somewhat small, narrow, dark green leaves. The other two T2 populations, however, appeared wild type, suggesting that transgene activity might have been reduced between the generations. Reduced seedling vigor was noted in the physiological assays. G2143 expression was detected at low levels in flowers and siliques, and at higher levels in germinating seed.

Potential Applications

G2143 or its equivalogs can be used to manipulate flower form and structure or plant fertility. One application for manipulation of flower structure can be in the production of saffron, which is derived from the stigmas of *Crocus sativus*.

G2144 (SEQ ID NO: 415)

Published Information

The sequence of G2144 was obtained from *Arabidopsis* genomic sequencing project, GenBank accession number AL132977, based on its sequence similarity within the conserved domain to other bHLH related proteins in *Arabidopsis*. G2144 corresponds to gene T10K17.10 (CAB67608).

Experimental Observations

The complete sequence of G2144 was determined. G2144 was expressed at low to moderate levels throughout the plant. It was not significantly induced or repressed by any of the conditions tested.

The function of this gene was analyzed using transgenic plants in which G2144 was expressed under the control of the 35S promoter. Overexpression of G2144 in *Arabidopsis* produced pleiotropic morphological changes that indicate the gene might affect light regulated development, or shade avoidance responses. At the seedling stage, 35S::G2144 transformants often exhibited elongated cotyledons and hypocotyls. Later, the plants developed rather pale, narrow, flat leaves that had long petioles, and were sometimes positioned in a vertical orientation. Flowering occurred several days earlier than in wild type and inflorescence stems were typically rather thin and spindly. Interestingly, in many of the plants, inflorescence stems sporadically split open at later stages. Additionally, in some plants, large numbers of secondary leaves developed in the axils of primary rosette leaves, and occasionally, internode elongation occurred between rosette leaves. It should also be noted that fertility was often poor; flowers sometimes failed to properly open or showed contorted organs, and seed yield was low.

Morphological alterations in the 35S::G2144 plants were somewhat similar to those in the 35S::G1494 plants.

In addition, overexpression of G2144 in *Arabidopsis* resulted in an increase in leaf glucosinolate M39480 in two T2 lines.

Potential Applications

G2144 or its equivalogs can be used to alter how plants respond to light. For example, it may be used to manipulate plant growth and development, and flowering time.

G2144 or its equivalogs could be used to alter glucosinolate composition in plants.

G2144 or its equivalogs could also be used to alter flowering time.

G2153 (SEQ ID NO: 417)

Published Information

The sequence of G2153 was obtained from *Arabidopsis* genomic sequencing project, GenBank accession number AC011437, based on its sequence similarity within the conserved domain to other AT-hook related proteins in *Arabidopsis*. G2153 corresponds to gene F7O18.4 (AAF04888).

Closely Related Genes from Other Species

G2153 protein shows extensive sequence similarity with *Oryza sativa* chromosome 2 and 8 clones (AP004020 and AP003891), a *Lotus japonicus* cDNA (AW720668) and a *Medicago truncatula* cDNA clone (AW574000).

Experimental Observations

The complete sequence of G2153 was determined. G2153 was strongly expressed in roots, embryos, siliques, and germinating seed, but at low or undetectable levels in shoots, flowers, and rosette leaves. It was not significantly induced or repressed by any condition tested.

The function of this gene was analyzed using transgenic plants in which G2153 was expressed under the control of the 35S promoter. Overexpression of G2153 in *Arabidopsis* resulted in seedlings with an altered response to osmotic stress. In a germination assay on media containing high sucrose, G2153 overexpressors had more expanded cotyledons and longer roots than the wild-type controls. This phenotype was confirmed in repeat experiments on individual lines, and all three lines showed osmotic tolerance. Increased tolerance to high sucrose could also be indicative of effects on sugar sensing. Overexpression of G2153 produced no consistent effects on *Arabidopsis* morphology, and no altered phenotypes were noted in any of the biochemical assays.

Potential Applications

G2153 or its equivalogs can be used to alter a plant's response to water deficit conditions and, therefore, could be used to engineer plants with enhanced tolerance to drought, salt stress, and freezing.

G2153 or its equivalogs may also be useful for altering a plant's response to sugars.

G2155 (SEQ ID NO: 419)

Published Information

The sequence of G2155 was obtained from *Arabidopsis* genomic sequencing project, GenBank accession number AC012188, based on its sequence similarity within the conserved domain to other AT-hook related proteins in *Arabidopsis*.

Closely Related Genes from Other Species

G2155 protein shows extensive sequence similarity with *Medicago truncatula* cDNA clones (BG646893 and BG647027) and a *Glycine max* cDNA clone (BI426899).

Experimental Observations

The complete sequence of G2155 was determined. G2155 expression was detected at low levels only in flowers and embryos. It was not induced in rosette leaves by any condition tested.

The function of this gene was analyzed using transgenic plants in which G2155 was expressed under the control of the 35S promoter. Overexpression of G2155 produced a marked delay in the time to flowering. Under continuous light conditions, 35S::G2155 transformants displayed a considerable extension of vegetative development, and typically formed flower buds about two weeks later than wild-type controls. At early stages, the plants were slightly small and had rather rounded leaves compared to wild type. However, later in development, when the leaves were fully expanded, 35S::G2155 plants became very large, dark-green, and senesced much later than controls.

In addition, overexpression of G2155 resulted in an increase in seed glucosinolate M39497 in two T2 lines. No other phenotypic alterations were observed in any of the biochemical or physiological assays.

Potential Applications

G2155 or equivalog overexpression may be used to delay flowering.

G2155 or its equivalogs could also be used to alter seed glucosinolate composition.

G2192 (SEQ ID NO: 421)

Published Information

G2192 was identified in the sequence of BAC T19F6, GenBank accession number AC002343, released by the *Arabidopsis* Genome Initiative.

Closely Related Genes from Other Species

G2192 is very similar to a rice gene on clone P0708G2, accession number AP001539, released as part of the rice genome sequencing project. Homology between G2192 and this rice gene extends well beyond the conserved domain and thus the two genes may be orthologs.

Experimental Observations

The annotation of G2192 in BAC AC002343 was experimentally determined. The function of this gene was analyzed using transgenic plants in which G2192 was expressed under the control of the 35S promoter. Overexpression of G2192 in *Arabidopsis* resulted in an decrease in 18:3 fatty acid in seeds in two T2 lines. These lines also showed changes in 16:0, 18:0 and 18:2 fatty acids.

G2192 appeared to be constitutively expressed in all tissues and environmental conditions tested.

Potential Applications

G2192 or its equivalogs may have utility to alter seed fatty acid composition, which would be of significant nutritional value.

G2295 (SEQ ID NO: 423)

Published Information

G2295 corresponds to gene K19M22.9 (BAB09634).

Experimental Observations

The function of G2295 was studied using transgenic plants in which the gene was expressed under the control of the 35S promoter. Overexpression of G2295 accelerated flowering by up to one week under 24-hour light conditions. Early flowering was apparent in all plants from two independent 35S::G2295 T2 lines in each of two separate sowings. Additionally, these plants had rather flat leaves compared to wild type. In the T1 generation, five of twenty lines also flowered markedly earlier than controls.

According to the results obtained in the RT-PCR experiments, G2295 was specifically expressed in embryo and silique tissues. It was not clear whether the alterations in flowering time observed in the 35S::G2295 overexpressors reflected the true function of the gene. There have already been cases described of *Arabidopsis* transcription factor genes that are specifically expressed in flower-derived tissues but that can affect flowering time when their expression pattern is modified, including a homeobox gene long considered representing a true flowering time locus, FWA. Similar examples have been found (e.g., G183).

35S::G2295 plants were wild-type in the physiological and biochemical analyses that were performed.

Potential Applications

G2295 or its equivalogs could be used to modify flowering time characteristics. In addition, the promoter of the gene could be used to drive embryo/silique-specific gene expression.

G2340 (SEQ ID NO: 425)

Published Information

G2340 is a member of the (R1)R2R3 subfamily of MYB transcription factors. G2340 corresponds to gene At1g74080 (AAK54746), and is also referred to as MYB122.

Closely Related Genes from Other Species

G2340 shows sequence similarity with known genes from other plant species within the conserved Myb domain.

Experimental Observations

G2340 (SEQ ID NO: 425) was analyzed using transgenic plants in which the gene was expressed under the control of the 35S promoter. Overexpression of G2340 produced a spectrum of deleterious effects on *Arabidopsis* growth and development. 35S::G2340 primary transformants were generally smaller than controls, and at early stages some displayed leaves that were held in a vertical orientation. The most severely affected lines died at early stages. Others survived, but displayed necrosis of the blades in later rosette leaves and cauline leaves. Inflorescence development was also highly abnormal; stems were typically shorter than wild type, often 'kinked' at nodes, and the tissue had a rather fleshy succulent appearance. Flower buds were frequently poorly formed, failed to open and withered away without siliques developing. Additionally, secondary shoot growth frequently failed the tips of such structures sometimes senesced. Due to these abnormalities, many of the primary transformants were completely infertile. Three T1 lines with a relatively weak phenotype, which did set some seed, were selected for further study. Plants from one T2-population displayed a strong phenotype, and died early in development. The other two T2 populations were slightly small, but the effects were much weaker than those seen in the parental plants, suggesting that activity of the transgene might have become reduced between the generations. It should be noted that G2340 and G671 are part of the same clade and that they had very similar morphological phenotypes and a similar expression pattern. These two genes may have overlapping or redundant phenotypes in the plant. Small, pale seedlings with strap-like leaves that held a vertical orientation were found in the mixed line populations of 35S::G2340 transgenic seedlings when grown under sterile conditions, similar to those observed in soil grown plants in the T1 generation. The necrotic lesions observed on the T1 plants grown in soil were not observed on the plants grown in culture. The necrotic lesion phenotype is a classic lesion mimic phenotype and would suggest that G2340 is involved in cell death responses, or alternatively G2340 overexpressor plants are hypersensitive to stresses. One class of lesion mimic forms progressive lesions following an inductive stress. Lesion formation may be induced in G2340 overexpressing plants grown in culture. In addition to the morphological changes, overexpression of G2340 resulted in an extreme alteration in seed glucosinolate profile. This phenotype was observed in one line in seed from two independent plantings. According to RT-PCR analysis, G2340 was expressed primarily in roots and was slightly induced in leaf tissue in response to auxin and heat treatments.

Potential Applications

G2340 or its equivalogs can be used to engineer plants with an inducible cell death response. A gene that regulates cell death in plants can be used to induce a pathogen protective hyper-response (HR) in plants without the potentially detrimental consequences of a constitutive systemic acquired resistance (SAR). Other potential utilities include the creation of novel abscission zones or inducing death in reproductive organs to prevent the spread of pollen, transgenic or otherwise. In the case of necrotrophic pathogens that rely on dead plant tissue as a source of nutrients, prevention of cell death could confer tolerance to these diseases. Overexpression of G2340 in *Arabidopsis* also resulted in an extreme alteration in seed glucosinolate profile. Therefore, the gene or its equivalogs can be used to alter glucosinolate composition in plants.

G2343 (SEQ ID NO: 427)
Published Information

G2343 is a member of the R2-R3 subfamily of Myb transcription factors. The gene was identified as part of BAC T12P18, accession number AC010852, released by the *Arabidopsis* Genome Initiative. A cDNA sequence corresponding to G2343 was submitted to GenBank, accession number AF214116, with the gene name MYB103.

Closely Related Genes from Other Species

The most related gene to G2343 is tomato gene LETHM1 (CAA64615). Similarity between G2343 and LETHM1 extends beyond the signature motif of the family to a level that would suggest the genes are orthologs.

Experimental Observations

The complete sequence of G2343 (SEQ ID NO: 427) was determined and G2343 was analyzed using transgenic plants in which G2343 was expressed under the control of the 35S promoter. The phenotype of these transgenic plants was wild-type in all assays performed. As determined by RT-PCR, G2343 was expressed in shoots, embryos and siliques. G2343 expression was induced in rosette leaves by auxin, heat stress, and infection by *Fusarium oxysporum*.

As measured by NIR, G2343 overexpressors had altered seed oil content compared to wild-type plants.

Potential Applications

G2343 or equivalog overexpression may be used to alter seed oil content, which may be very important for the nutritional value and production of various food products G2346 (SEQ ID NO: 429)
Published Information G2346 was identified in the sequence of BAC clone T10K17, GenBank accession number AL132977, released by the *Arabidopsis* Genome Initiative Closely Related Genes from Other Species G2346 shows sequence similarity with known genes from other plant species within the conserved SBP domain.

Experimental Observations

G2346 (SEQ ID NO: 429) was analyzed using transgenic plants in which the gene was expressed under the control of the 35S promoter. 35S::G2346 seedlings from all three T2 populations had larger cotyledons and were more advanced than controls. This indicated that the seedlings developed more rapidly that the control plants. At later stages, however, G2346 overexpressing plants showed no consistent differences from control plants. The phenotype of these transgenic plants was wild-type in all other assays performed. According to RT-PCR analysis, G2346 was expressed ubiquitously.

Potential Applications

G2346 or its equivalogs can be used to produce plants that develop more quickly, particularly at early stages. For almost all commercial crops, it is desirable to use plants that establish more quickly, since seedlings and young plants are particularly susceptible to stress conditions such as salinity or disease. Since many weeds may outgrow young crops or outcompete them for nutrients, it would also be desirable to determine means for allowing young crop plants to out compete weed species. Increasing seedling growth rate (emergence) contributes to seedling vigor and allows for crops to be planted earlier in the season with less concern for losses due to environmental factors. Early planting helps add days to the critical grain-filling period and increases yield.

G2347 (SEQ ID NO: 431)
Published Information

G2347 is a member of the SBP family of transcription factors and corresponds to sp15 (Cardon et al., 1999). Expression of sp15 is up-regulated in seedlings during development under both long day and short day conditions and is highly expressed in the inflorescence tissue. Expression of G2347 is specifically localized in the inflorescence apical meristem and young flowers (Cardon et al. (1999) *Gene* 237: 91-104).

Closely Related Genes from Other Species

The closest relative to G2347 is the *Antirrhinum* protein, SBP2 (CAA63061). The similarity between these two proteins is extensive enough to suggest they might have similar functions in a plant.

Experimental Observations

G2347 (SEQ ID NO: 431) was analyzed using transgenic plants in which G2347 was expressed under the control of the 35S promoter. Overexpression of G2347 markedly reduced the time to flowering in *Arabidopsis*. This phenotype was apparent in the majority of primary transformants and in all plants from two out of the three T2 lines examined. Under continuous light conditions, 35S::G2347 plants formed flower buds up a week earlier than wild type. Many of the plants were rather small and spindly compared to controls. To demonstrate that overexpression of G2347 could induce flowering under less inductive photoperiods, two T2 lines were re-grown in 12 hour conditions; again, all plants from both lines bolted early, with some initiating flower buds up to two weeks sooner than wild type. As determined by RT-PCR, G2347 was highly expressed in rosette leaves and flowers, and to much lower levels in embryos and siliques. No expression of G2347 was detected in the other tissues tested. G2347 expression was repressed by cold, and by auxin treatments and by infection by *Erysiphe*. G2347 is also highly similar to the *Arabidopsis* protein G2010. The level of homology between these two proteins suggested they could have similar, overlapping, or redundant functions in *Arabidopsis*. In support of this hypothesis, overexpression of both G2010 and G2347 resulted in early flowering phenotypes in transgenic plants.

Potential Applications

G2347 or its equivalogs may be used to modify the time to flowering in plants.

G2379 (SEQ ID NO: 433)

Published Information

G2379 was identified in the sequence of BAC MOP10, GenBank accession number AB005241, released by the *Arabidopsis* Genome Initiative.

Experimental Observations

The annotation of G2379 in BAC AB005241 was experimentally confirmed. The function of this gene was analyzed using transgenic plants in which G2379 was expressed under the control of the 35S promoter. G2379 overexpressing plants showed increased seedling vigor when grown on media containing elevated sucrose levels. This phenotype might be indicative of either altered sugar sensing or increased tolerance of osmotic stress. No altered morphological or biochemical phenotypes were observed. G2379 appeared to be constitutively expressed in all tissues and environmental conditions tested.

Potential Applications

G2379 or its equivalogs could be used to alter a plant's response to water deficit conditions and, therefore, could be used to engineer plants with enhanced tolerance to drought, salt stress, and freezing.

G2379 or its equivalogs may also be useful for altering a plant's response to sugars.

G2430 (SEQ ID NO: 435)

Published Information

G2430 was identified in the sequence of BAC F27J15, GenBank accession number AC016041, released by the *Arabidopsis* Genome Initiative.

Closely Related Genes from Other Species

G2430 has similarity within of the conserved GARP and response-regulator domains to non-*Arabidopsis* proteins.

Experimental Observations

The complete sequence of G2430 (SEQ ID NO: 435) was determined. G2430 is a member of the response regulator class of GARP proteins (ARR genes), although one of the two conserved aspartate residues characteristic of response regulators is not present. The second aspartate, the putative phosphorylated site, is retained so G2430 can have response regulator function. G2430 was specifically expressed in embryo and silique tissue. G2430 can regulate plant growth; in morphological analyses, plants overexpressing G2430 showed more rapid growth than control plants at early stages, and in two of three lines examined produced large, flat leaves. Early flowering was observed for some lines, but this effect was inconsistent between plantings.

Overexpression of G2430 in *Arabidopsis* resulted in seedlings that are more tolerant to heat in a germination assay. Seedlings from G2430 overexpressing transgenic plants were greener than the control seedlings under high temperature conditions. These observations were repeated in subsequent experiments.

Potential Applications

G2430 or its equivalogs may be used to create crops with better germination under hot conditions. The germination of many crops is very sensitive to temperature. A gene that would enhance germination in hot conditions may be useful for crops that are planted late in the season or in hot climates.

G2430 or its equivalogs can be used to promote faster development and reproduction in plants.

G2505 (SEQ ID NO: 437)

Published Information

G2505 was identified in the sequence of contig fragment No. 29, GenBank accession number AL161517, released by the *Arabidopsis* Genome Initiative.

Experimental Observations

Analysis of the function of G2505 was attempted through the generation transgenic plants in which the gene was expressed under the control of the 35S promoter. Numerous attempts were required to obtain 35S::G2505 transformants; thus, overexpression of this gene likely caused lethality during embryo or early seedling development. The transformants that were obtained exhibited improved drought stress tolerance compared to control plants.

G2505 was expressed in all tissues except shoots and rosette leaves according to RT-PCR. No induction of G2505 expression in leaf tissue was detected in response to environmental stress related conditions.

Potential Applications

G2505 or its equivalogs could be used to engineer drought hardiness into seeds or plants, thus providing for improved survival, vigor, appearance, and/or yield in drought stress conditions.

G2509 (SEQ ID NO: 439)

Published Information

G2509 corresponds to gene T2I1_20 (CAB87920).

Closely Related Genes from Other Species

G865 and other non-*Arabidopsis* AP2/EREBP proteins were similar within the conserved AP2 domain.

Experimental Observations

G2509 (SEQ ID NO: 439) was studied using transgenic plants in which the gene was expressed under the control of the 35S promoter. Overexpression of G2509 caused multiple alterations in plant growth and development, most notably, altered branching patterns, and a reduction in apical dominance, giving the plants a shorter, more bushy stature than wild type. Twenty 35S::G2509 primary transformants were examined; at early stages of rosette development, these plants displayed a wild-type phenotype. However, at the switch to flowering, almost all T1 lines showed a marked loss of apical dominance and large numbers of secondary shoots developed from axils of primary rosette leaves. In the most extreme cases, the shoots had very short internodes, giving the inflorescence a very bushy appearance. Such shoots were often very thin and flowers were relatively small and poorly fertile. At later stages, many plants appeared very small and had a low seed yield compared to wild type. In addition to the effects on branching, a substantial number of 35S::G2509 primary transformants also flowered early and had buds visible several days prior to wild type. Similar effects on inflorescence development were noted in each of three T2 populations examined. The branching and plant architecture phenotypes observed in 35S::G2509 lines resemble phenotypes observed for three other AP2/EREBP genes: G865, G1411, and G1794, G2509, G865, and G1411 form a small clade within the large AP2/EREBP family, and G1794, although not belonging to the clade, is one of the AP2/EREBP genes closest to it in the phylogenetic tree. It is thus likely that all these genes share a related function, such as affecting hormone balance.

G2509 overexpressing plants had increased seed protein compared to wild-type control plants.

Overexpression of G2509 in *Arabidopsis* resulted in an increase in alpha-tocopherol in seeds in two T2 lines. G2509 was ubiquitously expressed in *Arabidopsis* plant tissue. G2509 expression levels were altered by a variety of environmental or physiological conditions.

Potential Applications

G2509 or its equivalogs can be used to manipulate plant architecture and development.

G2509 or its equivalogs can be used to alter tocopherol composition.

G2509 or its equivalogs can be useful in altering flowering time.

G2517 (SEQ ID NO: 441)

Published Information

G2517 corresponds to gene T12C14_40 (CAB82948).

Closely Related Genes from Other Species

G2517 shows sequence similarity with known genes from other plant species within the conserved WRKY domain.

Experimental Observations

G2517 (SEQ ID NO: 441) was studied using transgenic plants in which the gene was expressed under the control of the 35S promoter. Overexpression of G2517 caused alterations in plant growth and development: size variation was apparent in the 35S::G2517 T1 generation, with at least half the lines being very small. Additionally, four of twelve T1 plants formed flower buds marginally earlier than wild type. Three T1 lines were examined in the T2 generation, and all three T2 populations were slightly smaller than controls. In the physiological analysis of the T2 populations, G2517 overexpressing lines were more resistant to the herbicide glyphosate.

Potential Applications

G2517 or its equivalogs can be used for the generation of glyphosate resistant plants, and to increase plant resistance to oxidative stress.

G2520 (SEQ ID NO: 443)

Published Information

The sequence of G2520 was obtained from *Arabidopsis* genomic sequencing project, GenBank accession number AC009317, based on its sequence similarity within the conserved domain to other bHLH related proteins in *Arabidopsis*.

Closely Related Genes from Other Species

G2520 shows sequence similarity with known genes from other plant species within the conserved basic HLH domain.

Experimental Observations

G2520 (SEQ ID NO: 443) was analyzed using transgenic plants in which G2520 was expressed under the control of the 35S promoter. At early stages, 35S::G2520 transformants displayed abnormal curled cotyledons, long hypocotyls, and rather short roots. During the vegetative phase, these plants formed somewhat small flat leaves. Following the switch to reproductive growth, 35S::G2520 inflorescences were typically very spindly, slightly pale colored, and stems often split open at late stages. Flowers were frequently small with narrow organs and showed poor pollen production. As a result, the seed yield from 35S::G2520 plants was low compared to wild-type controls. These effects were observed in the majority of primary transformants, and to varying extents, in all three of the T2 populations. Overexpression of G2520 also resulted in an increase in the leaf glucosinolate M39478 in two lines. In addition, these lines showed an increase in seed delta-tocopherol and a decrease in seed gamma-tocopherol. No altered phenotypes were detected in any of the physiological assays. G2520 was expressed throughout the plant and was induced by ABA, heat, salt, drought and osmotic stress.

Potential Applications

G2520 or its equivalogs may be useful for manipulating plant development and altering leaf glucosinolate composition.

G2520 or its equivalogs can also be used to modify seed tocopherol composition.

G2555 (SEQ ID NO: 445)

Published Information

The sequence of G2555 was obtained from *Arabidopsis* genomic sequencing project, GenBank accession number AC023064, based on its sequence similarity within the conserved domain to other bHLH related proteins in *Arabidopsis*. G2555 corresponds to gene At1g35460/F12A4_2 (AAG52112).

Experimental Observations

The complete sequence of G2555 was determined. G2555 was expressed throughout the plant, with the highest levels being detected in shoots, flowers, rosette leaves, siliques, and germinating seed. It was not significantly induced or repressed by any condition tested.

The function of this gene was analyzed using transgenic plants in which G2555 was expressed under the control of the 35S promoter. Overexpression of G2555 in *Arabidopsis* resulted in a small decrease in the time to flowering. Under continuous light conditions, 35S::G2555 transformants produced flower buds and bolted approximately two to five days earlier than wild-type controls. Such effects were readily visible in seven of twenty primary transformants and all plants from two of the three T2 populations. The third T2 population had only two of six plants that flowered early.

G2555 overexpressing seedlings showed open cotyledons when grown in the dark, indicating that G2555 may affect photomorphogenesis. This phenotype could be related to the early flowering noted in morphology, if G2555 is involved in light regulation of development. G2555 plants also showed increased sensitivity to infection by the necrotrophic fungal pathogen *Botrytis cinerea*. In repeat experiments on individual lines, all G2555 overexpressing lines showed similar phenotypes. No altered phenotypes were detected in any of the biochemical assays.

Potential Applications

G2555 or its equivalogs may be useful for accelerating flowering time in crop plants.

Since G2555 transgenic plants have an altered response to the fungal pathogen *Botrytis cinerea*, G2555 or its equivalogs might be used to manipulate the defense response in order to generate pathogen-resistant plants. G2555 or its equivalogs may also be useful for altering some aspect of light-regulated development.

G2557 (SEQ ID NO: 447)

Published Information

The sequence of G2557 was obtained from *Arabidopsis* genomic sequencing project, GenBank accession number AP001305, based on its sequence similarity within the conserved domain to other bHLH related proteins in *Arabidopsis*.

Closely Related Genes from Other Species

G2557 protein shows extensive sequence similarity in the region of basic helix loop helix with a protein encoded by *Glycine max* cDNA clone (BE347811).

Experimental Observations

G2557 (SEQ ID NO: 447) is a member of a clade of highly related HLH/MYC proteins that also includes G779, G1063, G1499, and G2143. All of these genes caused similar pleiotropic phenotypic effects when overexpressed, the most striking of which was the production of ectopic carpelloid tissue. These genes can be considered key regulators of carpel development. The flowers of 35S::G2557 primary transformants displayed patches of stigmatic papillae on the sepals, and often had rather narrow petals and poorly developed stamens. Additionally, carpels were also occasionally held outside of the flower at the end of an elongated pedicel like structure. As a result of such defects, 35S::G2557 plants often showed very poor fertility and formed small wrinkled siliques. In addition to such floral abnormalities, the majority of primary transformants were also small and darker green in coloration than wild type. Approximately one third of the T1 plants were extremely tiny and completely sterile. Three T1 lines that had produced some seeds and showed a relatively weak phenotype were chosen for further study. All three of the T2 populations from these lines contained plants that were distinctly small, had abnormal flowers, and were poorly fertile compared to controls. Stigmatic tissue was not noted on the sepals of plants from these three T2 lines. Another line that had shown a moderately strong phenotype in the T1 was sown for only morphological analysis in the T2 generation. These T2 plants were small, dark green, and produced abnormal flowers with ectopic stigmatic tissue on the sepals, as had been seen in the parental plant. G2557 expression was detected at low to moderate levels in all tissues tested except shoots. G2557 was induced by cold, heat, and salt, and repressed by pathogen infection Potential Applications G2557 or its equivalogs can be used to manipulate flower form and structure or plant fertility. One application for manipulation of flower structure can be in the production of saffron, which is derived from the stigmas of *Crocus sativus*.

G2583 (SEQ ID NO: 449)

Published Information

G2583 corresponds to gene F2I11_80 (CAB96654).

Closely Related Genes from Other Species

G2583 showed sequence similarity with known genes from other plant species within the conserved AP2/EREBP domain.

Experimental Observations

G2583 (SEQ ID NO: 449) was studied using transgenic plants in which the gene was expressed under the control of the 35S promoter. 35S::G2583 plants exhibited extremely glossy leaves. At early stages, 35S::G2583 seedlings appeared normal, but by about two weeks after sowing, the plants exhibited very striking shiny leaves, which were apparent until very late in development. Many lines displayed a variety of other effects such as a reduction in overall size, narrow curled leaves, or various non-specific floral abnormalities, which reduced fertility. These effects on leaf appearance were observed in eighteen of twenty primary transformants, and in all the plants from four of six of the T2 lines examined. The glossy nature of the leaves from 35S::G2583 plants may be a consequence of changes in epicuticular wax content or composition. G2583 belongs to a small clade within the large AP2/EREBP *Arabidopsis* family that also contains G975, G1387, and G977. Overexpression of G975 caused a substantial increase in leaf wax components, as well as morphological phenotypes resembling those observed in 35S::G2583 plants. G2583 was ubiquitously expressed, at higher levels in root, flower, embryo, and silique tissues.

Potential Applications

G2583 or its equivalogs can be used to modify plant appearance by producing shiny leaves. In addition, it or its equivalogs can be used to manipulate wax composition, amount, or distribution, which in turn can modify plant tolerance to drought and/or low humidity or resistance to insects.

G2701 (SEQ ID NO: 451)

Published Information

G2701 was identified in the sequence of BAC F11B9, GenBank accession number AC073395, released by the *Arabidopsis* Genome Initiative.

Experimental Observations

The function of G2701 was analyzed using transgenic plants in which the gene was expressed under the control of the 35S promoter. Overexpression of G2701 is *Arabidopsis* resulted in plants that were wild-type in morphology and in the biochemical analyses performed. However, 35S::G2701 transgenic plants were more tolerant to osmotic stress in a germination assay, the seedlings were greener with expanded cotyledons and longer roots than wild-type controls when germinated on plates containing either high salt or high sucrose. The phenotype was repeated in all three lines.

G2701 was expressed ubiquitously in *Arabidopsis* according to RT-PCR, and the level of G2701 expression in leaf tissue was essentially unchanged in response to environmental stress related conditions.

Potential Applications

G2701 or its equivalogs could be used to alter a plant's response to water deficit conditions and therefore, could be used to engineer plants with enhanced tolerance to drought, salt stress, and freezing.

G2719 (SEQ ID NO: 453)
Published Information
G2719 is a member of the (R1)R2R3 subfamily of MYB transcription factors. G2719 corresponds to gene At3g55730 (AAF72669), and is also referred to as MYB109.
Experimental Observations
The function of G2719 was analyzed using transgenic plants in which the gene was expressed under the control of the 35S promoter. Overexpression of G2719 in *Arabidopsis* resulted in plants with increased seedling vigor in a germination assay on media containing high sucrose. This phenotype could implicate G2719 in sugar sensing and/or osmotic stress tolerance. These observations were seen in repeat experiments. 35S::G2719 transgenic plants were wild-type in morphology and in the biochemical analyses performed.

G2719 was expressed ubiquitously in *Arabidopsis* according to RT-PCR, and the level of G2719 expression in leaf tissue was essentially unchanged in response to environmental stress related conditions.
Potential Applications
G2719 or its equivalogs could be used to alter a plant's response water deficit conditions and therefore, could be used to engineer plants with enhanced tolerance to drought, salt stress, and freezing.

In addition, G2719 or its equivalogs could be involved in sugar sensing pathways.

G2789 (SEQ ID NO: 455)
Published Information
The sequence of G2789 was obtained from *Arabidopsis* genomic sequencing project, GenBank accession number AL162295, based on its sequence similarity within the conserved domain to other AT-hook related proteins in *Arabidopsis*. G2789 corresponds to gene T4C21_280 (CAB82691).
Closely Related Genes from Other Species
G2789 protein shows extensive sequence similarity with *Medicago truncatula* cDNA clones (AL366947 and BG647144), an *Oryza sativa* chromosome 6 clone (AP003526) and a tomato crown gall *Lycopersicon esculentum* cDNA clone (BG134451).
Experimental Observations
The complete sequence of G2789 was determined. G2789 was expressed at moderate levels in roots, flowers, embryos, siliques, and germinating seeds. It was not detectable in rosette leaves or shoots. No significant induction of G2789 was observed in rosette leaves by any condition tested.

The function of this gene was analyzed using transgenic plants in which G2789 was expressed under the control of the 35S promoter. Overexpression of G2789 in *Arabidopsis* resulted in seedlings that are ABA insensitive and osmotic stress tolerant. In a germination assay on ABA containing media, G2789 transgenic seedlings showed enhanced seedling vigor. In a similar germination assay on media containing high concentrations of sucrose, the G2789 overexpressors also showed enhanced seedling vigor. In a repeat experiment on individual lines, all three lines showed the phenotype. The combination of ABA insensitivity and better germination under osmotic stress was also observed for G1820, G926, and G2140. It is possible that ABA insensitivity at the germination stage promoted germination despite unfavorable conditions.

Overexpression of G2789 produced alterations in leaf and flower development, and caused severe reductions in fertility. 35S::G2789 primary transformants displayed a variety of leaf abnormalities including; leaf curling, serrations, and changes in leaf shape and area. The most severely affected individuals grew slowly and were often very tiny compared with wild type. During the reproductive phase, most of the lines showed non-specific defects in flower formation; organs were frequently absent or poorly developed. As a result of such deficiencies, most of the T1 plants yielded very few seed. A comparable phenotype to that seen in the T1 was observed in two of the three T2 lines. Some plants from each of these two populations showed a somewhat attenuated phenotype, suggesting that the transgene might be becoming silenced. Plants from the third line appeared wild type in both the T1 and T2 generations.

Overexpression of G2789 in *Arabidopsis* did not result in any biochemical phenotypic alteration.
Potential Applications
G2789 or its equivalogs could be used to alter a plant's response to water deficit conditions and therefore, could be used to engineer plants with enhanced tolerance to drought, salt stress, and freezing.

G2830 (SEQ ID NO: 457)
Published Information
G2830 was identified in the sequence of P1 clone MFO20, GenBank accession number AB013391, released by the *Arabidopsis* Genome Initiative.
Experimental Observations
G2830 was primarily expressed at a low level in embryos and siliques as determined by RT-PCR analysis. Expression of G2830 was not detected in other tissues. A line homozygous for a T-DNA insertion in G2830 was used to determine the function of this gene. The T-DNA insertion of G2830 was approximately one quarter into the coding sequence of the gene and therefore is likely to result in a null mutation.

The G2830 knockouts were found to produce more seed oil than wild-type plants.
Potential Applications
G2830 or its equivalogs can used to increase seed oil content, which would be of value for modifying the nutritional value and caloric content of food for human consumption as well as animal feeds, and may be of value in improving seed storage characteristics.

Because expression of G2830 is embryo and silique specific, its promoter could be useful for targeted gene expression in these tissues.

Example IX

Identification of Homologous Sequences

This example describes identification of genes that are orthologous to *Arabidopsis thaliana* transcription factors from a computer homology search.

Homologous sequences, including those of paralogs and orthologs from *Arabidopsis* and other plant species, were identified using database sequence search tools, such as the Basic Local Alignment Search Tool (BLAST) (Altschul et al. (1990) J. Mol. Biol. 215: 403-410; and Altschul et al. (1997) *Nucleic Acid Res.* 25: 3389-3402). The tblastx sequence analysis programs were employed using the BLOSUM-62 scoring matrix (Henikoff and Henikoff (1992) *Proc Natl. Acad. Sci.* 89: 10915-10919). The entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*).

These sequences are compared to sequences representing genes of SEQ ID NO: 2N−1, wherein N=1-229, using the Washington University TBLASTX algorithm (version 2.0a19MP) at the default settings using gapped alignments with the filter "off". For each gene of SEQ ID NO: 2N−1, wherein N=1-229, individual comparisons were ordered by probability score (P-value), where the score reflects the probability that a particular alignment occurred by chance. For example, a score of 3.6e-40 is $3.6 \times 10^{-40}$. In addition to P-values, comparisons were also scored by percentage identity. Percentage identity reflects the degree to which two segments of DNA or protein are identical over a particular length. Examples of sequences so identified are presented in Table 7 and Table 9. Paralogous or orthologous sequences were readily identified and available in GenBank by Accession number (Table 7; Test sequence ID). The percent sequence identity among these sequences can be as low as 47%, or even lower sequence identity. Candidate paralogous sequences were identified among *Arabidopsis* transcription factors through alignment, identity, and phylogenic relationships. A list of paralogs is shown in Table 9. Candidate orthologous sequences were identified from proprietary unigene sets of plant gene sequences in *Zea mays, Glycine max* and *Oryza sativa* based on significant homology to *Arabidopsis* transcription factors. These candidates were reciprocally compared to the set of *Arabidopsis* transcription factors. If the candidate showed maximal similarity in the protein domain to the eliciting transcription factor or to a paralog of the eliciting transcription factor, then it was considered to be an ortholog. Identified non-*Arabidopsis* sequences that were shown in this manner to be orthologous to the *Arabidopsis* sequences are provided in Table 7.

Example X

Screen of Plant cDNA Library for Sequence Encoding a Transcription Factor DNA Binding Domain that Binds to a Transcription Factor Binding Promoter Element and Demonstration of Protein Transcription Regulation Activity The "one-hybrid" strategy (Li and Herskowitz (1993) *Science* 262: 1870-1874) is used to screen for plant cDNA clones encoding a polypeptide comprising a transcription factor DNA binding domain, a conserved domain. In brief, yeast strains are constructed that contain a lacZ reporter gene with either wild-type or mutant transcription factor binding promoter element sequences in place of the normal UAS (upstream activator sequence) of the GAL1 promoter. Yeast reporter strains are constructed that carry transcription factor binding promoter element sequences as UAS elements are operably linked upstream (5') of a lacZ reporter gene with a minimal GAL1 promoter. The strains are transformed with a plant expression library that contains random cDNA inserts fused to the GAL4 activation domain (GAL4-ACT) and screened for blue colony formation on X-gal-treated filters (X-gal: 5-bromo-4-chloro-3-indolyl-β-D-galactoside; Invitrogen Corporation, Carlsbad Calif.). Alternatively, the strains are transformed with a cDNA polynucleotide encoding a known transcription factor DNA binding domain polypeptide sequence.

Yeast strains carrying these reporter constructs produce low levels of beta-galactosidase and form white colonies on filters containing X-gal. The reporter strains carrying wild-type transcription factor binding promoter element sequences are transformed with a polynucleotide that encodes a polypeptide comprising a plant transcription factor DNA binding domain operably linked to the acidic activator domain of the yeast GAL4 transcription factor, "GAL4-ACT". The clones that contain a polynucleotide encoding a transcription factor DNA binding domain operably linked to GLA4-ACT can bind upstream of the lacZ reporter genes carrying the wild-type transcription factor binding promoter element sequence, activate transcription of the lacZ gene and result in yeast forming blue colonies on X-gal-treated filters.

Upon screening about $2 \times 10^6$ yeast transformants, positive cDNA clones are isolated; i.e., clones that cause yeast strains carrying lacZ reporters operably linked to wild-type transcription factor binding promoter elements to form blue colonies on X-gal-treated filters. The cDNA clones do not cause a yeast strain carrying a mutant type transcription factor binding promoter elements fused to LacZ to turn blue. Thus, a polynucleotide encoding transcription factor DNA binding domain, a conserved domain, is shown to activate transcription of a gene.

Example XI

Gel Shift Assays

The presence of a transcription factor comprising a DNA binding domain which binds to a DNA transcription factor binding element is evaluated using the following gel shift assay. The transcription factor is recombinantly expressed and isolated from *E. coli* or isolated from plant material. Total soluble protein, including transcription factor, (40 ng) is incubated at room temperature in 10 μl of 1× binding buffer (15 mM HEPES (pH 7.9), 1 mM EDTA, 30 mM KCl, 5% glycerol, 5% bovine serum albumin, 1 mM DTT) plus 50 ng poly(dI-dC):poly(dI-dC) (Pharmacia, Piscataway N.J.) with or without 100 ng competitor DNA. After 10 minutes incubation, probe DNA comprising a DNA transcription factor binding element (1 ng) that has been $^{32}$P-labeled by end-filling (Sambrook et al. (1989) supra) is added and the mixture incubated for an additional 10 minutes. Samples are loaded onto polyacrylamide gels (4% w/v) and fractionated by electrophoresis at 150V for 2 h (Sambrook et al. supra). The degree of transcription factor-probe DNA binding is visualized using autoradiography. Probes and competitor DNAs are prepared from oligonucleotide inserts ligated into the BamHI site of pUC118 (Vieira et al. (1987) *Methods Enzymol.* 153: 3-11). Orientation and concatenation number of the inserts are determined by dideoxy DNA sequence analysis (Sambrook et al. supra). Inserts are recovered after restriction digestion with EcoRI and HindIII and fractionation on polyacrylamide gels (12% w/v) (Sambrook et al. supra).

Example XII

Introduction of Polynucleotides into Dicotyledonous Plants

Transcription factor sequences listed in the Sequence Listing recombined into pMEN20 or pMEN65 expression vectors are transformed into a plant for the purpose of modifying plant traits. The cloning vector may be introduced into a variety of cereal plants by means well known in the art such as, for example, direct DNA transfer or *Agrobacterium tumefaciens*-mediated transformation. It is now routine to produce transgenic plants using most dicot plants (see Weissbach and Weissbach, (1989) supra; Gelvin et al. (1990) supra; Herrera-Estrella et al. (1983) supra; Bevan (1984) supra; and Klee (1985) supra). Methods for analysis of traits are routine in the art and examples are disclosed above.

Example XIII

Transformation of Cereal Plants with an Expression Vector

Cereal plants such as, but not limited to, corn, wheat, rice, sorghum, or barley, may also be transformed with the present polynucleotide sequences in pMEN20 or pMEN65 expression vectors for the purpose of modifying plant traits. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art such as, for example, direct DNA transfer or *Agrobacterium tumefaciens*-mediated transformation. It is now routine to produce transgenic plants of most cereal crops (Vasil (1994) *Plant Mol. Biol.* 25: 925-937) such as corn, wheat, rice, sorghum (Cassas et al. (1993) *Proc. Natl. Acad. Sci.* 90: 11212-11216, and barley (Wan and Lemeaux (1994) *Plant Physiol.* 104:37-48. DNA transfer methods such as the microprojectile can be used for corn (Fromm et al. (1990) *Bio/Technol.* 8: 833-839); Gordon-Kamm et al. (1990) *Plant Cell* 2: 603-618; Ishida (1990) *Nature Biotechnol.* 14:745-750), wheat (Vasil et al. (1992) *Bio/Technol.* 10:667-674; Vasil et al. (1993) *Bio/Technol.* 11:1553-1558; Weeks et al. (1993) *Plant Physiol.* 102: 1077-1084), rice (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218). For most cereal plants, embryogenic cells derived from immature scutellum tissues are the preferred cellular targets for transformation (Hiei et al. (1997) *Plant Mol. Biol.* 35:205-218; Vasil (1994) *Plant Mol. Biol.* 25: 925-937).

Vectors according to the present invention may be transformed into corn embryogenic cells derived from immature scutellar tissue by using microprojectile bombardment, with the A188XB73 genotype as the preferred genotype (Fromm et al. (1990) *Bio/Technol.* 8: 833-839; Gordon-Kamm et al. (1990) *Plant Cell* 2: 603-618). After microprojectile bombardment the tissues are selected on phosphinothricin to identify the transgenic embryogenic cells (Gordon-Kamm et al. (1990) *Plant Cell* 2: 603-618). Transgenic plants are regenerated by standard corn regeneration techniques (Fromm et al. (1990) *Bio/Technol.* 8: 833-839; Gordon-Kamm et al. (1990) *Plant Cell* 2: 603-618).

The plasmids prepared as described above can also be used to produce transgenic wheat and rice plants (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218) that coordinately express genes of interest by following standard transformation protocols known to those skilled in the art for rice and wheat (Vasil et al. (1992) *Bio/Technol.* 10:667-674; Vasil et al. (1993) *Bio/Technol.* 11:1553-1558; and Weeks et al. (1993) *Plant Physiol.* 102:1077-1084), where the bar gene is used as the selectable marker.

Example XIV

Identification of Orthologous and Paralogous Sequences

Orthologs to *Arabidopsis* genes may identified by several methods, including hybridization, amplification, or bioinformatically. This example describes how one may identify equivalogs to the *Arabidopsis* AP2 family transcription factor CBF1 (polynucleotide SEQ ID NO: 1955, encoded polypeptide SEQ ID NO: 1956), which confers tolerance to abiotic stresses (Thomashow et al. (2002) U.S. Pat. No. 6,417,428), and an example to confirm the function of homologous sequences. In this example, orthologs to CBF1 were found in canola (*Brassica napus*) using polymerase chain reaction (PCR).

Degenerate primers were designed for regions of AP2 binding domain and outside of the AP2 (carboxyl terminal domain):

```
Mol 368 (reverse)
                                      (SEQ ID NO: 2205)
5'-CAY CCN ATH TAY MGN GGN GT-3'

Mol 378 (forward)
                                      (SEQ ID NO: 2206)
5'-GGN ARN ARC ATN CCY TCN GCC-3'

(Y: C/T, N: A/C/G/T, H: A/C/T, M: A/C, R: AG)
```

Primer Mol 368 is in the AP2 binding domain of CBF1 (amino acid sequence: His-Pro-Ile-Tyr-Arg-Gly-Val, SEQ ID NO: 2909) while primer Mol 378 is outside the AP2 domain (carboxyl terminal domain) (amino acid sequence: Met-Ala-Glu-Gly-Met-Leu-Leu-Pro, SEQ ID NO: 2910).

The genomic DNA isolated from *B. napus* was PCR-amplified by using these primers following these conditions: an initial denaturation step of 2 min at 93° C.; 35 cycles of 93° C. for 1 min, 55° C. for 1 min, and 72° C. for 1 min; and a final incubation of 7 min at 72° C. at the end of cycling.

The PCR products were separated by electrophoresis on a 1.2% agarose gel and transferred to nylon membrane and hybridized with the AT CBF1 probe prepared from *Arabidopsis* genomic DNA by PCR amplification. The hybridized products were visualized by colorimetric detection system (Boehringer Mannheim) and the corresponding bands from a similar agarose gel were isolated using the Qiagen Extraction Kit (Qiagen). The DNA fragments were ligated into the TA clone vector from TOPO TA Cloning Kit (Invitrogen) and transformed into *E. coli* strain TOP10 (Invitrogen).

Seven colonies were picked and the inserts were sequenced on an ABI 377 machine from both strands of sense and antisense after plasmid DNA isolation. The DNA sequence was edited by sequencer and aligned with the AtCBF1 by GCG software and NCBI blast searching.

The nucleic acid sequence and amino acid sequence of one canola ortholog found in this manner (bnCBF1; polynucleotide SEQ ID NO: 2203 and polypeptide SEQ ID NO: 2204) identified by this process is shown in the Sequence Listing.

The aligned amino acid sequences show that the bnCBF1 gene has 88% identity with the *Arabidopsis* sequence in the AP2 domain region and 85% identity with the *Arabidopsis* sequence outside the AP2 domain when aligned for two insertion sequences that are outside the AP2 domain.

Similarly, paralogous sequences to *Arabidopsis* genes, such as CBF1, may also be identified.

Two paralogs of CBF1 from *Arabidopsis thaliana*: CBF2 and CBF3. CBF2 and CBF3 have been cloned and sequenced as described below. The sequences of the DNA SEQ ID NO: 1957 and 1959 and encoded proteins SEQ ID NO: 1958 and 1960 are set forth in the Sequence Listing.

A lambda cDNA library prepared from RNA isolated from *Arabidopsis thaliana* ecotype Columbia (Lin and Thomashow (1992) *Plant Physiol.* 99: 519-525) was screened for recombinant clones that carried inserts related to the CBF1 gene (Stockinger et al. (1997) *Proc. Natl. Acad. Sci.* 94:1035-1040). CBF1 was $^{32}$P-radiolabeled by random priming (Sambrook et al. supra) and used to screen the library by the plaque-lift technique using standard stringent hybridization and wash conditions (Hajela et al. (1990) *Plant Physiol.* 93:1246-1252; Sambrook et al. supra) 6×SSPE buffer, 60° C. for hybridization and 0.1×SSPE buffer and 60° C. for washes). Twelve positively hybridizing clones were obtained and the DNA sequences of the cDNA inserts were determined. The results indicated that the clones fell into three classes. One class carried inserts corresponding to CBF1. The two other classes carried sequences corresponding to two different homologs of CBF1, designated CBF2 and CBF3. The nucleic acid sequences and predicted protein coding sequences for *Arabidopsis* CBF1, CBF2 and CBF3 are listed in the Sequence Listing (SEQ ID NOs: 1955, 1957, 1959 and SEQ ID NOs: 1956, 1958, 1960, respectively). The nucleic acid sequences and predicted protein coding sequence for *Brassica napus* CBF ortholog is listed in the Sequence Listing (SEQ ID NOs: 2203 and 2204, respectively).

A comparison of the nucleic acid sequences of *Arabidopsis* CBF1, CBF2 and CBF3 indicate that they are 83 to 85% identical as shown in Table 11.

TABLE 11

| | Percent identity[a] | |
|---|---|---|
| | DNA[b] | Polypeptide |
| cbf1/cbf2 | 85 | 86 |
| cbf1/cbf3 | 83 | 84 |
| cbf2/cbf3 | 84 | 85 |

[a]Percent identity was determined using the Clustal algorithm from the Megalign program (DNASTAR, Inc.).
[b]Comparisons of the nucleic acid sequences of the open reading frames are shown.

Similarly, the amino acid sequences of the three CBF polypeptides range from 84 to 86% identity. An alignment of the three amino acidic sequences reveals that most of the differences in amino acid sequence occur in the acidic C-terminal half of the polypeptide. This region of CBF1 serves as an activation domain in both yeast and *Arabidopsis* (not shown).

Residues 47 to 106 of CBF1 correspond to the AP2 domain of the protein, a DNA binding motif that to date, has only been found in plant proteins. A comparison of the AP2 domains of CBF1, CBF2 and CBF3 indicates that there are a few differences in amino acid sequence. These differences in amino acid sequence might have an effect on DNA binding specificity.

Example XV

Transformation of Canola with a Plasmid Containing CBF1, CBF2, or CBF3

After identifying homologous genes to CBF1, canola was transformed with a plasmid containing the *Arabidopsis* CBF1, CBF2, or CBF3 genes cloned into the vector pGA643 (An (1987) *Methods Enzymol.* 253: 292). In these constructs the CBF genes were expressed constitutively under the CaMV 35S promoter. In addition, the CBF1 gene was cloned under the control of the *Arabidopsis* COR15 promoter in the same vector pGA643. Each construct was transformed into *Agrobacterium* strain GV3101. Transformed Agrobacteria were grown for 2 days in minimal AB medium containing appropriate antibiotics.

Spring canola (*B. napus* cv. Westar) was transformed using the protocol of Moloney et al. (1989) *Plant Cell Reports* 8: 238, with some modifications as described. Briefly, seeds were sterilized and plated on half strength MS medium, containing 1% sucrose. Plates were incubated at 24° C. under 60-80 µE/m²s light using a 16 hour light/8 hour dark photoperiod. Cotyledons from 4-5 day old seedlings were collected, the petioles cut and dipped into the *Agrobacterium* solution. The dipped cotyledons were placed on co-cultivation medium at a density of 20 cotyledons/plate and incubated as described above for 3 days. Explants were transferred to the same media, but containing 300 mg/l timentin (SmithKline Beecham, Pa.) and thinned to 10 cotyledons/plate. After 7 days explants were transferred to Selection/Regeneration medium. Transfers were continued every 2-3 weeks (2 or 3 times) until shoots had developed. Shoots were transferred to Shoot-Elongation medium every 2-3 weeks. Healthy looking shoots were transferred to rooting medium. Once good roots had developed, the plants were placed into moist potting soil.

The transformed plants were then analyzed for the presence of the NPTII gene/kanamycin resistance by ELISA, using the ELISA NPTII kit from 5Prime-3Prime Inc. (Boulder, Colo.). Approximately 70% of the screened plants were NPTII positive. Only those plants were further analyzed.

From Northern blot analysis of the plants that were transformed with the constitutively expressing constructs, showed expression of the CBF genes and all CBF genes were capable of inducing the *Brassica napus* cold-regulated gene BN115 (homolog of the *Arabidopsis* COR15 gene). Most of the transgenic plants appear to exhibit a normal growth phenotype. As expected, the transgenic plants are more freezing tolerant than the wild-type plants. Using the electrolyte leakage of leaves test, the control showed a 50% leakage at −2 to −3° C. Spring canola transformed with either CBF1 or CBF2 showed a 50% leakage at −6 to −7° C. Spring canola transformed with CBF3 shows a 50% leakage at about −10 to −15° C. Winter canola transformed with CBF3 may show a 50% leakage at about −16 to −20° C. Furthermore, if the spring or winter canola are cold acclimated the transformed plants may exhibit a further increase in freezing tolerance of at least −2° C.

To test salinity tolerance of the transformed plants, plants were watered with 150 mM NaCl. Plants overexpressing CBF1, CBF2 or CBF3 grew better compared with plants that had not been transformed with CBF1, CBF2 or CBF3.

These results demonstrate that equivalogs of *Arabidopsis* transcription factors can be identified and shown to confer similar functions in non-*Arabidopsis* plant species.

Example XVI

Cloning of Transcription Factor Promoters

Promoters are isolated from transcription factor genes that have gene expression patterns useful for a range of applications, as determined by methods well known in the art (including transcript profile analysis with cDNA or oligonucleotide microarrays, Northern blot analysis, semi-quantitative or quantitative RT-PCR). Interesting gene expression profiles are revealed by determining transcript abundance for a selected transcription factor gene after exposure of plants to a range of different experimental conditions, and in a range of different tissue or organ types, or developmental stages. Experimental conditions to which plants are exposed for this purpose includes cold, heat, drought, osmotic challenge, varied hormone concentrations (ABA, GA, auxin, cytokinin, salicylic acid, brassinosteroid), pathogen and pest challenge. The tissue types and developmental stages include stem, root, flower, rosette leaves, cauline leaves, siliques, germinating seed, and meristematic tissue. The set of expression levels provides a pattern that is determined by the regulatory elements of the gene promoter.

Transcription factor promoters for the genes disclosed herein are obtained by cloning 1.5 kb to 2.0 kb of genomic sequence immediately upstream of the translation start codon for the coding sequence of the encoded transcription factor protein. This region includes the 5'-UTR of the transcription factor gene, which can comprise regulatory elements. The 1.5 kb to 2.0 kb region is cloned through PCR methods, using primers that include one in the 3' direction located at the translation start codon (including appropriate adaptor sequence), and one in the 5' direction located from 1.5 kb to 2.0 kb upstream of the translation start codon (including appropriate adaptor sequence). The desired fragments are PCR-amplified from *Arabidopsis* Col-0 genomic DNA using high-fidelity Taq DNA polymerase to minimize the incorporation of point mutation(s). The cloning primers incorporate two rare restriction sites, such as Not1 and Sfi1, found at low frequency throughout the *Arabidopsis* genome. Additional restriction sites are used in the instances where a Not1 or Sfi1 restriction site is present within the promoter.

The 1.5-2.0 kb fragment upstream from the translation start codon, including the 5'-untranslated region of the transcription factor, is cloned in a binary transformation vector immediately upstream of a suitable reporter gene, or a transactivator gene that is capable of programming expression of a reporter gene in a second gene construct. Reporter genes used include green fluorescent protein (and related fluorescent protein color variants), beta-glucuronidase, and luciferase. Suitable transactivator genes include LexA-GAL4, along with a transactivatable reporter in a second binary plasmid (as disclosed in U.S. patent application Ser. No. 09/958,131, incorporated herein by reference). The binary plasmid(s) is transferred into *Agrobacterium* and the structure of the plasmid confirmed by PCR. These strains are introduced into *Arabidopsis* plants as described in other examples, and gene expression patterns determined according to standard methods know to one skilled in the art for monitoring GFP fluorescence, beta-glucuronidase activity, or luminescence.

All references, publications, patent documents, web pages, and other documents cited or mentioned herein are hereby incorporated by reference in their entirety for all purposes. Although the invention has been described with reference to specific embodiments and examples, it should be understood that one of ordinary skill can make various modifications without departing from the spirit of the invention. The scope of the invention is not limited to the specific embodiments and examples provided.

SEQUENCE LISTING (2910 sequences)

SEQ ID NO: 1 - DNA, 1713 bp, Arabidopsis thaliana
  G8
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 2 - protein, 449 aa, Arabidopsis thaliana
  G8  (conserved domain in AA coordinates: 151-217, 243-296)
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 3 - DNA, 1055 bp, Arabidopsis thaliana
  G19
ataaaggcatttcagctccaccgtaggaaactttctcttgaaagaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttctt

SEQ ID NO: 4 - protein, 248 aa, Arabidopsis thaliana
  G19  (conserved domain in AA coordinates: 76-145)
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 5 - DNA, 913 bp, Arabidopsis thaliana
  G22
agaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttgttgtaaaaaaaaaaaaaaaaaa

SEQ ID NO: 6 - protein, 226 aa, Arabidopsis thaliana
  G22  (conserved domain in AA coordinates: 89-157)
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 7 - DNA, 957 bp, Arabidopsis thaliana
  G24
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 8 - protein, 176 aa, Arabidopsis thaliana
  G24  (conserved domain in AA coordinates: 25-93)
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 9 - DNA, 964 bp, Arabidopsis thaliana
  G28
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaaaaa

SEQ ID NO: 10 - protein, 268 aa, Arabidopsis thaliana
  G28  (conserved domain in AA coordinates: 145-213)
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 11 - DNA, 785 bp, Arabidopsis thaliana
  G47
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 12 - protein, 144 aa, Arabidopsis thaliana
  G47  (conserved domain in AA coordinates:11-80)
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 13 - DNA, 947 bp, Arabidopsis thaliana
  G156
  misc_feature (924)..(925): n is a, c, g, or t
  misc_feature (929)..(929): n is a, c, g, or t
  misc_feature (932)..(933): n is a, c, g, or t
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatannaaanaannaaaaaaaaaaaaaa

SEQ ID NO: 14 - protein, 238 aa, Arabidopsis thaliana
  G156  (conserved domain in AA coordinates: 2-57)
MGRGKIEIKKIENQTARQVTFSKRRTGLIKKTRELSILCDAHIGLIVFSATGKLSEFCSEQNRMPQLIDRYLHTNGLRLPDHHDDQEQLHHEMELLRRETCNLELRLRPFHGHDLASIPPNELDGLERQLEHSVLKVRERKRRMLEEDNNNMYRWLHEHRAAMEFQQAGIDTKPGEYQQFIEQLQCYKPGEYQQFLEQQQQQPNSVLQLATLPSEIDPTYNLQLAQPNLQNDPTAQND

SEQ ID NO: 15 - DNA, 883 bp, Arabidopsis thaliana
  G157
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 16 - protein, 196 aa, Arabidopsis thaliana
  G157  (conserved domain in AA coordinates: 2-57)
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 17 - DNA, 826 bp, Arabidopsis thaliana
  G162
agacatacaacaccaaaatcttcttcttcaccaacatattcactttcacagcaaaaaaaaacgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgcaaaaaaaa

SEQ ID NO: 18 - protein, 172 aa, Arabidopsis thaliana
  G162  (conserved domain in AA coordinates: 2-57)
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 19 - DNA, 2217 bp, Arabidopsis thaliana
  G175
  misc_feature (2192)..(2192): n is a, c, g, or t
atttctaaaaatagttaaactgttggtgatttttgtggaactgattaattaacacaattggagaaaacaaattgaaacttttttgtttgttagagagttaaggagaaattttatctaaccaagctgtgtaaatctcttgtagtttttctgccgatatacattttcattgtgttgagggtaaacgataatcaagaacgagagagagagagagcaagagcaagagatttctactacagaagatttattatattgatcattttgtgtgatcaacccataaaaacagagagacatagacaagtccatgtttcgatgtttcgatctctcttactgtctaaacggcgaaataaaaagtctgatgggtgtcacttattgcatgtatattagtaaatcagcttgagcccaagttaaagctgaaacttgggtttgcaatggctggtattgataataaagctgctgtaatgggagaatggttcgactgtagtactactaaccacaggaagagatcgaaagcggaacttggtagagagttttctttaaattacatcaagaatgaggattctttgcaaaccacctttcaagaaagttcacgaggagctcttcgtgaaaggattgctgcgagatccgggtttaatgcaccgtggttaaacactgaggatattcttcagtcgaaatctttaaccatctcttctcctggtcttagtcctgcaactctgttagagtctcctgttttcctctcaaaccctttgctatctccaacaaccgggaagctctcatcagtaccttctgataaggctaaagctgagttatttgacgacattaccacatccttagccttccaaaccatttcaggaagtggccttgatcctactaacatcgctttagaacccgatgattcccaagactatgaagaaagacagctcggcggtttaggagactcgatggcttgttgtgcacctgcagatgatggatacaactggagaaaatatggacaaaagctagttaaaggaagtgagtatccgcggagctattacaagtgcacgcacccgaattgtgaggccaagaagaaggttgaacggtctcgggaaggtcatattatagagatcatatacacaggagatcatatacacagcaaacctccacctaaccgccggtcagggattggatcatccggtactggccaagacatgcaaatagatgcaaccgaatacgaaggttttgctggaaccaatgagaacatagaatggacatcacctgtatctgcagagctcgaatacggaagccattcaggatcaatgcaggttcaaaacgggactcatcagttcgggtatggtgatgcagcagctgatgccttatatagagatgaaaacgaagatgatcgcacgtcccacatgagtgtttccctgacttacgatggagaggtagaagagtccgaatcaaagagaaggaaactagaagcttatgcaacagaaacgagtggatcaaccagagccagccgtgagccaagagttgtggtgcagaccacaagtgacattgacatcctcgatgatggttatcgctggcgcaagtatgggcaaaaagtcgttaaaggaaacccgaatccaaggagctactataaatgcacagctaatggatgtaccgtaacgaagcatgtagagagagcctctgatgacttcaagagcgtactaacaacttatataggcaagcacacccacgttgtaccagcagcacgcaacagcagccacgtcggtgcaggcagttcagggactctccaaggcagtttagcgactcagacccacaaccacaatgtgcactatccaatgccacacagtagatctgagggactggccacagccaactcatctctatttgacttccagtcacacctgaggcatcctacaggtttctccgtttacataggccaatctgagctttctgatctttcaatgcctggtctaactattgggcaagagaagcttaccagcctgcaggcgcctgacattggggatccaactggcctaatgttgcagttagcagcacagccgaaggtggaaccagtgtcaccacaacagggacttgatttgtcagcgagctcattgatatgcagagagatgttgagtagattacgacagatatgaaacaaatctctttgttcactgattgctcaaatttttgaataaatgaaaaattgaganaaaaaaaaaaaaaaaaaaaaaaaaa

SEQ ID NO: 20 - protein, 568 aa, Arabidopsis thaliana
  G175  (conserved domain in AA coordinates: 178-234, 372-428)
MAGIDNKAAVMGEWFDCSTTNHRKRSKAELGREFSLNYIKNEDSLQTTFQESSRGALRERIAARSGFNAPWLNTEDILQSKSLTISSPGLSPATLLESPVFLSNPLLSPTTGKLSSVPSDKAKAELFDDITTSLAFQTISGSGLDPTNIALEPDDSQDYEERQLGGLGDSMACCAPADDGYNWRKYGQKLVKGSEYPRSYYKCTHPNCEAKKKVERSREGHIIEIIYTGDHIHSKPPPNRRSGIGSSGTGQDMQIDATEYEGFAGTNENIEWTSPVSAELEYGSHSGSMQVQNGTHQFGYGDAAADALYRDENEDDRTSHMSVSLTYDGEVEESESKRRKLEAYATETSGSTRASREPRVVVQTTSDIDILDDGYRWRKYGQKVVKGNPNPRSYYKCTANGCTVTKHVERASDDFKSVLTTYIGKHTHVVPAARNSSHVGAGSSGTLQGSLATQTHNHNVHYPMPHSRSEGLATANSSLFDFQSHLRHPTGFSVYIGQSELSDLSMPGLTIGQEKLTSLQAPDIGDPTGLMLQLAAQPKVEPVSPQQGLDLSASSLICREMLSRLRQI

SEQ ID NO: 21 - DNA, 837 bp, Arabidopsis thaliana
  G180
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttcatttctgttcaaacaaaaaaaaaaaaaaa

SEQ ID NO: 22 - protein, 191 aa, Arabidopsis thaliana
  G180  (conserved domain in AA coordinates: 118-174)
MNFLVPFEETNVLTFFSSSSSSSLSSPSFPIHNSSSTTTTHAPLGFSNNLQGGGPLGSKVVNDDQENFGGGTNNDAHSNSWWRSNSGSGDMKNKVKIRRKLREPRFCFQTKSDVDVLDDGYKWRKYGQKVVKNSLHPRSYYRCTHNNCRVKKRVERLSEDCRMVITTYEGRHNHIPSDDSTSPDHDCLSSF

SEQ ID NO: 23 - DNA, 1458 bp, Arabidopsis thaliana
  G183
atgagtgattttgatgaaaacttcatcgaaatgacgtcgtattgggctccaccatccagtcctagcccaagaacgatattggcaatgctggagcaaaccgacaatggtctgaatccaatcagtgagatcttccctcaagaaagcttgccaagagatcatactgatcaatctggacaaagatctggtcttcgtgagagactggctgcaagagtaggattcaatcttccaacactcaatacagaagaaaacatgagtcctttggatgcatttttcaggagctcgaatgttcctaattctcctgtcgttgcaatctctccaggattcagtccatcagcactattgcatactcccaatatggtcagtgattcttcccagattatccctccgtcttcagccaccaattacggacctctagagatggtggaaacttccggtgaagacaatgcagcgatgatgatgttcaacaacgatcttccttatcagccgtacaatgttgatctgccttctctagaagtctttgatgatattgcaacggaagagtccttttatatcccatcttatgaacctcatgttgacccaattggaactcctttagtcacatcctttgaatctgaactcgttgacgatgcccataccgacatcatctccattgaggacagtgagagcgaggatggaaacaaagatgatgacgacgaggacttccaatacgaagacgaagacgaagaccaatacgaccaagatcaagatgtagatgaagatgaagaggaagaaaaagatgaagacaatgttgcattagatgatcctcaacctccacctccaaagagaaggagatatgaggtatcaaacatgattggagccacaagaacaagcaagacacaaaggatcatacttcagatggaaagcgacgaagacaatcctaacgatggttatcgctggagaaaatacggtcagaaagtcgtcaaaggaaatcctaatccgaggagttacttcaagtgcacaaacatcgagtgcagagtgaaaaaacatgtggagagaggagcagacaatatcaagttggttgtgactacatacgatgggatacacaaccatccttcaccacctgcacgtagaagcaattccagttcaaggaaccggtctgcaggggcaacaatacctcaaaatcagaatgatcgaaccagtcggttaggtagggctcctcctactcctactcctcctactcctcctccttcgtcttacacacctgaggagatgaggcctttctcttcgttggctacagaaattgatctgacagaggtttatatgaccggaatctctatgctgccgaatataccggtttacgagaattcgggttttatgtaccagaatgatgaaccgacgatgaatgcgatgccggatggttcagatgtgtacgatgggatcatggaacgcctgtattttaagtttggtgtcgacatgtag

SEQ ID NO: 24 - protein, 485 aa, Arabidopsis thaliana
  G183  (conserved domain in AA coordinates: 307-363)
MSDFDENFIEMTSYWAPPSSPSPRTILAMLEQTDNGLNPISEIFPQESLPRDHTDQSGQRSGLRERLAARVGFNLPTLNTEENMSPLDAFFRSSNVPNSPVVAISPGFSPSALLHTPNMVSDSSQIIPPSSATNYGPLEMVETSGEDNAAMMMFNNDLPYQPYNVDLPSLEVFDDIATEESFYIPSYEPHVDPIGTPLVTSFESELVDDAHTDIISIEDSESEDGNKDDDDEDFQYEDEDEDQYDQDQDVDEDEEEEKDEDNVALDDPQPPPPKRRRYEVSNMIGATRTSKTQRIILQMESDEDNPNDGYRWRKYGQKVVKGNPNPRSYFKCTNIECRVKKHVERGADNIKLVVTTYDGIHNHPSPPARRSNSSSRNRSAGATIPQNQNDRTSRLGRAPPTPTPPTPPPSSYTPEEMRPFSSLATEIDLTEVYMTGISMLPNIPVYENSGFMYQNDEPTMNAMPDGSDVYDGIMERLYFKFGVDM

SEQ ID NO: 25 - DNA, 1191 bp, Arabidopsis thaliana
  G188
ctctcaccaacataatcaaagaagctttcctcacgaattcaagatcgccatgtcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatgatgaaaacgaataaaatctcaatttacaatttacaaaaagaaaaaagtcagtttttaattattatttttgtttgttaaaacttgacatttattgtg

SEQ ID NO: 26 - protein, 348 aa, Arabidopsis thaliana
  G188  (conserved domain in AA coordinates: 175-222)
MSSEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 27 - DNA, 1115 bp, Arabidopsis thaliana
  G189
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgctaaaaaaaaaaaaaaaaa

SEQ ID NO: 28 - protein, 317 aa, Arabidopsis thaliana
  G189  (conserved domain in AA coordinates: 240-297)
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 29 - DNA, 1171 bp, Arabidopsis thaliana
  G192
cttttttctcttctctcctcagagattcgaagctttttgtctcccctgagtaaccaaattcaatggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatgattagattacgacggcttagaatactcttattaggacagatttataggattaaggaattattctcggagcatatgtaaaaataggataaaagaaaatgttctttgttactttttttcgggttttcttcctattgtttctaaacatcttagaaaaaatttaattgtatattccttaagctcgatacatcttgttttaaaaaaaaaaaaaaaaaa

SEQ ID NO: 30 - protein, 298 aa, Arabidopsis thaliana
  G192  (conserved domain in AA coordinates: 128-185)
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 31 - DNA, 1501 bp, Arabidopsis thaliana
  G196
tcgacatcagatttctctcacggattcctaatcatttttattatatttggatatttgctaattcttcccgtgtataaatctcatataaacacgcatcatacatatatattatgtgcagcgtctttgagtttcaagacatggacaacttccaaggagatctaacagacgtcgtacgaggaataggatcaggccacgtgtcaccatctcctggaccaccggaaggtccatctccgagcagcatgtctccgccgccaacatcagatctccacgtggaattcccctccgccgctacttctgccagctgtctcgcaaatcccttcggagacccgttcgtaagcatgaaggatcctctcatccacctcccggccagctacatctccggcgccggtgataataaaagcaacaaaagttttgcaatctttccaaagatttttgaggatgatcatattaagagtcaatgcagtgtcttcccaagaattaagatctcgcaaagtaacaatatccacgatgcctccacgtgtaattctccggccataaccgtctcctctgccgccgtagcagcttcgccgtggggcatgatcaacgttaataccactaacagtccaagaaactgtttacttgtcgataataataacaacacgtcatcatgctcacaggttcagatctcttcttcccctcggaatctcggaattaagagaaggaagagccaggcaaagaaagtggtgtgcataccggctccagccgctatgaacagccggtccagtggagaagttgttccgtctgatctatgggcttggcgaaagtacggtcaaaaacctatcaaaggttctccttatccaaggggttactacagatgtagcagctcaaaaggttgttcagctaggaaacaagtcgaacgtagccgcactgatccaaacatgttagtcattacttacacctctgagcataaccacccatggcctactcaacgcaacgctctcgcaggttccactcgttcctcttcctcctcctctttaaacccttcttccaaatcctcaaccgcagccgccactacttctccctcatccagagttttccaaaacaacagcagcaaagacgaacccaataactccaacttgccttcctcttccactcatcctccttttgacgccgccgcaattaaggaggagaacgtggaagagcgtcaggaaaagatggagttcgattataatgacgttgaaaatacctatagaccggagttgttgcaagagtttcaacatcagccggaggatttctttgccgatctcgacgagcttgagggagattctttgactatgttgctctctcacagtagcggcggaggcaacatggaaaacaaaacgacgattccagacgtttttagtgatttctttgacgacgacgagtcctcaaggtcgttataaatattgttgttaatgtatacatagaaatgaaattattcatgtaattcgttttgtgttaaatgacggtatttgcctttgca

SEQ ID NO: 32 - protein, 436 aa, Arabidopsis thaliana
  G196  (conserved domain in AA coordinates:223-283)
MCSVFEFQDMDNFQGDLTDVVRGIGSGHVSPSPGPPEGPSPSSMSPPPTSDLHVEFPSAATSASCLANPFGDPFVSMKDPLIHLPASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRGYYRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 33 - DNA, 750 bp, Arabidopsis thaliana
  G211
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactag

SEQ ID NO: 34 - protein, 249 aa, Arabidopsis thaliana
  G211  (conserved domain in AA coordinates:24-137)
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 35 - DNA, 2240 bp, Arabidopsis thaliana
  G214
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 36 - protein, 608 aa, Arabidopsis thaliana
  G214  (conserved domain in AA coordinates: 22-71)
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 37 - DNA, 407 bp, Arabidopsis thaliana
  G226
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 38 - protein, 112 aa, Arabidopsis thaliana
  G226  (conserved domain in AA coordinates: 28-78)
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 39 - DNA, 1046 bp, Arabidopsis thaliana
  G241
gaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtcgctggtttagttgagatacaacaagagtttcaaaacttgggctccgctaataatgagatgatttttgacagtgagatggaacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaa

SEQ ID NO: 40 - protein, 273 aa, Arabidopsis thaliana
  G241  (conserved domain in AA coordinates: 14-114)
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMELLVRCIG

SEQ ID NO: 41 - DNA, 1317 bp, Arabidopsis thaliana
  G248
tcgacagttggtgtttaaatggaattctcattgatctccgatgaaaatttcatcttaaacgatgctcatcgatgtcctgttaatgatgatgcatcgcatataccaaaaaataatcttaactttttcaatgacaatttaggtcaatcttctcgtactggatggtctttttcaccagatctgactgatatctctaatcagcaccaccaaaatcttatacctttgatcccaaattatgattctcaaaatcagaatttggatactaatcaaaaccatttggtttacaactcttcctcctatgaaattccatcaaactacccattcatgagtatcaaatcctactcaaatattgatactcttgagcaatctatgaataacatagtcaacaacggaaaaatccatatgatcgataatcccccaatttttgcaaaccctaagggtatattcgaaaattttcatgatttgcaggaatacactatagggaatgagattgtacacaatgaagaactgactaataagggttatgagccaactcttgataaggtaatgggtgaacctcaattatttgatgtgccagtgctagaaggtatcaaaaatacaaccaacgaaatcatgaatcaacttgaagatgataagatgaaaaaaacttatgagaataaaaaggaggcgagcacaagcaaatatttgaagaaaagtgacatcaccaaaaaaagatggacagaatctgaggacataaaattgaaagagatggtggcacttgaacccaaaaaatggacaaaggtcgcaaaacattttgaaggacgaacaccaaaacaatgcagagagaggtggcataaccatgctcgtcctaacgttaagaaaactacttggagtgaagaagaagatcaaatactaattgaagtacacaaagtaattggtgccaaatggatccagatctcagagcaacttccggggaggagctataacaatgttaagaaccattggaataccacaaagcgtcgggtgcaaaataaaagtggtcgaactgtcaaccgtgtcggcaataacatccttgaaaactacataaggagtatcacaatcaacaacgatgatgaatctgatggtgaaccgacaaacattgagaattatcatgatgactctgaagatatgttatatggggagatgaatttgagtccagaggctataacgcagaccaccaaaccattgaccgatgcttctacaatatcaccttatattccgatgccaaaagaaaactatactctggaggtttgtgaatcactggaggactatctagagctgctgcgttggtgggattaatgc

SEQ ID NO: 42 - protein, 431 aa, Arabidopsis thaliana
  G248  (conserved domain in AA coordinates: 264-332)
MEFSLISDENFILNDAHRCPVNDDASHIPKNNLNFFNDNLGQSSRTGWSFSPDLTDISNQHHQNLIPLIPNYDSQNQNLDTNQNHLVYNSSSYEIPSNYPFMSIKSYSNIDTLEQSMNNIVNNGKIHMIDNPPIFANPKGIFENFHDLQEYTIGNEIVHNEELTNKGYEPTLDKVMGEPQLFDVPVLEGIKNTTNEIMNQLEDDKMKKTYENKKEASTSKYLKKSDITKKRWTESEDIKLKEMVALEPKKWTKVAKHFEGRTPKQCRERWHNHARPNVKKTTWSEEEDQILIEVHKVIGAKWIQISEQLPGRSYNNVKNHWNTTKRRVQNKSGRTVNRVGNNILENYIRSITINNDDESDGEPTNIENYHDDSEDMLYGEMNLSPEAITQTTKPLTDASTISPYIPMPKENYTLEVCESLEDYLELLRWWD

SEQ ID NO: 43 - DNA, 1391 bp, Arabidopsis thaliana
  G254
cgatttcgagctctatggtgtccgtaaaccctagacctaagggttttccagttttcgattcctcgaatatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacttcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtttacagcttcattggaagtgtcttcgatcccaacacatcaggccacctccagagattaaagcagatggatccaataaatatggaaacggttcttttactgatgcaaaacctgtctgtaaatctgacaagtcccgagtttgcagagcaaaggaggttgatatcatcatacagcgctaaagctttgaaatagagatagaataaaacaataatgtaccttatgtgagatcaagagacaatcatccaaggtctgtatgcattgcttggatttaggcctcgtgttctcactacaggagcagaaccaatcgcaaagactcttagatggctactgagttgtggtttttatgtctctgtaagtcgcggtggagcacacgtgtttgtcctgtcttgtgtatgtgtgtatagataatacaaggttttgcagagtaaggtcacagttagctgcaagtgagtttggatcaatcttaagattaaaaccctgagagtgagtgtccaaagagactgtgtaatattggtttggcggtcagcagaagagttttgaagtgcacatccagttagtgataacacggttgaagaaaaggtaaggttacaagtttagttttgaataattgtatactcaaaaaatatgaatgtataaagaataatcacttgagtcgcctta

SEQ ID NO: 44 - protein, 302 aa, Arabidopsis thaliana
  G254  (conserved domain in AA coordinates: 62-106)
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPLPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 45 - DNA, 1547 bp, Arabidopsis thaliana
  G256
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 46 - protein, 332 aa, Arabidopsis thaliana
  G256  (conserved domain in AA coordinates: 13-115)
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 47 - DNA, 2104 bp, Arabidopsis thaliana
  G278
tcgatctttaaccaaatccagttgataaggtctcttcgttgattagcagagatctctttaatttgtgaatttcaattcatcggaacctgttgatggacaccaccattgatggattcgccgattcttatgaaatcagcagcactagtttcgtcgctaccgataacaccgactcctctattgtttatctggccgccgaacaagtactcaccggacctgatgtatctgctctgcaattgctctccaacagcttcgaatccgtctttgactcgccggatgatttctacagcgacgctaagcttgttctctccgacggccgggaagtttctttccaccggtgcgttttgtcagcgagaagctctttcttcaagagcgctttagccgccgctaagaaggagaaagactccaacaacaccgccgccgtgaagctcgagcttaaggagattgccaaggattacgaagtcggtttcgattcggttgtgactgttttggcttatgtttacagcagcagagtgagaccgccgcctaaaggagtttctgaatgcgcagacgagaattgctgccacgtggcttgccggccggcggtggatttcatgttggaggttctctatttggctttcatcttcaagatccctgaattaattactctctatcagaggcacttattggacgttgtagacaaagttgttatagaggacacattggttatactcaagcttgctaatatatgtggtaaagcttgtatgaagctattggatagatgtaaagagattattgtcaagtctaatgtagatatggttagtcttgaaaagtcattgccggaagagcttgttaaagagataattgatagacgtaaagagcttggtttggaggtacctaaagtaaagaaacatgtctcgaatgtacataaggcacttgactcggatgatattgagttagtcaagttgcttttgaaagaggatcacaccaatctagatgatgcgtgtgctcttcatttcgctgttgcatattgcaatgtgaagaccgcaacagatcttttaaaacttgatcttgccgatgtcaaccataggaatccgaggggatatacggtgcttcatgttgctgcgatgcggaaggagccacaattgatactatctctattggaaaaaggtgcaagtgcatcagaagcaactttggaaggtagaaccgcactcatgatcgcaaaacaagccactatggcggttgaatgtaataatatcccggagcaatgcaagcattctctcaaaggccgactatgtgtagaaatactagagcaagaagacaaacgagaacaaattcctagagatgttcctccctcttttgcagtggcggccgatgaattgaagatgacgctgctcgatcttgaaaatagagttgcacttgctcaacgtctttttccaacggaagcacaagctgcaatggagatcgccgaaatgaagggaacatgtgagttcatagtgactagcctcgagcctgaccgtctcactggtacgaagagaacatcaccgggtgtaaagatagcacctttcagaatcctagaagagcatcaaagtagactaaaagcgctttctaaaaccgtggaactcgggaaacgattcttcccgcgctgttcggcagtgctcgaccagattatgaactgtgaggacttgactcaactggcttgcggagaagacgacactgctgagaaacgactacaaaagaagcaaaggtacatggaaatacaagagacactaaagaaggcctttagtgaggacaatttggaattaggaaattcgtccctgacagattcgacttcttccacatcgaaatcaaccggtggaaagaggtctaaccgtaaactctctcatcgtcgtcggtgagactcttgcctcttagtgtaatttttgctgtaccatataattctgttttcatgatgactgtaactgtttatgtctatcgttggcgtcatatagtttcgctcttcgttttgcatcctgtgtattattgctgcaggtgtgcttcaaacaaatgttgtaacaatttgaaccaatggtatacagatttgtaatatatatttatgtacatcaacaataaaaaaaaaaaaaaaaaa

SEQ ID NO: 48 - protein, 593 aa, Arabidopsis thaliana
  G278  (conserved domain in AA coordinates: 2-593)
MDTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 49 - DNA, 1350 bp, Arabidopsis thaliana
  G291
caagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcagacaaagatctttgggttattaaatgacattaacataaaaaaaa

SEQ ID NO: 50 - protein, 357 aa, Arabidopsis thaliana
  G291  (conserved domain in AA coordinates: 132-160)
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 51 - DNA, 1072 bp, Arabidopsis thaliana
  G303
aaaagataacgtagccattaacttttatgcattaactccttcatttctttttgtgctcgtttggttgagagagagagaggctatatatgatgttccaacaagattaccctcatggcttttcactcgtggaaacatccttaagttacgaaatgttggattactttcaaaacatcgtcgtttcgaactctgaagacgtggcgtcacagcaaaattccatttcgtcctcttcttattcatcagcgacactctcctgctccataacagagcaaaaatctcacttaactgaaaagttatctcctctacgagaaagatatggttgcggtgactttctgtcgcggaagaggagaaggagaagtgaaaaaacgattgtagataaagagaatcaaaggatgaatcacattgccgtcgagcgtaaccggagaaaacagatgaatcattttctgtctatcctcaagtctatgatgcctctctcttattctcaacctaatgaccaagcatcaatcatagaagggaccattagctatctgaagaagctagaacaacgtctccaatctctcgaagcccaattaaaagctactaaactcaatcaatcaccaaatatattttccgacttcttcatgttccctcaatactccaccgccactgccactgccaccgccactgcctcctcatcctcctcgagccaccaccatcacaagcgactagaggtggttgctgacgtggaggttacaatggtagaaagacatgccaacattaaagtgttaacgaagacacagccaagattgctcttcaagattatcaatgagtttaactctttaggtttaagtactcttcatctcaacctcacaacttccaaagacatgtctctcttcacttttagcgtcaaggtagaggcagattgtcaattgacgccttctggtaatgaggtcgcaaatacggtgcatgaagtcgttagaagagttcacaaggaacgttgaattttgtttacatactagctaactttgaaattctattttattgtataaacaatctcttatgtgtgtaatttacatatatacaattaattaacatt

SEQ ID NO: 52 - protein, 296 aa, Arabidopsis thaliana
  G303  (conserved domain in AA coordinates: 92-161)
MMFQQDYPHGFSLVETSLSYEMLDYFQNIVVSNSEDVASQQNSISSSSYSSATLSCSITEQKSHLTEKLSPLRERYGCGDFLSRKRRRRSEKTIVDKENQRMNHIAVERNRRKQMNHFLSILKSMMPLSYSQPNDQASIIEGTISYLKKLEQRLQSLEAQLKATKLNQSPNIFSDFFMFPQYSTATATATATASSSSSSHHHHKRLEVVADVEVTMVERHANIKVLTKTQPRLLFKIINEFNSLGLSTLHLNLTTSKDMSLFTFSVKVEADCQLTPSGNEVANTVHEVVRRVHKER

SEQ ID NO: 53 - DNA, 1755 bp, Arabidopsis thaliana
  G312
atggcttacatgtgcactgatagtggcaatctaatggctattgctcaacaagtcatcaaacagaagcagcaacaagaacaacaacagcagcaacatcatcaagaccatcagatttttggtattaatcctttgtctcttaacccatggcccaatacttccctcgggtttgggctttcaggttcggcttttcccgacccgtttcaagttaccggcggcggagattccaacgatcctggctttccttttcctaacttagaccaccaccacgccacaaccaccggcggtgggttcaggttatctgatttcggcggtggaaccggcggcggcgagtttgagtccgacgagtggatggagactcttatcagcggtggagactccgttgcagacggtcctgattgtgacacctggcatgataatcccgattacgtaatctacggtcctgatccattcgatacttacccgagtcgactcagtgtccaaccgtcagatctaaaccgagtcattgacacgtcgagtccgcttcctccgccgaccttgtggcctccttcttcgccattatcgattcctccgcttactcatgagtcaccaaccaaagaagatccagagactaacgactccgaagacgatgacttcgacctagaaccacctctcctcaaagctatatacgactgtgcacggatctcagactctgaccctaacgaagcttccaagacgcttcttcagatccgagaatctgtatcggagctaggtgatccgacggagcgagttgcattttacttcacggaagctctctccaacagactgtctcctaattcgccggcgacgtcgtcttcttcttcatctacggaggatttaatcttatcttataaaaccctaaacgacgcttgtccttactccaaattcgcacatttgacggcgaatcaagcgattctagaagcgacggagaagtcgaacaagattcacatcgtcgattttggaatcgttcaaggtatacaatggcctgctcttcttcaagctctagctactcgtacttctggtaaacccactcaaatccgggtctcgggtatacccgctccatctctcggtgaatctccggaaccgtcgttaatcgccaccggaaaccgcctccgtgatttcgccaaggttctggatctgaatttcgatttcatcccaattctcactcccatacatttacttaacgggtcaagtttccgggtcgacccggatgaagtactggccgtgaatttcatgctccagctctacaaattactcgacgagacgccgacgatagttgacaccgcactacggctcgccaaatcgttgaacccgagggtcgtcactctcggagaatacgaagtgagcttaaaccgggtcggtttcgctaaccgggtaaagaacgcgcttcaattctattccgcggttttcgaatcccttgaaccgaacttggggcgtgattcggaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataa

SEQ ID NO: 54 - protein, 584 aa, Arabidopsis thaliana
  G312  (conserved domain in AA coordinates: 320-336)
MAYMCTDSGNLMAIAQQVIKQKQQQEQQQQQHHQDHQIFGINPLSLNPWPNTSLGFGLSGSAFPDPFQVTGGGDSNDPGFPFPNLDHHHATTTGGGFRLSDFGGGTGGGEFESDEWMETLISGGDSVADGPDCDTWHDNPDYVIYGPDPFDTYPSRLSVQPSDLNRVIDTSSPLPPPTLWPPSSPLSIPPLTHESPTKEDPETNDSEDDDFDLEPPLLKAIYDCARISDSDPNEASKTLLQIRESVSELGDPTERVAFYFTEALSNRLSPNSPATSSSSSSTEDLILSYKTLNDACPYSKFAHLTANQAILEATEKSNKIHIVDFGIVQGIQWPALLQALATRTSGKPTQIRVSGIPAPSLGESPEPSLIATGNRLRDFAKVLDLNFDFIPILTPIHLLNGSSFRVDPDEVLAVNFMLQLYKLLDETPTIVDTALRLAKSLNPRVVTLGEYEVSLNRVGFANRVKNALQFYSAVFESLEPNLGRDSEERVRVERELFGRRISGLIGPEKTGIHRERMEEKEQWRVLMENAGFESVKLSNYAVSQAKILLWNYNYSNLYSIVESKPGFISLAWNDLPLLTLSSWR

SEQ ID NO: 55 - DNA, 876 bp, Arabidopsis thaliana
  G325
atggaggctcgatgtgacttttgtggaaccgaaaaagcattaatctactgcaaatctgattcggctaaactttgtttaaactgtgacgttaatgtacactcagcgaatcctctgtctcaaagacacacgcgatctctactctgcgagaaatgttccttacaacccacggcagtacactgtatgaacgaaaatgtttctctttgccaaggatgtcagtggaccgctagtaactgcactggtttaggacacagacttcagagtctgaacccttactctgattgtccttctccatcagatttcggcaagatctggtcttcaactttagaaccttctgtcacaagtttggtctctccattttctgataccctgctccaggaattagacgattggaatggttcatcaacttccgtggttacacaaactcagaaccttaaagactattcttctttctttcctatggaatctaatcttccaaaagtgatagaagaggaatgttctggtttggatctatgcgaagggataaacttagatgatgcgccgttgaatttcaacgcaagcaatgatataatcggatgttcatcacttgacaataccaaatgttacgagtacgaggattcttttaaggaagagaataacattggccttccttcattactgcttcctactttatccgggaacgttgtaccgaacatgtcactttcgatgtctaacctcacaggagaaagcaatgcgactgattaccaagattgcggaatttcaccagggtttctcataggagattcgccatgggaatcgaatgttgaagttagttttaatccaaaattaagggatgaggctaaaaagagatacaaacaaaagaaatcaaagcgcatgtaa

SEQ ID NO: 56 - protein, 291 aa, Arabidopsis thaliana
  G325  (conserved domain in AA coordinates:5-28, 48-71)
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRM

SEQ ID NO: 57 - DNA, 795 bp, Arabidopsis thaliana
  G343
atggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccagtgatgacgcagctcatcttgaatggctttcgcaattcgtggacgattctttcgctgattttccggcgaatccattaggaggaactatgacttctgtcaaaactgaaacttcctttccggggaaaccaagaagcaaacgatcaagagctcctgctcctttcgccggaacatggtctccgatgccactggaatccgagcatcagcagcttcactccgccgccaaattcaagccaaagaaagaacaatccggcggaggaggaggaggaggaggaagacatcagtcatcgtcatcggagactacggaaggaggaggaatgaggagatgtactcactgtgcatcggagaaaacgccacagtggaggacaggaccacttggacctaaaacactatgtaacgcttgtggagtccggtttaaatccggtagacttgtaccggaatatagaccggcttcgagtcctacttttgttttgactcagcattcaaactctcaccggaaagtgatggagcttcgacggcagaaagaagttatgagacaaccacaacaagttcaacttcatcaccaccaccacccgttttag

SEQ ID NO: 58 - protein, 264 aa, Arabidopsis thaliana
  G343  (conserved domain in AA coordinates: 178-214)
MDVYGLSSPDLLRIDDLLDFSNEDIFSASSSGGSTAATSSSSFPPPQNPSFHHHHLPSSADHHSFLHDICVPSDDAAHLEWLSQFVDDSFADFPANPLGGTMTSVKTETSFPGKPRSKRSRAPAPFAGTWSPMPLESEHQQLHSAAKFKPKKEQSGGGGGGGGRHQSSSSETTEGGGMRRCTHCASEKTPQWRTGPLGPKTLCNACGVRFKSGRLVPEYRPASSPTFVLTQHSNSHRKVMELRRQKEVMRQPQQVQLHHHHHPF

SEQ ID NO: 59 - DNA, 727 bp, Arabidopsis thaliana
  G353
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcaaa

SEQ ID NO: 60 - protein, 162 aa, Arabidopsis thaliana
  G353  (conserved domain in aa coordinates: 41-61, 84-104)
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 61 - DNA, 628 bp, Arabidopsis thaliana
  G354
cctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccgatcgatgtgaatattattttgatacaataaaa

SEQ ID NO: 62 - protein, 168 aa, Arabidopsis thaliana
  G354  (conserved domain in aa coordinates: 42-62, 88-109)
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 63 - DNA, 922 bp, Arabidopsis thaliana
  G361
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 64 - protein, 197 aa, Arabidopsis thaliana
  G361  (conserved domain in AA coordinates: 43-63)
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 65 - DNA, 977 bp, Arabidopsis thaliana
  G362
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 66 - protein, 211 aa, Arabidopsis thaliana
  G362  (conserved domain in AA coordinates: 62-82)
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 67 - DNA, 582 bp, Arabidopsis thaliana
  G371
atggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaa

SEQ ID NO: 68 - protein, 193 aa, Arabidopsis thaliana
  G371  (conserved domain in aa coordinates: 21-74)
MEIEKDEDDTTLVDSGGDFDCNICLDQVRDPVVTLCGHLFCWPCIHKWTYASNNSRQRVDQYDHKREPPKCPVCKSDVSEATLVPIYGRGQKAPQSGSNVPSRPTGPVYDLRGVGQRLGEGESQRYMYRMPDPVMGVVCEMVYRRLFGESSSNMAPYRDMNVRSRRRAMQAEESLSRVYLFLLCFMFMCLFLF

SEQ ID NO: 69 - DNA, 2526 bp, Arabidopsis thaliana
  G390
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 70 - protein, 841 aa, Arabidopsis thaliana
  G390  (conserved domain in AA coordinates: 18-81)
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 71 - DNA, 2559 bp, Arabidopsis thaliana
  G391
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 72 - protein, 852 aa, Arabidopsis thaliana
  G391  (conserved domain in AA coordinates: 25-85)
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 73 - DNA, 1302 bp, Arabidopsis thaliana
  G409
tgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttgttgtttccatgttgacgataattgttgactcgtggaataattccgctgttcaacggtatttttatcagttgcattatatgcttttatgaaaaaaaaaa

SEQ ID NO: 74 - protein, 272 aa, Arabidopsis thaliana
  G409  (conserved domain in AA coordinates: 64-124)
MESNSFFFDPSASHGNSMFFLGNLNPVVQGGGARSMMNMEETSKRRPFFSSPEDLYDDDFYDDQLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEKLQGKQETANEPPGQVPEPNQLDPVYINAAAIKTEDRLSSGSVGSAVLDDDAPQLLDSCDSYFPSIVPIQDNSNASDHDNDRSCFADVFVPTTSPSHDHHGESLAFWGWP

SEQ ID NO: 75 - DNA, 1501 bp, Arabidopsis thaliana
  G427
tttccctctccgaaacagaaattcaaaaacaaattcaacacgaaaacgatggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgccacagccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggagtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgagatcaagcttgcatgtagagatccaaaagctttatagaaaggtggaggcatgaagacaaagaattcttacacaacaaacgtaggacgtaattttgtgccagtacatggtatggctttcatatttggtaatgattagggccacacaaaattaaaccccaaagcatgatttgtaatatgaggttttagatggactttatgataggatcgtcagtcttcactgccatctccattctccaccatcaatccatcattatatcttgtgaaaaaaaaa

SEQ ID NO: 76 - protein, 393 aa, Arabidopsis thaliana
  G427  (conserved domain in AA coordinates: 307-370)
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 77 - DNA, 2821 bp, Arabidopsis thaliana
  G438
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 78 - protein, 842 aa, Arabidopsis thaliana
  G438  (conserved domain in AA coordinates: 22-85)
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 79 - DNA, 988 bp, Arabidopsis thaliana
  G450
gagttatcgagagagagagaaaacatattctgatttaagacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgttttaatttaaaatataggaaggatataggaaaatataattgtttacaaaaaaataactttaaatatgtcttttttttttttttgaaattagtctgtgtttttgttttcatctcttaattagtagaaatcattttttaatatgtaattgtgatagtaaatctatagagttcgta

SEQ ID NO: 80 - protein, 228 aa, Arabidopsis thaliana
  G450  (conserved domain in aa coordinates: 6-14, 78-89, 112-128, 180-217)
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 81 - DNA, 992 bp, Arabidopsis thaliana
  G464
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctctt

SEQ ID NO: 82 - protein, 239 aa, Arabidopsis thaliana
  G464  (conserved domain in AA coordinates: 20-28, 71-82, 126-142, 187-224)
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 83 - DNA, 2580 bp, Arabidopsis thaliana
  G470
atggcgagttcggaggtttcaatgaaaggtaatcgtggaggagataacttctcctcctctggttttagtgaccctaaggagactagaaatgtctccgtcgccggcgaggggcaaaaaagtaattctacccgatccgctgcggctgagcgtgctttggaccctgaggctgctctttacagagagctatggcacgcttgtgctggtccgcttgtgacggttcctagacaagacgaccgagtcttctattttcctcaaggacacatcgagcaggtggaggcttcgacgaaccaggcggcagaacaacagatgcctctctatgatcttccgtcaaagcttctctgtcgagttattaatgtagatttaaaggcagaggcagatacagatgaagtttatgcgcagattactcttcttcctgaggctaatcaagacgagaatgcaattgagaaagaagcgcctcttcctccacctccgaggttccaggtgcattcgttctgcaaaaccttgactgcatccgacacaagtacacatggtggattttctgttcttaggcgacatgcggatgaatgtctcccacctctggatatgtctcgacagcctcccactcaagagttagttgcaaaggatttgcatgcaaatgagtggcgattcagacatatattccggggtcaaccacggaggcatttgctacagagtgggtggagtgtgtttgttagctccaaaaggctagttgcaggcgatgcgtttatatttctaaggggcgagaatggagaattaagagttggtgtaaggcgtgcgatgcgacaacaaggaaacgtgccgtcttctgttatatctagccatagcatgcatcttggagtactggccaccgcatggcatgccatttcaacagggactatgtttacagtctactacaaacccaggacgagcccatctgagtttattgttccgttcgatcagtatatggagtctgttaagaataactactctattggcatgagattcaaaatgagatttgaaggcgaagaggctcctgagcagaggtttactggcacaatcgttgggattgaagagtctgatcctactaggtggccaaaatcaaagtggagatccctcaaggtgagatgggatgagacttctagtattcctcgacctgatagagtatctccgtggaaagtagagccagctcttgctcctcctgctttgagtcctgttccaatgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 84 - protein, 859 aa, Arabidopsis thaliana
  G470  (conserved domain in AA coordinates: 61-393)
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 85 - DNA, 1218 bp, Arabidopsis thaliana
  G477
atggattcttggagctacgggagaagcgttttcatgtcaaatgaaactcttttaccttgtgatacttttgctaagaatagaagatttgaacagagactctctaataatgatgatgtgttgatttctgacatggctggtaactccaatggattcagtgctgtttctattactaaagttgttcctgaagaggaagatgaggagaacatatcttcttcttcaaagttctctagtcaggaattgaataggatagatttcaaacttaggagctttttggatttaggaaatgatgatgatgatacatcctctagaggttttgctctgccatctaaaaagtctcgagcttcaaacttgtgctctcagaatcccttgtgtcaagtttatgggtgtagtaaggatctgagctcttcgaaagattaccacaaaaggcatagagtttgcgaggctcattcgaaaacttctgtggtcatagttaatggtcttgaacagaggttttgtcaacagtgcagcaggtttcatttcctctcagagtttgatgatggcaaaagaagttgcagaaggcgattagccggtcacaatgaacgaagaaggaaacctgcattctatttcctaccgggtaagcgccataagcttcttcgcacctctcaagatgtagtaggcaacaagtttctggagaattcatcattggtattgccagagtcatttcctggtagtctcttatacagagtaatagatgaagacgaccaccgtacaagtagactcgtgagtttcaaagatgaacctacttgttccatgtttcctactaatgagcaaaacagcagcagaacttatgaatctaaaccagcaatttattccacggaagtatcctccatttgggacttacatgagacggcggcatcacgctctactcgtgctctctctcttctgtcagctcagtcccaacaacacttgtctaagtttccaaacacaacgttctcaatcacccaacccaaccaaaatctcaatcactcatcatcaactgactatcatcagatggaacaaccgttgtggatcgatcctggcaagaccaattctgctggttctagttcttgtaaaggaaaaggaacatccacggttgatctactgcaactgtcatcacatcttcaaagaatcgagcaacagaggaattacactggtgatgtgaagcaggaatataatgagctttatttccctggctcctaa

SEQ ID NO: 86 - protein, 405 aa, Arabidopsis thaliana
  G477  (conserved domain in AA coordinates: 108-233)
MDSWSYGRSVFMSNETLLPCDTFAKNRRFEQRLSNNDDVLISDMAGNSNGFSAVSITKVVPEEEDEENISSSSKFSSQELNRIDFKLRSFLDLGNDDDDTSSRGFALPSKKSRASNLCSQNPLCQVYGCSKDLSSSKDYHKRHRVCEAHSKTSVVIVNGLEQRFCQQCSRFHFLSEFDDGKRSCRRRLAGHNERRRKPAFYFLPGKRHKLLRTSQDVVGNKFLENSSLVLPESFPGSLLYRVIDEDDHRTSRLVSFKDEPTCSMFPTNEQNSSRTYESKPAIYSTEVSSIWDLHETAASRSTRALSLLSAQSQQHLSKFPNTTFSITQPNQNLNHSSSTDYHQMEQPLWIDPGKTNSAGSSSCKGKGTSTVDLLQLSSHLQRIEQQRNYTGDVKQEYNELYFPGS

SEQ ID NO: 87 - DNA, 832 bp, Arabidopsis thaliana
  G481
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 88 - protein, 141 aa, Arabidopsis thaliana
  G481  (conserved domain in AA coordinates: 20-109)
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 89 - DNA, 1065 bp, Arabidopsis thaliana
  G482
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 90 - protein, 190 aa, Arabidopsis thaliana
  G482  (conserved domain in AA coordinates: 25-116)
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 91 - DNA, 922 bp, Arabidopsis thaliana
  G484
attatattccgtacaatccgatcgatttcccggcgccagatctcaccgcgactcgtctactttccgatttggttcgtgttgactcagttacgattaaactatggatccaatggatatagtcggcaaatccaaggaagacgcttctcttccaaaagctacgatgactaaaattataaaggagatgttaccaccagatgttcgtgttgcaagagatgctcaagatcttctcattgaatgttgtgtagagtttataaatcttgtatcttcagaatctaatgatgtttgtaacaaagaggataaacggacgattgctcctgagcatgttctcaaggcattacaggttcttggttttggagaatacattgaagaagtctatgctgcgtatgagcaacataagtatgaaacaatgcaggacacacagaggagcgtgaaatggaaccctggagctcaaatgactgaggaggaagcagcagctgagcaacaacgtatgtttgcagaagcacgtgcaagaatgaatggaggtgtttcggttcctcaacctgaacatccagaaactgaccagagaagtccgcaaagctaactgaaaccgtaagggtaagtgttaggcaagaaaaaacaacatccttttaacattcccttgtaagttgcaaatgcgtatgttctctgtttatatgctcttagtatgatatatgttagttagtgtttcacgatctaaaaacacttgtgattcagatgtaattagtaagcattccttgttttgtgtttactttgtgtcttgactaagcatggtgggtcaggtctacacaaagcatctgattcgatgacttacaggaatcttaatgtttgtagattggataaatttggtgattggtgtaattgtttttccataaacacaatgcaatcattgtttagtgttgttaac

SEQ ID NO: 92 - protein, 159 aa, Arabidopsis thaliana
  G484  (conserved domain in AA coordinates: 11-104)
MDPMDIVGKSKEDASLPKATMTKIIKEMLPPDVRVARDAQDLLIECCVEFINLVSSESNDVCNKEDKRTIAPEHVLKALQVLGFGEYIEEVYAAYEQHKYETMQDTQRSVKWNPGAQMTEEEAAAEQQRMFAEARARMNGGVSVPQPEHPETDQRSPQS

SEQ ID NO: 93 - DNA, 1008 bp, Arabidopsis thaliana
  G489
tggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcgcggccgctctagacaggcctcgtaccggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtccatttgttgtgcttgtaatttactgtgttttttattcggttttcgctatcgaactgtgaaatggaaatggatggagaagagttaatgaatgatatggccttttgttcattctcaaattaa

SEQ ID NO: 94 - protein, 220 aa, Arabidopsis thaliana
  G489  (conserved domain in AA coordinates: 57-156)
MNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 95 - DNA, 588 bp, Arabidopsis thaliana
  G490
atgaggaggccaaagtcatctcacgtcaggatggaacctgttgcgcctcgttcacataacacgatgccaatgcttgatcaatttcgatctaatcatcctgaaacaagcaagatcgagggggtctcttcgttggacacagctctgaaggtgttttggaataatcaaagggagcagctaggaaactttgcaggccaaactcatttgccgctatctagggtcagaaagattttgaaatctgatcctgaagtcaagaagataagctgtgatgttcctgctttgttttcgaaagcctgtgaatacttcattctagaggtaacattacgagcttggatgcatactcaatcatgcactcgtgagaccatccggcgttgtgatatcttccaggccgtaaagaactcaggaacttatgatttcctgattgatcgtgtcccttttggaccgcactgtgtcacccatcagggtgtgcaacctcctgctgaaatgattttgccggatatgaatgttccaatcgatatggaccagattgaggaggagaatatgatggaagagcgctctgtcgggtttgacctcaactgtgatctccagtga

SEQ ID NO: 96 - protein, 195 aa, Arabidopsis thaliana
  G490  (conserved domain in AA coordinates: 48-143)
MRRPKSSHVRMEPVAPRSHNTMPMLDQFRSNHPETSKIEGVSSLDTALKVFWNNQREQLGNFAGQTHLPLSRVRKILKSDPEVKKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGFDLNCDLQ

SEQ ID NO: 97 - DNA, 1125 bp, Arabidopsis thaliana
  G504
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgct

SEQ ID NO: 98 - protein, 323 aa, Arabidopsis thaliana
  G504  (conserved domain in AA coordinates: 19-174)
MENMGDSSIGPGHPHLPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLLREDLMEGMLSKSSANSSSTSVLDNNDNNNNNNEEHFFDGMVVSSDKRSLCGQYRMGHEASGSSSFGSFLSSKRFHHTGDLNNDNYNVSFVSMLSEIPQSSGFHANGVMDTTSSLADHGVLRQAFQLPNMNWHS

SEQ ID NO: 99 - DNA, 1454 bp, Arabidopsis thaliana
  G509
cttcctcctttgctaataaacttttctttgaaccttacacgccttgttgatattactctcttaaatatatattttcgtacattaacacagacatatataaagctaaagatttcttcacgtaatgggtttgaaagatattgggtccaaattgccaccggggtttcgatttcatccaagtgatgaagagttggtttgtcattatctttgcaacaagattagggccaaatctgatcatggtgatgttgatgatgatgatgatgatgttgatgaagctttgaagggttctactgatcttgtggagattgacttgcatatctgtgagccatgggagcttcctgatgtggcaaagttaaacgcaaaggaatggtacttcttcagtttccgtgatcgaaagtatgctactggatatcgcacgaacagagcgacagtaagcggatactggaaagcaacaggaaaagatcgaacggtgatggatccacgtacaaggcaattggtagggatgagaaaaacactagtgttctacagaaacagagcaccaaatgggatcaaaactacttggatcatgcacgagttccgtcttgagtgtcctaacatcccacataaggaagactgggtcttgtgcagagtgttcaacaaaggcagagactcatcgctacaagacaataattattataacaatgataatcagacgcaaaggcttgaagttaatgacgctccggatcttaattacaacaatcagttgccacctttgctatcatcccctcctcataatcatcaacatgagaagatgaaaatccaagtttgtgatcagtgggagcagctaatgaagcagccttcaaggaccaccggccacccctatcatcaccattgtcatcatcaaaccatagcatgtggttgggagcagatgatgatcggttcgctgtcatcaccttcgagtcatggccctgatcacgagtcctttgctaaatttgctttaccgtcgacaataacaacagtgtcaacatcagtggtgatcatcatcagaattatgagaagattttgttgtcatcactagacatgacgagtttggatcacgacaagacatgtatgggatcatcatcggatggtggtatggtctctgatcttcacatggaatgtggtggattgagttttgagaccgaaaatatcctcgctttccaatgaacataattcaaggggttcgccaatttgttgattcgtgaattatacaaacattttatctatagatttatcacattatcaaacatgtaagttgtgtggcatttgggtatagggtttgtgtgattctaggtttttaggacgatgtatgttgttatatttagcgtgtttttaggatttattctcattttaaaattatatgaaaacccattactatgaatacaattagttttctttgttgtaaataatattttagattatcaaaaaaaaaaaaaaaa

SEQ ID NO: 100 - protein, 310 aa, Arabidopsis thaliana
  G509  (conserved domain in AA coordinates: 13-169)
MGLKDIGSKLPPGFRFHPSDEELVCHYLCNKIRAKSDHGDVDDDDDDVDEALKGSTDLVEIDLHICEPWELPDVAKLNAKEWYFFSFRDRKYATGYRTNRATVSGYWKATGKDRTVMDPRTRQLVGMRKTLVFYRNRAPNGIKTTWIMHEFRLECPNIPHKEDWVLCRVFNKGRDSSLQDNNYYNNDNQTQRLEVNDAPDLNYNNQLPPLLSSPPHNHQHEKMKIQVCDQWEQLMKQPSRTTGHPYHHHCHHQTIACGWEQMMIGSLSSPSSHGPDHESFAKFALPSTITTVSTSVVIIIRIMRRFCCHH

SEQ ID NO: 101 - DNA, 1254 bp, Arabidopsis thaliana
  G519
cacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagattcagaagaactgtaaaagcaattgtgaccacccgttatgaatcataaatatattcaatgaagcatgagcttattttttttttaaaaaaaaa

SEQ ID NO: 102 - protein, 269 aa, Arabidopsis thaliana
  G519  (conserved domain in AA coordinates: 11-104)
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 103 - DNA, 890 bp, Arabidopsis thaliana
  G545
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 104 - protein, 227 aa, Arabidopsis thaliana
  G545  (conserved domain in AA coordinates: 82-102, 136-154)
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 105 - DNA, 558 bp, Arabidopsis thaliana
  G546
atgactcgaccgtcaagattacttgagacggcggcgccaccaccacaaccgtcggaggagatgatcgcagcggaatccgacatggtggtgatcttgtcggctcttctttgcgctcttatctgcgttgctggtctcgccgccgtcgtacgatgcgcttggctccggcggtttacagccggaggagattcgccgtcaccgaacaaaggcttgaaaaagaaagctcttcagtctcttccaagatccactttcaccgccgcggaatcaacctccggcgccgccgctgaagagggagactcgacggaatgtgctatttgcctcactgacttcgccgacggtgaagaaataagagtgcttcctctttgtggtcattctttccacgtggagtgtattgacaaatggctagtttctaggtcttcttgtccttcttgtcgcaggattcttacgccggtgagatgtgaccggtgtggtcatgcttctacggcggagatgaaagatcaagctcatcgtcatcaacatcaccaacactcttctactaccattcctacgtttcttccttaa

SEQ ID NO: 106 - protein, 185 aa, Arabidopsis thaliana
  G546  (conserved domain in AA coordinates:114-155)
MTRPSRLLETAAPPPQPSEEMIAAESDMVVILSALLCALICVAGLAAVVRCAWLRRFTAGGDSPSPNKGLKKKALQSLPRSTFTAAESTSGAAAEEGDSTECAICLTDFADGEEIRVLPLCGHSFHVECIDKWLVSRSSCPSCRRILTPVRCDRCGHASTAEMKDQAHRHQHHQHSSTTIPTFLP

SEQ ID NO: 107 - DNA, 1413 bp, Arabidopsis thaliana
  G561
aatttgtttttttttcttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattgatgtaatatggtttaagagattcggtgttctctggtgtgtgctgcaaccacataattggtgatagataggtttagttatataagcaaatgtattagagataaggggagacatatttgatggtcttt

SEQ ID NO: 108 - protein, 360 aa, Arabidopsis thaliana
  G561  (conserved domain in AA coordinates: 248-308)
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 109 - DNA, 1554 bp, Arabidopsis thaliana
  G562
atttgaatttctgggtttctctctgtttaagcttcttcttcttcatcttctgcttacgtttcttcttcaaggagctttcggattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttggtgttatggtttgttactgttaatatagagaggcttttctttttttataaaatggcttcctttgttgca

SEQ ID NO: 110 - protein, 382 aa, Arabidopsis thaliana
  G562  (conserved domain in AA coordinates: 253-315)
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 111 - DNA, 1479 bp, Arabidopsis thaliana
  G567
aaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataaaaaaaaaaaaaaaaa

SEQ ID NO: 112 - protein, 411 aa, Arabidopsis thaliana
  G567  (conserved domain in AA coordinates: 210-270)
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVNVDSDDYRRVLKNKLEAECATGVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 113 - DNA, 1294 bp, Arabidopsis thaliana
  G568
gaccggctaaagtcaagaacctctctctgagctctcaccactttctctctctactccctctctgcgtgtaggatactactagacaattgacaaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtactaacttatacttgtattcttg

SEQ ID NO: 114 - protein, 284 aa, Arabidopsis thaliana
  G568  (conserved domain in AA coordinates: 215-265)
MLSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQAYTNELELEVAHLQAENARLKRQQDQKMAAAIQQPKKNTLQRSSTAPF

SEQ ID NO: 115 - DNA, 2162 bp, Arabidopsis thaliana
  G584
aaaaagtcttctcttttataactacgtcagagaactgttatgtctccgacgaatgttcaagtaaccgattaccatctcaaccaatcaaaaacggatacaacaaatctctggtcaaccgacgacgatgcatcggtaatggaagctttcatcggcggcggctccgatcattcttctctttttcctccacttcctcctcctcctcttcctcaagtcaacgaagataatctccagcaacgtctccaagctttaatcgaaggagcaaacgagaactggacttacgccgtgttctggcaatcatctcacggtttcgccggagaagacaacaacaacaacaacacagtgttgttaggttggggagatggttattacaaaggagaagaagagaagtctagaaagaagaaatcaaatccagctagtgcagctgaacaagagcatcgtaagagagtgattagagagctcaactctttaatctccggtggtgtaggaggaggagatgaagctggagatgaagaagttacagatactgaatggttcttcttagtttcaatgacacagagctttgtcaagggtactggtttacctggtcaagctttctcaaattcagacacgatttggttatctggttctaatgctttagctggatcaagttgtgagagagctcgtcaaggtcagatttatgggttacaaacaatggtgtgtgtagcgacagagaatggtgtcgttgagcttggttcgtcggagattattcatcaaagttcagatcttgttgataaagttgacacctttttcaattttaacaatggtggtggtgaatttggttcttgggcgtttaatttgaatccagatcaaggagagaatgatccaggtttgtggattagtgaacctaatggtgttgactctggtcttgtagctgctccggtgatgaataatggtggaaatgactcaacttctaattctgattctcaaccaatttctaagctttgtaatggaagctctgttgaaaaccctaaccctaaagttctgaaatcttgtgaaatggtgaatttcaagaatgggattgagaatggtcaagaagaagatagtagtaataagaagagatcaccggtttcgaataatgaagaagggatgctttcttttacctctgttcttccatgtgactcgaatcactctgatcttgaagcttcagtggctaaagaagctgagagtaacagagttgtggttgaaccggagaagaaaccgaggaaacgagggagaaaaccggcgaatggaagagaagagcctttgaatcatgtagaggcagagagacagagaagagagaagttgaatcagagattctattctttaagagctgtggttcctaatgtgtctaagatggataaagcttctctattaggagatgctatttcgtatatcagtgagcttaagtctaagttgcaaaaggctgaatctgataaagaagagttgcagaagcagattgatgtgatgaataaagaagcgggaaatgcgaaaagttcggtaaaagatcgaaaatgtttgaatcaagaatcgagtgtgttgatagagatggaggttgatgtgaagattattggttgggatgcaatgataaggattcaatgtagtaagaggaatcatcctggtgctaagttcatggaagcacttaaggagttggatttggaagtgaatcatgcgagtttatcggtagtgaatgatcttatgatccaacaagcgactgtgaaaatggggaatcagtttttcacgcaagatcaactcaaggttgctctaacggagaaagttggagaatgtccatgaattgaagtcagcatctttagggctaatacaccggagaatactgcgaaaagtcgaaaacaacgatcatagtataagccgcggtaaaaagtgttaaacctttcacacaagtttctctagtgaatgtagttgtaaactctattgtgtaagggtaattttgtagtacccacttgttgctattgaatgcttgttagagaggattcttagtgtagtatatgattaggttggggtttgttgtttcatgagataaataaatgtgtttgatcaatggttaagtctttggtttgttggtgtatgtatgtaaataaggcttttgttagaaataagacaaatgggactgaagttggagtttaaaa

SEQ ID NO: 116 - protein, 589 aa, Arabidopsis thaliana
  G584  (conserved domain in AA coordinates: 401-494)
MSPTNVQVTDYHLNQSKTDTTNLWSTDDDASVMEAFIGGGSDHSSLFPPLPPPPLPQVNEDNLQQRLQALIEGANENWTYAVFWQSSHGFAGEDNNNNNTVLLGWGDGYYKGEEEKSRKKKSNPASAAEQEHRKRVIRELNSLISGGVGGGDEAGDEEVTDTEWFFLVSMTQSFVKGTGLPGQAFSNSDTIWLSGSNALAGSSCERARQGQIYGLQTMVCVATENGVVELGSSEIIHQSSDLVDKVDTFFNFNNGGGEFGSWAFNLNPDQGENDPGLWISEPNGVDSGLVAAPVMNNGGNDSTSNSDSQPISKLCNGSSVENPNPKVLKSCEMVNFKNGIENGQEEDSSNKKRSPVSNNEEGMLSFTSVLPCDSNHSDLEASVAKEAESNRVVVEPEKKPRKRGRKPANGREEPLNHVEAERQRREKLNQRFYSLRAVVPNVSKMDKASLLGDAISYISELKSKLQKAESDKEELQKQIDVMNKEAGNAKSSVKDRKCLNQESSVLIEMEVDVKIIGWDAMIRIQCSKRNHPGAKFMEALKELDLEVNHASLSVVNDLMIQQATVKMGNQFFTQDQLKVALTEKVGECP

SEQ ID NO: 117 - DNA, 2299 bp, Arabidopsis thaliana
  G585
ctctcaaacatttctctgtttgttccggcgaaaacggcaactgtttcatcaaatgacaaacacaaaaaccttaacatctagtttgtatcctctctgatacttcaaaaaaaatggatgaagaaacaatggctaccggacaaaacagaacaactgtgccagagaatctgaagaaacacctcgcagtttcagttcgaaacattcaatggagttatggtatcttttggtctgtctctgcttctcagtctggagttttagaatggggagatggatactataatggagatatcaaaacgaggaagacgattcaagcttcggagatcaaagctgatcagcttggtctacggaggagcgagcagcttagcgagctttacgagtctctctccgtcgctgaatcttcttcttcaggcgttgctgccggatctcaagtcaccagacgagcttccgccgccgcactttcaccggaagatctcgccgacaccgagtggtactatttggtttgtatgtctttcgtcttcaacattggtgaaggaatgcctggacggacgtttgcaaacggtgaaccgatatggttgtgcaacgctcatacggcggatagtaaagtgtttagccgttctcttctagcaaaaagtgctgcggttaagacagtggtttgcttcccgttccttggaggagtcgttgagattggtaccacagaacatattacggaagacatgaatgtaatacaatgcgtgaagacatcattcctcgaagcccctgatccgtacgctacaatattaccagcaagatccgattatcacatcgacaacgttcttgatccgcaacagattctaggcgacgagatttacgcgcctatgttcagtacggagccttttccaacagcttctccgagcagaactaccaacggtttcgatcaagaacatgaacaagtagcagatgatcatgattctttcatgaccgaaagaatcactggaggagcttctcaggtgcaaagctggcagctcatggacgacgagcttagtaactgcgttcaccagtcgctaaattccagcgattgcgtctctcaaacgtttgttgaaggggcggctggacgggttgcttacggtgcaagaaagagtagagttcaaagactagggcaaattcaagagcaacagagaaatgtgaagacattgtcatttgatccaagaaacgacgacgttcattaccaaagtgtgatctcaacgatttttaagaccaaccatcagttaattctcggaccgcagtttcgaaactgcgataaacagtcaagcttcactaggtggaagaaatcatcgtcatcatcatcaggaaccgccacggtcacggcaccatcacaaggaatgttaaagaaaattattttcgatgttccgcgagtgcaccagaaagagaagttaatgttggactcaccagaagccagagatgaaactgggaaccatgcggttttagagaagaagcgccgcgagaaattgaacgaacggttcatgaccttgagaaaaatcattccgtcaatcaacaagatcgataaagtatcgattcttgacgatacgatagagtatcttcaagaactcgagagacgggttcaagaactagaatcttgcagagaatcaaccgatacagagactcgtgggacgatgacgatgaagaggaagaaaccatgcgacgcaggagaaagaacatcagctaattgcgcaaataatgaaacaggaaatgggaagaaggtgtcggttaacaatgttggtgaagccgagccagcagataccggttttactggtttaaccgataatttaaggatcggttcgtttggtaatgaggtggttattgagcttagatgtgcttggagagaaggagtattgcttgagataatggatgtgattagtgatctccatttggattctcattcggttcaatcctcgaccggagacggtttgctctgcttaaccgtcaattgcaagcacaaggggtcaaaaatagcgacaccaggaatgatcaaagaagcacttcaaagggttgcatggatctgttgaagactacttagttaaaattgacagcaaagaaaaaacattcccggtttggtttctattctttggttttcttctaaccgggttttaggaattaatgttatgtttatcatttgttttttgttttttttttgtgtctttttttccgttgcttaacgtaggtgaagaggaacatacactatgcgtattttgtttgaggtagattattttaagggtattagtaatagtaatagccagtttagatgattttgtgttcttttgttgtt

SEQ ID NO: 118 - protein, 642 aa, Arabidopsis thaliana
  G585  (conserved domain in AA coordinates:436-501)
MDEETMATGQNRTTVPENLKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSFLEAPDPYATILPARSDYHIDNVLDPQQILGDEIYAPMFSTEPFPTASPSRTTNGFDQEHEQVADDHDSFMTERITGGASQVQSWQLMDDELSNCVHQSLNSSDCVSQTFVEGAAGRVAYGARKSRVQRLGQIQEQQRNVKTLSFDPRNDDVHYQSVISTIFKTNHQLILGPQFRNCDKQSSFTRWKKSSSSSSGTATVTAPSQGMLKKIIFDVPRVHQKEKLMLDSPEARDETGNHAVLEKKRREKLNERFMTLRKIIPSINKIDKVSILDDTIEYLQELERRVQELESCRESTDTETRGTMTMKRKKPCDAGERTSANCANNETGNGKKVSVNNVGEAEPADTGFTGLTDNLRIGSFGNEVVIELRCAWREGVLLEIMDVISDLHLDSHSVQSSTGDGLLCLTVNCKHKGSKIATPGMIKEALQRVAWIC

SEQ ID NO: 119 - DNA, 1292 bp, Arabidopsis thaliana
  G590
tcgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattacttgaacagtgtcccaacttcgggatctctatgtgttcttgtttcttagaacgcaagccataaagctgtctgac

SEQ ID NO: 120 - protein, 373 aa, Arabidopsis thaliana
  G590  (conserved domain in AA coordinates: 202-254)
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 121 - DNA, 1292 bp, Arabidopsis thaliana
  G594
agaaaagataagagccttttaaagttttttttttaccttctcttcatggacttgtctgtacttgataggcttaagtggctgcaacagcaacaaatggtttcacctgagtttcttcagatacttggctcagatgggagagaagagctcaaaagagttgagagttacttgggaaacaacaatgatgagctgcagagtttcagacattttcccgaattcggaccggattatgatactactgatggctgcatttctaggacaagtagcttccatatggagccagtgaagaataatggacacagcagagccattaccttgcagaacaagagaaaaccagagggtaagacagaaaagagagagaagaagaagatcaaagcagaggatgaaacagagccaagcatgaaagggaaatcaaacatgagtaacacagagacatcttcagaaattcagaaaccagattacattcatgttagggctagacgaggtgaagccaccgacagacatagcttagcagagagggcaagaagagaaaagataagcaagaagatgaaatgtctacaagatattgttcctggatgcaacaaagttactggaaaagctggtatgcttgatgagatcatcaactatgtccaatctctgcaacaacaagtcgagttcttgtcgatgaaactctctgtcataaatccagaacttgagtgtcatatcgatgatttatccgcaaaacagtttcaggcttacttcacaggtcctccagaaggtgactcgaagcagtcaatcatggcggattttcggtcttttccattacatcagcaaggatctttagattactcagtcataaactcagaccacaccacatctctcggcgctaaagatcatacatcatcaagctgggaaactcactcacagtgtctttacaacagcttgagaaccgattctgtttccaatttcttcagcctcaagtaaaaaaattagggatagcctcattaaaaaaatcgcggttttttgttgttgtcttatccatttatctatcttatctgaaatttgaaccagaaagacagaggaaaccaatccaaagatctttctcaatctattatcttcatacaaatatagtgatttacatatattccaggggatatgtatatgtgtagaagaaagagaaaaaactcttgtggtcatagcaattcctttttttgtacattgtagaatcaaactcttgtggtcgtaacaattatttccttcacaaattacaactacacttgtattaatggagatgccttttggccctgggatcaaca

SEQ ID NO: 122 - protein, 304 aa, Arabidopsis thaliana
  G594  (conserved domain in AA coordinates: 140-204)
MDLSVLDRLKWLQQQQMVSPEFLQILGSDGREELKRVESYLGNNNDELQSFRHFPEFGPDYDTTDGCISRTSSFHMEPVKNNGHSRAITLQNKRKPEGKTEKREKKKIKAEDETEPSMKGKSNMSNTETSSEIQKPDYIHVRARRGEATDRHSLAERARREKISKKMKCLQDIVPGCNKVTGKAGMLDEIINYVQSLQQQVEFLSMKLSVINPELECHIDDLSAKQFQAYFTGPPEGDSKQSIMADFRSFPLHQQGSLDYSVINSDHTTSLGAKDHTSSSWETHSQCLYNSLRTDSVSNFFSLK

SEQ ID NO: 123 - DNA, 1538 bp, Arabidopsis thaliana
  G597
aaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatgtgagaagaaaatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccgatgagatcagtatcaccaccgcagcagtaccaacccaactcagctggtgagaattctgtcttgaacatgaacttgcccggaggtgagtctggaggcatgactggaactggaagtgagccagtgaaaaagaggagaggtagaccgaggaaatatgggcctgatagtggtgaaatgtcacttggtttgaatcctggagctccttctttcactgtcagccaacctagtagcggcggcgatggaggagagaagaagagaggaagacctcctggttcttctagcaaaaggctcaagcttcaagctttaggctcgactggaatcggatttacgcctcatgtacttaccgtgctggctggagaggatgtatcatccaagataatggcgttaactcataatggaccccgtgctgtgtgtgtcttgtctgcaaatggagccatctccaatgtgactctccgccagtctgccacatccggtggaactgttacatatgaggggagatttgagattctgtctttatcgggatctttccatttgctggagaacaatggtcaaagaagcaggacgggaggtctaagcgtgtcattatcaagtccggatggtaatgtcctcggtggcagtgtagctggtcttcttatagcagcatcacctgttcagattgttgttgggagtttcttaccagacggagaaaaagaaccaaaacagcatgtgggacaaatgggactgtcgtcacccgtattaccgcgtgtggccccaacgcaggtgctgatgactccaagtagcccacaatctcgaggcacaatgagtgagtcatcttgtggaggaggacatggaagccctattcatcagagcactggaggaccttacaataacaccattaacatgccctggaagtagccaagtgatctgtgtcggcttaaaaccaacaacttcccgttattagagtgatttatttctacatttggtttagactttctagttctgatggttatttctacagttggtttagactttctagttctgttcagacaaaaggagtttgataaattgaccgacctattttgtgtgtttgaggtactttcagaaccataggtgttcagaaattagaatgttctgtttaaaaaa

SEQ ID NO: 124 - protein, 351 aa, Arabidopsis thaliana
  G597  (conserved domain in AA coordinates: 97-104,137-144)
MSGSETGLMAATRESMQFTMALHQQQQHSQAQPQQSQNRPLSFGGDDGTALYKQPMRSVSPPQQYQPNSAGENSVLNMNLPGGESGGMTGTGSEPVKKRRGRPRKYGPDSGEMSLGLNPGAPSFTVSQPSSGGDGGEKKRGRPPGSSSKRLKLQALGSTGIGFTPHVLTVLAGEDVSSKIMALTHNGPRAVCVLSANGAISNVTLRQSATSGGTVTYEGRFEILSLSGSFHLLENNGQRSRTGGLSVSLSSPDGNVLGGSVAGLLIAASPVQIVVGSFLPDGEKEPKQHVGQMGLSSPVLPRVAPTQVLMTPSSPQSRGTMSESSCGGGHGSPIHQSTGGPYNNTINMPWK

SEQ ID NO: 125 - DNA, 1226 bp, Arabidopsis thaliana
  G598
gtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagattatgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagtataatgtaggttcattcaacaatcgtctaaatgaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaatttttagttatatcaaaccattaaattaaacagtactcgttatatatctagttagtaaacaaaggggcagttttatagctcatgtacacataattgagagtgtagtactgttgtgtcaaa

SEQ ID NO: 126 - protein, 263 aa, Arabidopsis thaliana
  G598  (conserved domain in AA coordinates: 205-263)
MLTLYHQERSPDATSNDRDETPETVVREVHALTPAPEDNSRTMTATLPPPPAFRGYFSPPRSATTMSEGENFTTISREFNALVIAGSSMENNELMTRDVTQREDERQDELMRIHEDTDHEEETNPLAIVPDQYPGSGLDPGSDNGPGQSRVGSTVQRVKREEVEAKITAWQTAKLAKINNRFKREDAVINGWFNEQVNKANSWMKKIEYNVGSFNNRLNEEARGEKSKSDGENAKQCGESAEESGGEKSDGRGKERDRGCKSS

SEQ ID NO: 127 - DNA, 798 bp, Arabidopsis thaliana
  G634
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatga

SEQ ID NO: 128 - protein, 265 aa, Arabidopsis thaliana
  G634  (conserved domain in aa coordinates: 62-147, 189-245)
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 129 - DNA, 993 bp, Arabidopsis thaliana
  G635
atggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaa

SEQ ID NO: 130 - protein, 330 aa, Arabidopsis thaliana
  G635  (conserved domain in AA coordinates: 239-323)
MEIMRPGVSENTLKGKIRITTRCMWLDKGRLLDALHKAAHAALSSCPVTCPLSHMERTVSEVLRKIVRKYSGKRPEVIAIATENPMAVRADEVSARLSGDPSVGSGVAALRKVVEGNDKRSRAKKAPSQEASPKEVDRTLEDDIIDSARLLAEEETAASTYTEEVDTPVGSSSEESDDFWKSFINPSSSPSPSETENMNKVADTEPKAEGKENSRDDDELADASDSETKSSPKRVRKNKWKPEEIKKVIRMRGELHSRFQVVKGRMALWEEISSNLSAEGINRSPGQCKSLWASLIQKYEESKADERSKTSWPHFEDMNNILSELGTPAS

SEQ ID NO: 131 - DNA, 1913 bp, Arabidopsis thaliana
  G636
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttcgaaccggtttggtggtgaaagattagtaatctttttttaagttttgatacagaacatgagaatttaaatattggagggttt

SEQ ID NO: 132 - protein, 602 aa, Arabidopsis thaliana
  G636  (conserved domain in AA coordinates: 55-145, 405-498)
MQLGGGTPTTTAAATTVTTATAPPPQSNNNDSAATEAAAAAVGAFEVSEEMHDRGFGGNRWPRQETLALLKIRSDMGIAFRDASVKGPLWEEVSRKMAEHGYIRNAKKCKEKFENVYKYHKRTKEGRTGKSEGKTYRFFDQLEALESQSTTSLHHHQQQTPLRPQQNNNNNNNNNNNSSIFSTPPPVTTVMPTLPSSSIPPYTQQINVPSFPNISGDFLSDNSTSSSSSYSTSSDMEMGGGTATTRKKRKRKWKVFFERLMKQVVDKQEELQRTFLEAVEKREHKRLVREESWRVQEIARINREHEILAQERSMSAAKDAAVMAFLQKLSEKQPNQPQPQPQPQQVRPSMQLNNNNQQQPPQRSPPPQPPAPLPQPIQAVVSTLDTTKTHNRGDQNMTPAASASSSRWPKVEIEALIKLRTNLDSKYQENGPKGPLWEEISAGMRRLGFNRNSKRCKEKWENINKYFKKVKESNKKRPEDSKTCPYFHQLDALYRERNKFHSNNNIAASSSSSGLVKPDNSVPLMVQPEQQWPPAVTTATTTPAAAQPDQQSQPSEQNFDDEEGTDEEYDDEDEEEENEEEEGGEFELVPSNNNNNKTTNNL

SEQ ID NO: 133 - DNA, 2136 bp, Arabidopsis thaliana
  G638
gaattaaaaggtttaacctttacctttttttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcataaaggacctctttgggatgaagtttctaggattatgtccgaggaacatggataccaaaggagtgggaagaaatgcagagagaagtttgagaatctgtacaaatactatagtaagactaaagaaggcgaagccggaagacaagacggaaaacatcacagatttttccgccagctccaagcgctatacggggattctaataacttggtttcttgtcccaatcataacacgcagttcatgagcagtgctcttcatggtttccatactcaaaaccctatgaacgttgctacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggctttaaccaacgtacgattatatattatgttttcatgtatttattctgtaagactttttaatatcaatctttctctaaa

SEQ ID NO: 134 - protein, 591 aa, Arabidopsis thaliana
  G638  (conserved domain in AA coordinates: 119-206)
MDQDQHPQYGIPELRQLMKGGGRTTTTTPSTSSHFPSDFFGFNLAPVQPPPHRLHQFTTDQDMGFLPRGIHGLGGGSSTAGNNSNLNASTSGGGVGFSGFLDGGGFGSGVGGDGGGTGRWPRQETLTLLEIRSRLDHKFKEANHKGPLWDEVSRIMSEEHGYQRSGKKCREKFENLYKYYSKTKEGEAGRQDGKHHRFFRQLQALYGDSNNLVSCPNHNTQFMSSALHGFHTQNPMNVATTTSNIHNVDSVHGFHQSLSLSNNYNSSELELMTSSSEGNDSSSRRKKRSWKAKIKEFIDTNMKRLIERQDVWLEKLTKVIEDKEEQRMMKEEEWRKIEAARIDKEHLFWAKERARMEARDVAVIEALQYLTGKPLIKPLCSSPEERTNGNNEIRNNSETQNENGSDQTMTNNVCVKGSSSCWGEQEILKLMEIRTSMDSTFQEILGGCSDEFLWEEIAAKLIQLGFDQRSALLCKEKWEWISNGMRKEKKQINKKRKDNSSSCGVYYPRNEENPIYNNRESGYNDNDPHQINEQGNVGSSTSNANANANVTTGNPSGAMAASTNCFPFFMGDGDQNLWESYGLRLSKEENQ

SEQ ID NO: 135 - DNA, 606 bp, Arabidopsis thaliana
  G652
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 136 - protein, 201 aa, Arabidopsis thaliana
  G652  (conserved domain in AA coordinates:28-49, 137-151, 182-196)
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 137 - DNA, 1033 bp, Arabidopsis thaliana
  G663
gtcgacccacgcgtccgtgggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaaaaaaaaaaaaaaaaaaaaaaaaaaaaaa

SEQ ID NO: 138 - protein, 249 aa, Arabidopsis thaliana
  G663  (conserved domain in AA coordinates: 9-111)
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKKHESSCCKSKMKKKNIISPPTTPVQKIGVFKPRPRSFSVNNGCSHLNGLPEVDLIPSCLGLKKNNVCENSITCNKDDEKDDFVNNLMNGDNMWLENLLGENQEADAIVPEATTAEHGATLAFDVEQLWSLFDGETVELD

SEQ ID NO: 139 - DNA, 1087 bp, Arabidopsis thaliana
  G664
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaaaaaaaaaaaaaaaa

SEQ ID NO: 140 - protein, 282 aa, Arabidopsis thaliana
  G664  (conserved domain in AA coordinates: 13-116)
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 141 - DNA, 786 bp, Arabidopsis thaliana
  G674
atggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaa

SEQ ID NO: 142 - protein, 261 aa, Arabidopsis thaliana
  G674  (conserved domain in AA coordinates: 20-120)
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 143 - DNA, 612 bp, Arabidopsis thaliana
  G676
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtttaaagagatgtggaaagagttgtagattgaggtggatgaattatctcagccctaatgtgaaaagaggcaatttcaccgagcaagaagaggatcttatcattaggctccacaagttgcttggtaataggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 144 - protein, 203 aa, Arabidopsis thaliana
  G676  (conserved domain in AA coordinates: 17-119)
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 145 - DNA, 2526 bp, Arabidopsis thaliana
  G680
cagttatcttcttccttcttctctctgttttttaaatttatttttagagaattttttttgttttgcttccgatttgattatttccgggaacgatgacttctccggggagttcccggtgagatgataagtcagattgcatacttgtctcctccatggctactctcaagggttttggctgcggtggattcgtttggtttctctagaatctaaagaggttatcacaacggctttgcaatttgaaaactttcatgtttggggagatcaaagatggtttcttttttatactttacttgttagagaggatttgaagcagcgaatagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtcttta

SEQ ID NO: 146 - protein, 645 aa, Arabidopsis thaliana
  G680  (conserved domain in AA coordinates: 24-70)
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 147 - DNA, 228 bp, Arabidopsis thaliana
  G682
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 148 - protein, 75 aa, Arabidopsis thaliana
  G682  (conserved domain in AA coordinates: 27-63)
MDNHRRTKQPKTNSIVTSSSEEVSSLEWEVVNMSQEEEDLVSRMHKLVGDRWELIAGRIPGRTAGEIERFWVMKN

SEQ ID NO: 149 - DNA, 705 bp, Arabidopsis thaliana
  G715
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaagggtaa

SEQ ID NO: 150 - protein, 234 aa, Arabidopsis thaliana
  G715  (conserved domain in AA coordinates: 60-132)
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 151 - DNA, 2209 bp, Arabidopsis thaliana
  G720
ctttgaatgtgactcaggatagagagagggcgagacagataaagagagcttgaggaaggatttaagcagatctgcaagaaacactctctcagtgtttactttttttccgtagaatcaaaccggcggcgacagtgacggcggcgaaaagcggcggtgttggccgcaaaaacgatgcaaaaccagctatggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctgacgtgtccatgatgaaacagaacccgcagatatgatgacgtcatgcgtggcgtacttgtccgtgtctgacgatccgaagcgggaactgattcggatcctgagagttgttttttaattgttgtttttaattttttgttgtcataaaaacatttgtctctattggtattattaaagaagatcggacggtggagatagaggcaacgatgttagtctgaggaccacaagtggactctgcggctgtaagtagatctcggacacgggattttgacaagtcggaatctgacgtgtgtgcgtactcgcttttgtgggttgtcgagaatttaatagttgacactgttttaggtggatatgagatatgatgatgataataataaaaaggtacaactcaaagattccgtgatgaaaaaaaaaaaaaaa

SEQ ID NO: 152 - protein, 535 aa, Arabidopsis thaliana
  G720  (conserved domain in AA coordinates: 301-349)
MVITANDLSKWENFPKGLKVLLLLNGCDSDGDGSSAAETRSELESMDYIVTTFTDETEALSAVVKNPESFHIAIVEVNMSAESESFKFLEAAKDVLPTIMISTDHCITTTMKCIALGAVEFLQKPLSPEKLKNIWQHVVHKAFNDGGSNVSISLKPVKESVVSMLHLETDMTIEEKDPAPSTPQLKQDSRLLDGDCQENINFSMENVNSSTEKDNMEDHQDIGESKSVDTTNRKLDDDKVVVKEERGDSEKEEEGETGDLISEKTDSVDIHKKEDETKPINKSSGIKNVSGNKTSRKKVDWTPELHKKFVQAVEQLGVDQAIPSRILELMKVGTLTRHNVASHLQKFRQHRKNILPKDDHNHRWIQSRENHRPNQRNYNVFQQQHRPVMAYPVWGLPGVYPPGAIPPLWPPPLQSIGQPPPWHWKPPYPTVSGNAWGCPVGPPVTGSYITPSNTTAGGFQYPNGAETGFKIMPASQPDEEMLDQVVKEAISKPWLPLPLGLKPPSAESVLAELTRQGISAVPSSSCLINGSHRLR

SEQ ID NO: 153 - DNA, 513 bp, Arabidopsis thaliana
  G736
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacggtaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctga

SEQ ID NO: 154 - protein, 170 aa, Arabidopsis thaliana
  G736  (conserved domain in AA coordinates: 54-111)
MATQDSQGIKLFGKTIAFNTRTIKNEEETHPPEQEATIAVRSSSSSDLTAEKRPDKIIACPRCKSMETKFCYFNNYNGNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 155 - DNA, 1707 bp, Arabidopsis thaliana
  G748
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 156 - protein, 448 aa, Arabidopsis thaliana
  G748  (conserved domain in AA coordinates: 112-140)
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 157 - DNA, 766 bp, Arabidopsis thaliana
  G779
gacatgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 158 - protein, 200 aa, Arabidopsis thaliana
  G779  (conserved domain in AA coordinates: 126-182)
MKMENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRNVRISDDPQTVVARRRRERISEKIRILKRIVPGGAKMDTASMLDEAIRYTKFLKRQVRILQPHSQIGAPMANPSYLCYYHNSQP

SEQ ID NO: 159 - DNA, 1913 bp, Arabidopsis thaliana
  G789
ggcaagaagaaccttagcctctctttcttctttctctctctctctctctgtggtactgttctgtttcaactttactccctcagtttcagaacaattccctatctagaagagagataaaaccgagaaggttttggagatagaatcttttgttcttcttttgtccctccttgctcgatttttgttacgtgtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccc

SEQ ID NO: 160 - protein, 444 aa, Arabidopsis thaliana
  G789  (conserved domain in AA coordinates: 253-313)
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNRSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 161 - DNA, 1009 bp, Arabidopsis thaliana
  G801
gatagtgataacgaaatcctaattccatggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttgagaaatggtattgtctttttggtaatgtatagaaaaattcctatgttttatgtcatcgaaagtgtttagaaagtacctctaatttgcggtttcttttgctccttttttacttaatttaagcttattgcttgtttgattagggttttagggtttaagaatatttggtctcgttaatttgtttcggagagtgatagaaagagagagagattgattgattgttgtacctaaaacgctataaaagctctgtttttactagcgaaaaaa

SEQ ID NO: 162 - protein, 239 aa, Arabidopsis thaliana
  G801  (conserved domain in AA coordinates: 32-93)
MADNDGAVSNGIIVEQTSNKGPLNAVKKPPSKDRHSKVDGRGRRIRMPIICAARVFQLTRELGHKSDGQTIEWLLRQAEPSIIAATGTGTTPASFSTASLSTSSPFTLGKRVVRAEEGESGGGGGGGLTVGHTMGTSLMGGGGSGGFWAVPARPDFGQVWSFATGAPPEMVFAQQQQPATLFVRHQQQQQASAAAAAAMGEASAARVGNYLPGHHLNLLASLSGGANGSGRREDDHEPR

SEQ ID NO: 163 - DNA, 2214 bp, Arabidopsis thaliana
  G849
aactcgagaattcttcatttcttttaaatcttagaatctcgagtttttgtataaatcgattctaatttttcctttgtacattgttttatatatacataaaacacacaaatcgggtatgggggaatttgggttttaagatagcgtgatctgtaataataagtggttcgcgatcgtgatcaagaaactggtggctgatagtgatatgcatatttgagagatggtgttcaagagaaagttagattgcctttccgtgggatttgattttcccaacattcccagagctcctcgttcatgcaggaggaaggttctaaacaagaggattgatcatgatgatgataacactcagatctgtgcaattgacttactagctttggctggaaagattctacaggaaagcgagagttcctctgcgtcttctaatgcatttgaagaaattaagcaagagaaagtagaaaattgcaagactattaaatctgagtcttctgaccaaggaaactctgtgtcaaagcctacttatgatatctctactgagaagtgtgtggtgaacagttgtttttcatttccggatagtgacggcgttttggagcggactccgatgtctgattacaagaagattcatggtttgatggatgtagggtgtgaaaacaagaatgtaaataatgggttcgagcaaggagaagcaaccgatcgcgtgggtgatggaggcttagtcactgatacttgcaacttagaggatgcaactgcgttaggtctgcagtttccgaaatcagtctgtgtgggtggtgatttaaaatcaccatccaccttggatatgacccctaatggttcctatgctagacatgggaaccatactaacctaggtagaaaagatgatgatgaaaaattctatagttaccataaacttagcaataaatttaagtcgtataggtctccaacaattcgaagaataagaaagtccatgtcgtccaaatactggaaacaagttccaaaagattttggatacagtagagctgatgtgggtgtgaagactctttatcgcaaaagaaaatcatgttatggttacaacgcatggcagcgtgagatcatttataagagaagaagatcacctgacagaagctcggtcgtaacttctgatggaggactcagtagtggaagtgtttccaagttacccaagaagggagatacagtaaagctaagcattaagtcctttaggattccagagctttttattgaagttccagaaactgcaacagtaggatcactaaagaggactgtgatggaggctgtcagtgttttactcagcggaggaatacgtgttggggtgttaatgcatgggaagaaggttagagatgaaaggaaaactctgtcccagactgggatctcatgtgatgaaaatctagacaaccttgggttcaccttggagcctagtcccagcaaagttcccctacctttgtgttctgaagatcctgctgtgccaaccgaccctacaagtttgtctgaacggtctgcggcgtctcctatgctagattctggaattccacatgcagatgacgtgattgattcaagaaatattgtggacagtaacctcgaattagttccatatcagggtgacatatctgttgatgaaccttcatcagattcaaaagagcttgtcccacttccagagttggaagtcaaggcgcttgccatagttccgttgaaccagaaacctaagcgtactgagctagcccagaggagaactaggagacccttctctgtgacagaggtagaagctcttgtacaagcagttgaggaactcgggactggaagatggcgtgatgtaaaattgcgtgctttcgaggatgcagatcatcggacttacgtggacttgaaggacaaatggaagacgctagttcacacagcaagtatatccccacagcaacgaagaggagagccggtgccacaagaactgctagacagagtcttgagggcatacgggtattggtcgcagcaccaaggaaaacatcaggcgagaggagcgtccaaagatccagacatgaacagaggtggagcttttgaatcaggtgtttcagtgtaaaaaaggaggtacgcattggtgggtgggtgtacagaagcaaacaacacaataaatggacaactcaatttctgcaaagtttaattgtctttatttctcgtttttttttttttttctcctacatacacttttttttttct

SEQ ID NO: 164 - protein, 619 aa, Arabidopsis thaliana
  G849  (conserved domain in AA coordinates: 324-413, 504-583)
MVFKRKLDCLSVGFDFPNIPRAPRSCRRKVLNKRIDHDDDNTQICAIDLLALAGKILQESESSSASSNAFEEIKQEKVENCKTIKSESSDQGNSVSKPTYDISTEKCVVNSCFSFPDSDGVLERTPMSDYKKIHGLMDVGCENKNVNNGFEQGEATDRVGDGGLVTDTCNLEDATALGLQFPKSVCVGGDLKSPSTLDMTPNGSYARHGNHTNLGRKDDDEKFYSYHKLSNKFKSYRSPTIRRIRKSMSSKYWKQVPKDFGYSRADVGVKTLYRKRKSCYGYNAWQREIIYKRRRSPDRSSVVTSDGGLSSGSVSKLPKKGDTVKLSIKSFRIPELFIEVPETATVGSLKRTVMEAVSVLLSGGIRVGVLMHGKKVRDERKTLSQTGISCDENLDNLGFTLEPSPSKVPLPLCSEDPAVPTDPTSLSERSAASPMLDSGIPHADDVIDSRNIVDSNLELVPYQGDISVDEPSSDSKELVPLPELEVKALAIVPLNQKPKRTELAQRRTRRPFSVTEVEALVQAVEELGTGRWRDVKLRAFEDADHRTYVDLKDKWKTLVHTASISPQQRRGEPVPQELLDRVLRAYGYWSQHQGKHQARGASKDPDMNRGGAFESGVSV

SEQ ID NO: 165 - DNA, 1036 bp, Arabidopsis thaliana
  G859
  misc_feature (1012)..(1012): n is a, c, g, or t
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtcttcccctcnaaaaaaaaaaaaaaaaaaaaaaaa

SEQ ID NO: 166 - protein, 196 aa, Arabidopsis thaliana
  G859  (conserved domain in AA coordinates: 1-57)
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGKKTFLVIEGDRGMSWENGSGNKVRETLPLLK

SEQ ID NO: 167 - DNA, 1747 bp, Arabidopsis thaliana
  G864
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 168 - protein, 343 aa, Arabidopsis thaliana
  G864  (conserved domain in AA coordinates: 119-186)
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 169 - DNA, 1281 bp, Arabidopsis thaliana
  G867
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 170 - protein, 344 aa, Arabidopsis thaliana
  G867  (conserved domain in AA coordinates: 59-124)
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 171 - DNA, 1571 bp, Arabidopsis thaliana
  G869
aggaacagtgaaaggttcggttttttgggtttcgatctgataatcaacaagaaaaaagggtttgatttatgtcggctgggtttgaatcgactgtgattttgtctttgattcatatctcttctccgatttcatcatcatcttccccatcatcgtcgtctttgaaatcttgtcttctcaacgctcttcacttctgctgtaataagcagaggcttgttctggagactccttctctttccatgcgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttgttttttcgtttatgctttagtaatttaagacatacaaaagtgtgtgttccggattgtagtaagatcttaagacataaagccgggttttgcaattaggaatcgagttttaatgaagttttagtttatgtttg

SEQ ID NO: 172 - protein, 324 aa, Arabidopsis thaliana
  G869  (conserved domain in AA coordinates: 109-177)
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 173 - DNA, 2603 bp, Arabidopsis thaliana
  G877
caaagattagactaatccgactgtgtttttaatcaatcatcattttatttaggggagagaagttgtaaagttttgatttttttttctgggttttttctgtgagacccagaagaagaacagagagaggaagaaggagaagaaaaaaatatctctttctctccggctttcaacaaaatctctcttttttccttcatcagtgttaaattcggatccgggtcgggtgggttttcggtttttggtgttcggatcagagcacagttggatgttagcgacggaactgaggatttcagtttgcggctgcggcggctgtgacggtgtttgtgtgtcgtcttcttttatcaatcaggagtttcatcacagtttgatcagagattcagccaaattcttggatactaaatggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttgaaatttactcttcttcttcttcttctgcatttggtcactccttataataacttttaatttctgcttcttcttcttctttcatttattggtttcaaactttggggaaggtaaaggctgttttattgttaaaaaaaaaaaaaaaaa

SEQ ID NO: 174 - protein, 687 aa, Arabidopsis thaliana
  G877  (conserved domain in AA coordinates: 272-328, 487-603)
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 175 - DNA, 1152 bp, Arabidopsis thaliana
  G881
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaaaaaaaaaaaaaaaaaa

SEQ ID NO: 176 - protein, 310 aa, Arabidopsis thaliana
  G881  (conserved domain in AA coordinates: 176-233)
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRLMEQSRT

SEQ ID NO: 177 - DNA, 1137 bp, Arabidopsis thaliana
  G892
tataacaattccttccaacaatgtcattgagtcagccaataacacggaccgatagtgcacccaatggagcatttaggacttttggtctctactggtgctaccattgtgatcgtatggtcagaattgcatcctctaacccatcagagatcgcctgtcctcgatgtttgaggcaatttgtcgttgagattgaaacgagacaacggcctcggtttactttcaaccatgctactccgccttttgatgcttctcctgaggctcgtcttctcgaagctctctcgctcatgtttgagcctgcaaccataggtaggtttggtgcagacccatttcttagggcaagatccagaaacatcttggaacctgaatcaagaccccgaccgcaacatcgaagacgacacagccttgacaatgttaacaatggtggtttacctctaccaagaagaacatatgttattctccggcccaataatccgactagtccactcggaaacataattgcgccaccaaatcaagcaccaccacggcatgtgaactcacatgattactttactggagcatcaagcttagagcagctgattgaacaactaacacaagacgataggcctggaccaccacctgcgtcagaacccaccattaattccctaccatctgtgaaaataacaccacaacatctaactaacgacatgtcccaatgcacagtgtgcatggaagaattcattgttggtggggacgcaacggaattaccatgtaaacatatttaccataaagattgtatagtcccgtggcttaggcttaacaattcttgccctatctgccgccgtgacctgccacttgtcaacaccgttgctgaatctcgagaaaggagcaatcctattagacaagacatgcctgaaagaaggcgtccaaggtggatgcaactcggtaacatttggccatttagagcaagataccaaagggttagtccagaagaaacagcaaaccagaatcctcgagataacaggagctaactctgaatattccatgggaaataaaaatcgtgactatctatatgtatagactctatgagacattgtctatttgaatgtgcatgtatatctcagaaataaactcaagcgaaacatatttaacgactaaaaaaaa

SEQ ID NO: 178 - protein, 327 aa, Arabidopsis thaliana
  G892  (conserved domain in AA coordinates: 177-270)
MSLSQPITRTDSAPNGAFRTFGLYWCYHCDRMVRIASSNPSEIACPRCLRQFVVEIETRQRPRFTFNHATPPFDASPEARLLEALSLMFEPATIGRFGADPFLRARSRNILEPESRPRPQHRRRHSLDNVNNGGLPLPRRTYVILRPNNPTSPLGNIIAPPNQAPPRHVNSHDYFTGASSLEQLIEQLTQDDRPGPPPASEPTINSLPSVKITPQHLTNDMSQCTVCMEEFIVGGDATELPCKHIYHKDCIVPWLRLNNSCPICRRDLPLVNTVAESRERSNPIRQDMPERRRPRWMQLGNIWPFRARYQRVSPEETANQNPRDNRS

SEQ ID NO: 179 - DNA, 1276 bp, Arabidopsis thaliana
  G896
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 180 - protein, 367 aa, Arabidopsis thaliana
  G896  (conserved domain in AA coordinates: 18-39)
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 181 - DNA, 1071 bp, Arabidopsis thaliana
  G910
atgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattctggtaagaatcagccttgtgttgtccgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtggaggagaaaaaagcttaa

SEQ ID NO: 182 - protein, 356 aa, Arabidopsis thaliana
  G910  (conserved domain in AA coordinates:14-37, 77-103)
MLCIIIIENMERVCEFCKAYRAVVYCIADTANLCLTCDAKVHSANSLSGRHLRTVLCDSGKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDIDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 183 - DNA, 480 bp, Arabidopsis thaliana
  G911
atgggtcttcctgaagatttcatcaccgagcttcagattccaggttacatattaaagatactttacgtcatcggtttctttagagacatggtcgatgctctttgtccttacattggtctacctagttttctagaccacaacgagacctctggacccgatccgacccgacacgctctctctacgtcagcgagtcttgctaacgagttgatcccggtggttcggttctcggatcttccgaccgatccggaagattgttgtacggtttgtttgtcagattttgagtccgacgataaggttaggcagctacccaagtgtggacacgtgtttcatcatcattgtttagaccgttggatcgttgactacaacaagatgaaatgtccggtttgtcggcaccggttcttaccgaaagaaaagtacacgcaatgtgattggggttctggttcagattggtttagtgatgaagtggaaagtaccaactaa

SEQ ID NO: 184 - protein, 159 aa, Arabidopsis thaliana
  G911  (conserved domain in AA coordinates: 86-129)
MGLPEDFITELQIPGYILKILYVIGFFRDMVDALCPYIGLPSFLDHNETSGPDPTRHALSTSASLANELIPVVRFSDLPTDPEDCCTVCLSDFESDDKVRQLPKCGHVFHHHCLDRWIVDYNKMKCPVCRHRFLPKEKYTQCDWGSGSDWFSDEVESTN

SEQ ID NO: 185 - DNA, 724 bp, Arabidopsis thaliana
  G912
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 186 - protein, 224 aa, Arabidopsis thaliana
  G912  (conserved domain in AA coordinates:51-118)
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 187 - DNA, 890 bp, Arabidopsis thaliana
  G913
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 188 - protein, 232 aa, Arabidopsis thaliana
  G913  (conserved domain in AA coordinates: 62-128)
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 189 - DNA, 1449 bp, Arabidopsis thaliana
  G922
atggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtga

SEQ ID NO: 190 - protein, 482 aa, Arabidopsis thaliana
  G922  (conserved domain in AA coordinates:225-242)
MVAMFQEDNGTSSVASSPLQVFSTMSLNRPTLLASSSPFHCLKDLKPEERGLYLIHLLLTCANHVASGSLQNANAALEQLSHLASPDGDTMQRIAAYFTEALANRILKSWPGLYKALNATQTRTNNVSEEIHVRRLFFEMFPILKVSYLLTNRAILEAMEGEKMVHVIDLDASEPAQWLALLQAFNSRPEGPPHLRITGVHHQKEVLEQMAHRLIEEAEKLDIPFQFNPVVSRLDCLNVEQLRVKTGEALAVSSVLQLHTFLASDDDLMRKNCALRFQNNPSGVDLQRVLMMSHGSAAEARENDMSNNNGYSPSGDSASSLPLPSSGRTDSFLNAIWGLSPKVMVVTEQDSDHNGSTLMERLLESLYTYAALFDCLETKVPRTSQDRIKVEKMLFGEEIKNIISCEGFERRERHEKLEKWSQRIDLAGFGNVPLSYYAMLQARRLLQGCGFDGYRIKEESGCAVICWQDRPLYSVSAWRCRK

SEQ ID NO: 191 - DNA, 1388 bp, Arabidopsis thaliana
  G926
ccaaaatctagggttttcttctcgcccaatttcacttttcttctacgaaattctccattcctgccggctgtcgggttttctgaatcgattctccttcaccaacttcttctctggttctgttcgattctgattttttttcaaggtcaattttttcttctctttaaactctgcaaaatcgtgatcgattaaattcacctcagggttttttgatttctgaaagaagttaatcttcttcgaaggcgattgcaaaagagtgctctgctgtgaatttccactgagatgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataataaaaaaagccaaagctctgagaggagagagagacacacactttggctaatataatccattgcctcaaaccggcaaatcattcttggctttttcgtttttgtgtttgctagttgttcttgtcagagtctcatattgtgtgggtttaacagttatgatgaatgtacaaagagcgagttatgttaggtgttagattttggagacaagagacaaaggaatagcaagtaggtcttgtttttattctttgaccttttttttctcttttgcaaaattgaaaaatacgtttgcttaaaaa

SEQ ID NO: 192 - protein, 271 aa, Arabidopsis thaliana
  G926  (conserved domain in AA coordinates: 174-226)
MQSKPGRENEEEVNNHHAVQQPMMYAEPWWKNNSFGVVPQARPSGIPSNSSSLDCPNGSESNDVHSASEDGALNGENDGTWKDSQAATSSRSDNHGMEGNDPALSIRNMHDQPLVQPPELVGHYIACVPNPYQDPYYGGLMGAYGHQQLGFRPYLGMPRERTALPLDMAQEPVYVNAKQYEGILRRRKARAKAELERKVIRDRKPYLHESRHKHAMRRARASGGRFAKKSEVEAGEDAGGRDRERGSATNSSGSEQVETDSNETLNSSGAP

SEQ ID NO: 193 - DNA, 1200 bp, Arabidopsis thaliana
  G961
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatgttttgctgcttgtttgtctccttcgtctgcagcttcagttctggccgttccaaccatggcagaggcaggttcatttcgatctttcatcgcctcagatgcagatctctctccattga

SEQ ID NO: 194 - protein, 399 aa, Arabidopsis thaliana
  G961  (conserved domain in AA coordinates: 15-140)
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNVLLLVCLLRLQLQFWPFQPWQRQVHFDLSSPQMQISLH

SEQ ID NO: 195 - DNA, 1303 bp, Arabidopsis thaliana
  G971
ttttttttcttccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaatatatatttttactctatctgattattgtatacaaggataaaatttgattctttccttaatgagtgagaaatattggaagtgttaaaaaaaaaaaaaaaaaaaaaaa

SEQ ID NO: 196 - protein, 346 aa, Arabidopsis thaliana
  G971  (conserved domain in aa coordinates: 120-186)
MLDLNLKIFSSYNEDQDRKVPLMISTTGEEESNSSSSSTTDSAARDAFIAFGILKRDDDLVPPPPPPPHKETGDLFPVVADARRNIEFSVEDSHWLNLSSLQRNTQKMVKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNGHNDLELSLGISSSSESIKLTTGDYYKGINRSTMGLYGKQSSIFLPMATMKPLKTVAASSGFPFISMTSSSSSMSNCFDP

SEQ ID NO: 197 - DNA, 1430 bp, Arabidopsis thaliana
  G974
aaaaaaaaagttgatatactttctggttttctccttaacttttattctttacaaatccatcccccttagatctgtttatttcccgctactttgattcatttctgttagtaatctgtctttcgtatagaagaaaactgatttcttggtttgtattttcttaaagagatcaatctttttttatttttgatcttcttgtgtttttttttctttgtagaattaatcgtttgtgagggtatttttttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttagggactttagagctctctgcgatggagtttttggtcattgcagagattttattattattaagggggtttgttatgttaatatcaaataagtttatctactttgatgttaattagtgttaatctctgcgtcggtccaagctgtttttttttggcatgcttcgaccgtgtgagatttcttatgtaatttttgtagttccttgattttcttagttcaagttaaattggcacaaaaaaaaaaaaaaaaaa

SEQ ID NO: 198 - protein, 261 aa, Arabidopsis thaliana
  G974  (conserved domain in AA coordinates: 81-140)
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 199 - DNA, 768 bp, Arabidopsis thaliana
  G975
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 200 - protein, 199 aa, Arabidopsis thaliana
  G975  (conserved domain in AA coordinates: 4-71)
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 201 - DNA, 1530 bp, Arabidopsis thaliana
  G979
  misc_feature (1499)..(1500): n is a, c, g, or t
  misc_feature (1503)..(1503): n is a, c, g, or t
  misc_feature (1505)..(1505): n is a, c, g, or t
  misc_feature (1507)..(1507): n is a, c, g, or t
  misc_feature (1512)..(1512): n is a, c, g, or t
  misc_feature (1514)..(1514): n is a, c, g, or t
  misc_feature (1518)..(1518): n is a, c, g, or t
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttnnaangntncaagntnaaanaaaaaaaaaaaa

SEQ ID NO: 202 - protein, 430 aa, Arabidopsis thaliana
  G979  (conserved domain in AA coordinates: 63-139,165-233)
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 203 - DNA, 4011 bp, Arabidopsis thaliana
  G987
atgggttcttactcagctggcttccctggatccttggactggtttgattttcccggtttaggaaacggatcctatctaaatgatcaacctttgttagatattggatctgttcctcctcctctagacccatatcctcaacagaatcttgcttctgcggatgctgatttctctgattctgttttgaagtacataagccaagttcttatggaagaggacatggaagataagccttgtatgtttcatgatgctttatctcttcaagcagctgagaagtctctctatgaagctctcggcgagaagtacccggttgatgattctgatcagcctctgactactactactagccttgctcaattggttagtagtcctggtggttcttcttatgcttcaagcaccacaaccacttcctctgattcacaatggagttttgattgtttggagaataataggccttcttcttggttgcagacaccgatcccgagtaacttcatttttcagtctacatctactagagccagtagcggtaacgcggttttcgggtcaagttttagcggtgatttggtttctaatatgtttaatgatactgacttggcgttacaattcaagaaagggatggaggaagctagtaaattccttcctaagagctctcagttggttatagataactctgttcctaacagattaaccggaaagaagagccattggcgcgaagaagaacatttgactgaagaaagaagtaagaaacaatctgctatttatgttgatgaaactgatgagcttactgatatgtttgacaatattctgatatttggcgaggctaaggaacaacctgtatgcattcttaacgagagtttccctaaggaacctgcgaaagcttcaacgtttagtaagagtcctaaaggcgaaaaaccggaagctagtggtaacagttatacaaaagagacacctgatttgaggacaatgctggtttcttgtgctcaagctgtttcgattaacgatcgtagaactgctgacgagctgttaagtcggataaggcaacattcttcatcttacggcgatggaacagagagattggctcattattttgctaacagtcttgaagcacgtttggctgggataggtacacaggtttatactgccttgtcttccaagaaaacatctacttctgacatgttgaaagcttatcagacatatatatcagtctgtccgttcaagaaaatcgcaatcatattcgccaaccatagtattatgcggttggcttcaagtgctaatgccaaaaccatccacatcatagattttggaatatctgatggtttccagtggccttctctgattcatcgacttgcttggagacgtggttcatcttgtaagcttcggataaccggtatagagttgcctcaacgtggttttagaccagccgagggagttattgagactggtcgtcgcttggctaagtattgtcagaagttcaatattccgtttgagtacaatgcgattgcgcagaaatgggaatcaatcaagttggaggacttgaagctaaaagaaggcgagtttgttgcggtaaactctttatttcggtttaggaatcttctagatgagacggtggcagtgcatagcccgagagatacggttttgaagctgataaggaagataaagccagacgtgttcatccccgggatcctcagcggatcctacaacgcgcctttctttgtcacgaggtttagagaagttctgtttcattactcatctctgtttgacatgtgtgacacgaatctaacacgggaagatccaatgagggttatgtttgagaaagagttctatgggcgggagatcatgaacgtggtggcgtgtgaggggacggagagagtggagaggccagagagttataagcagtggcaggcgagggcgatgagagccgggtttagacagattccgctggagaaggaactagttcagaaactgaagttgatggtggaaagtggatacaaacccaaagagtttgatgttgatcaagattgtcactggttgcttcagggctggaaaggtagaattgtatacggttcatctatttgggttcctttctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctag

SEQ ID NO: 204 - protein, 1336 aa, Arabidopsis thaliana
  G987  (conserved domain in AA coordinates: 428-432,704-708)
MGSYSAGFPGSLDWFDFPGLGNGSYLNDQPLLDIGSVPPPLDPYPQQNLASADADFSDSVLKYISQVLMEEDMEDKPCMFHDALSLQAAEKSLYEALGEKYPVDDSDQPLTTTTSLAQLVSSPGGSSYASSTTTTSSDSQWSFDCLENNRPSSWLQTPIPSNFIFQSTSTRASSGNAVFGSSFSGDLVSNMFNDTDLALQFKKGMEEASKFLPKSSQLVIDNSVPNRLTGKKSHWREEEHLTEERSKKQSAIYVDETDELTDMFDNILIFGEAKEQPVCILNESFPKEPAKASTFSKSPKGEKPEASGNSYTKETPDLRTMLVSCAQAVSINDRRTADELLSRIRQHSSSYGDGTERLAHYFANSLEARLAGIGTQVYTALSSKKTSTSDMLKAYQTYISVCPFKKIAIIFANHSIMRLASSANAKTIHIIDFGISDGFQWPSLIHRLAWRRGSSCKLRITGIELPQRGFRPAEGVIETGRRLAKYCQKFNIPFEYNAIAQKWESIKLEDLKLKEGEFVAVNSLFRFRNLLDETVAVHSPRDTVLKLIRKIKPDVFIPGILSGSYNAPFFVTRFREVLFHYSSLFDMCDTNLTREDPMRVMFEKEFYGREIMNVVACEGTERVERPESYKQWQARAMRAGFRQIPLEKELVQKLKLMVESGYKPKEFDVDQDCHWLLQGWKGRIVYGSSIWVPFFFYVGRATRVLIMDPNFSESLNGFEYFDGNPNLLTDPMEDQYPPPSDTLLKYVSEILMEESNGDYKQSMFYDSLALRKTEEMLQQVITDSQNQSFSPADSLITNSWDASGSIDESAYSADPQPVNEIMVKSMFSDAESALQFKKGVEEASKFLPNSDQWVINLDIERSERRDSVKEEMGLDQLRVKKNHERDFEEVRSSKQFASNVEDSKVTDMFDKVLLLDGECDPQTLLDSEIQAIRSSKNIGEKGKKKKKKKSQVVDFRTLLTHCAQAISTGDKTTALEFLLQIRQQSSPLGDAGQRLAHCFANALEARLQGSTGPMIQTYYNALTSSLKDTAADTIRAYRVYLSSSPFVTLMYFFSIWMILDVAKDAPVLHIVDFGILYGFQWPMFIQSISDRKDVPRKLRITGIELPQCGFRPAERIEETGRRLAEYCKRFNVPFEYKAIASQNWETIRIEDLDIRPNEVLAVNAGLRLKNLQDETGSEENCPRDAVLKLIRNMNPDVFIHAIVNGSFNAPFFISRFKEAVYHYSALFDMFDSTLPRDNKERIRFEREFYGREAMNVIACEEADRVERPETYRQWQVRMVRAGFKQKTIKPELVELFRGKLKKWRYHKDFVVDENSKWLLQGWKGRTLYASSCWVPA

SEQ ID NO: 205 - DNA, 1338 bp, Arabidopsis thaliana
  G988
atgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatga

SEQ ID NO: 206 - protein, 445 aa, Arabidopsis thaliana
  G988  (conserved domain in AA coordinates:178-195)
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 207 - DNA, 1057 bp, Arabidopsis thaliana
  G1040
ctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcaccaggagaaggaaaggtagagaaagaggcagagcagaggatagaggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggccaatgaagagaaagaggataccaacattcatctcaatttggatttcacattgggcggcctagttgggggatggaatatgcggaaccctccagtgatttaacccttctcaagtgctaattgccttaagctacaacaaataagtcagcttaggttaccagttttaacataattttaacttgttttgatcatatgagcttcggaagaatcatattatcatcatatatgaacttctttccaagaatgttctatgagttttttgatatgtataatcaagagaatcgtttgaagtaaaaa

SEQ ID NO: 208 - protein, 270 aa, Arabidopsis thaliana
  G1040  (conserved domain in AA coordinates: 109-158)
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSPGEGKVEKEAEQRIEDNNNNEEADEGTDTNSPNSSSVQKTQRASWSSTKEVSRSISTQAYSHLGTTHHTKANEEKEDTNIHLNLDFTLGGLVGGWNMRNPPVI

SEQ ID NO: 209 - DNA, 715 bp, Arabidopsis thaliana
  G1047
caattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaagaaaaaaaaa

SEQ ID NO: 210 - protein, 227 aa, Arabidopsis thaliana
  G1047  (conserved domain in AA coordinates: 129-180)
MMSTVPAFTFTEPGLVNQLSDFQTGFTPWELNCSDLFSTIHLEPVVPSPCSGESDAGSVKINTDFNGFDESCIGSIKTNSGSDDSNLFHGVPSPQSDELDSKNTKIRSNATNHNRNKLNRSVLQVTDDRKRKRMESNRESAKRSRMRKQRHIDNLKDEANRLGLENRELANRLRIVLYNIALMCTDNNQLLSEQEILRRRFLEMRQILIFRQLQLNPSLIINHHHMI

SEQ ID NO: 211 - DNA, 1291 bp, Arabidopsis thaliana
  G1051
cctgtaaattcagatttgctttctttggtaatcttttggatcaagatccatctattttttcttcaatggcacaactccctcctaaaatccccaacatgacacaacattggcctgatttctcttcccaaaagctctctcctttctctaccccaaccgcaaccgctgtcgccaccgctacaaccaccgtacaaaacccctcatgggtcgacgaattcctcgacttctcagcgtctcgccgtggcaaccaccgtcgttccatcagcgactctatcgcattcctcgaagctccaacagtcagcatcgaagaccaccaattcgacaggttcgatgacgaacagttcatgtcgatgttcaccgacgacgacaaccttcatagcaatccttcccatatcaacaacaaaaataacaatgtggggcccacgggatcttcctcgaacacatccacgccgtccaatagcttcaacgacgataacaaagaattaccaccgtccgatcataacatgaacaataatatcaacaacaactataacgatgaagtccaaagccaatgcaagatggagccagaagatggtacggcgtcgaataacaattccggtgatagctccggcaaccggattctcgatcccaaaagggttaagagaatattagcaaatcggcaatcagcacagagatcaagggtgaggaaactgcaatacatatcagagctcgaacgtagcgtcacttcgttgcaggcggaagtgtcagtgttatcgccaagagttgcattcttggatcatcaacgtttgcttcttaacgttgacaacagcgctctcaagcaacgaatcgctgctttatctcaagacaagcttttcaaagacgcacatcaagaagcattgaagagagaaatagagagacttcgacaagtgtataatcaacaaagcctcacgaatgtggaaaatgcaaatcatttatcggcgaccggagccggtgctactccggccgtcgacatcaagtcgtccgttgaaacagagcagctcctcaatgtctcataaattaaccatcatgcatcatcatcaacatttctctcttttagcttcttggcaaaagttcttgactataaaatctctttcgggtaagaaattcaggagatatacattttttattctaatcacattgtttttaagttgtgatgaattcagtttgatgtatcttatttattttgtttatgtcgtctttttttcttggggttgatggaagggaatcatcaattgttgtttgtacaaagaactagttgaatttttttttttttttt

SEQ ID NO: 212 - protein, 321 aa, Arabidopsis thaliana
  G1051  (conserved domain in AA coordinates: 189-250)
MAQLPPKIPNMTQHWPDFSSQKLSPFSTPTATAVATATTTVQNPSWVDEFLDFSASRRGNHRRSISDSIAFLEAPTVSIEDHQFDRFDDEQFMSMFTDDDNLHSNPSHINNKNNNVGPTGSSSNTSTPSNSFNDDNKELPPSDHNMNNNINNNYNDEVQSQCKMEPEDGTASNNNSGDSSGNRILDPKRVKRILANRQSAQRSRVRKLQYISELERSVTSLQAEVSVLSPRVAFLDHQRLLLNVDNSALKQRIAALSQDKLFKDAHQEALKREIERLRQVYNQQSLTNVENANHLSATGAGATPAVDIKSSVETEQLLNVS

SEQ ID NO: 213 - DNA, 1304 bp, Arabidopsis thaliana
  G1052
tgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttttt

SEQ ID NO: 214 - protein, 329 aa, Arabidopsis thaliana
  G1052  (conserved domain in AA coordinates: 201-261)
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 215 - DNA, 2026 bp, Arabidopsis thaliana
  G1062
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaacttgaggttgttgttgttggatacataacttcaaccttttattagcaatgttaacttccatttatgtttcatctt

SEQ ID NO: 216 - protein, 494 aa, Arabidopsis thaliana
  G1062  (conserved domain in AA coordinates: 308-359)
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 217 - DNA, 1148 bp, Arabidopsis thaliana
  G1063
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttg

SEQ ID NO: 218 - protein, 241 aa, Arabidopsis thaliana
  G1063  (conserved domain in aa coordinates: 131-182)
MDSDIMNMMMHQMEKLPEFCNPNSSFFSPDHNNTYPFLFNSTHYQSDHSMTNEPGFRYGSGLLTNPSSISPNTAYSSVFLDKRNNSNNNNNGTNMAAMREMIFRIAVMQPIHIDPEAVKPPKRRNVRISKDPQSVAARHRRERISERIRILQRLVPGGTKMDTASMLDEAIHYVKFLKKQVQSLEEQAVVTGGGGGGGGRVLIGGGGMTAASGGGGGGGVVMKGCGTVGTHQMVGNAQILR

SEQ ID NO: 219 - DNA, 1728 bp, Arabidopsis thaliana
  G1064
ctttattttttttcccctcttgtcgaaaacatcacatataaataaaaaaccaaaaaccctaatttataaaatatatataaaatagttatagctccccacttatatatgcaaaagccaacatcaagtatcttaaatgtcataatggacggtggagacagcgtcggaggaggaggaggagatgatcaccaccgtcacctccaccatcaccaccgccctactttcccttttcaactactcggaaaacacgaccccgacgacaaccatcaacaacaaccttccccttcctcctcctcctctctattttctctccatcaacaccaacaattatctcaatcgcaacctcaatcgcaatcgcaaaagtcacaaccgcagacaacgcaaaaagagttattacaaacgcaagaggaatctgcggtggtggcagctaaaaagccaccgttgaaacgagcgtcgacgaaagaccgacacacgaaagtagacggaagagggaggagaataaggatgccggcgttatgtgcagctagggtttttcagctaacgcgagagctaggtcataaatccgacggtgagacaatagagtggcttcttcaacaagctgaaccatctgtaatcgccgccaccggaaccggaacaatcccggcgaatttcacttctttaaacatctctctccgttcttcaggctcttccatgtctcttccttctcatttccgctccgccgcttccacttttagccctaataacatattttctccggcgatgcttcaacaacaacaacaacaacaacgtggtggtggtgttgggtttcatcatccccatctacagggacgtgcacctacgtcgtctttgtttcctggtattgataacttcacaccaacgacgtcgtttttgaactttcataatccaacaaagcaagaaggagatcaagattctgaagagttaaactcggagaagaaaagaagaatccaaacgacgtcggatttgcatcaacaacaacaacaacaccaacatgatcaaatcggaggatatacacttcaatctagcaacagtggatctacggccaccgcagccgccgcgcaacaaataccgggaaatttctggatggttgcggcggctgcggctgcaggtggtggtggtggtaataacaaccaaacaggtggtcttatgacagcttctattggtactggtggcggcggtggagagcctgtttggacgtttccttccattaacacggcagcggcagcgttatatagaagtggcgtttcgggcgttccaagcggcgcggtttctagcggtttacattttatgaatttcgcagcgccaatggcatttcttactggacaacaacagctagcaacaactagtaatcatgagattaatgaagatagtaataataatgaaggaggaagaagtgacggtggtggtgatcatcataatacacagagacatcatcatcatcaacaacaacatcatcataatattctctccggcttgaaccagtacggacggcaagtttccggcgactctcaagctagtggatcacttggaggtggtgatgaggaggatcagcaagattagacacacacaaaaacattttaatggtgggattttctgccgacggcggtagcggtgacggcgttcggcggctgtgtaaaacttttgttttcaccgttaattttttttattttctgtagtaattttttttgctaagtaaaaaaaaaaaaaaaaaaa

SEQ ID NO: 220 - protein, 489 aa, Arabidopsis thaliana
  G1064  (conserved domain in AA coordinates: 116-179)
MQKPTSSILNVIMDGGDSVGGGGGDDHHRHLHHHHRPTFPFQLLGKHDPDDNHQQQPSPSSSSSLFSLHQHQQLSQSQPQSQSQKSQPQTTQKELLQTQEESAVVAAKKPPLKRASTKDRHTKVDGRGRRIRMPALCAARVFQLTRELGHKSDGETIEWLLQQAEPSVIAATGTGTIPANFTSLNISLRSSGSSMSLPSHFRSAASTFSPNNIFSPAMLQQQQQQQRGGGVGFHHPHLQGRAPTSSLFPGIDNFTPTTSFLNFHNPTKQEGDQDSEELNSEKKRRIQTTSDLHQQQQQHQHDQIGGYTLQSSNSGSTATAAAAQQIPGNFWMVAAAAAAGGGGGNNNQTGGLMTASIGTGGGGGEPVWTFPSINTAAAALYRSGVSGVPSGAVSSGLHFMNFAAPMAFLTGQQQLATTSNHEINEDSNNNEGGRSDGGGDHHNTQRHHHHQQQHHHNILSGLNQYGRQVSGDSQASGSLGGGDEEDQQD

SEQ ID NO: 221 - DNA, 1116 bp, Arabidopsis thaliana
  G1069
ttggaaccctagaggcctttcaagcaaatcatcagggtaacaatttcttgatctttctttttagcgaatttccagtttttggtcaatcatggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactgactcagtgagccatttctatatataatggtctatataaataaatatatagatgaatataagcaagcaatttgaggtagtctattacaaagcttttgctctggttggaaaaataaataagtatcaaagctttgtttgttcttaatggaaatatagagcttgggaaggtagaaagagacgacatt

SEQ ID NO: 222 - protein, 281 aa, Arabidopsis thaliana
  G1069  (conserved domain in AA coordinates: 67-74)
MANPWWTNQSGLAGMVDHSVSSGHHQNHHHQSLLTKGDLGIAMNQSQDNDQDEEDDPREGAVEVVNRRPRGRPPGSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEEEEDGGGSRQIHGGGDSPPRIGSNLPDLSGMAGPGYNMPPHLIPNGAGQLGHEPYTWVHARPPY

SEQ ID NO: 223 - DNA, 974 bp, Arabidopsis thaliana
  G1073
ccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 224 - protein, 270 aa, Arabidopsis thaliana
  G1073  (conserved domain in AA coordinates: 33-42, 78-175)
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 225 - DNA, 1084 bp, Arabidopsis thaliana
  G1075
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 226 - protein, 285 aa, Arabidopsis thaliana
  G1075  (conserved domain in AA coordinates: 78-85)
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 227 - DNA, 2535 bp, Arabidopsis thaliana
  G1084
atgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactatctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaaggactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctag

SEQ ID NO: 228 - protein, 844 aa, Arabidopsis thaliana
  G1084  (conserved domain in AA coordinates: 1-53, 490-619)
MGCSHSKLDDEEAVQICKDRKRFIKQAIEHRTKFASGHIAYIHSLRKVSDALHDFILQGDNNNEFVPTLCQDSFVTPVKRMPQRRRRSSRSNSGEFISISPSSIPPKMIQGRPRSNVKANYLMANRSRPVRVEQRSPETFRVETFSPPSSSNQYGESDGFFGMNMNMNTSASTSSSFWNPLSSPEQRLSSHNIPPPSPQNSQWDFFWNPFSSLDYYGYNSYDRGSVDSRSGIDDEIRGLRRVREEEGIPDLEEDDEPHKPEPVVNVRFQNHNPNPKATEENRGKVDKSCCNEEVKVEDVDEDEDEDGDEDDDEFTDSGCETENEGDEKCVAPPTQEQRKAEVCRGGEATGNVVGVGKVQEMKNVVGVRDDAKTTGFTVYVNRRPTSMAEVIKDLEDQFTTICDAAKEVSGLLEAGRAQYTSSFNDHSGEFMNNVAIFLSRKMLNPVALFRSGSSRSSSSRFLITSSGGSRESGSESRSDVSDESCMISGSHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQKRTLDEAKLLLAGTPVSKRHKKRQPPIMPEAINSQRLAQSALNLEAQLRNWRTCFEFWITSQRSYMKALSGWLLRCFRCDPDPEKVRLSSCLHPIYRVCIQWSRLLNSLNEKPVLDKLEFFASGMGSIYARQVREDPNWSGSGSRRYSGSESMELVVADKGEEDVVMTAEKLAEVAVKVLCHGMSVAVSSLAEFSINSADEHSKLVSQPADDASEQQPPDVNFNS

SEQ ID NO: 229 - DNA, 2663 bp, Arabidopsis thaliana
  G1089
aagtaagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcgcggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaatctttatcattgctttcttatattaaggttttggcttttgtaagaaggtttcttacatatgagattcatatagtgtttgattcttaaggaactgttctgttgagtaataagaaagttgtgtattgaaatagagttgcatttgttaattttg

SEQ ID NO: 230 - protein, 798 aa, Arabidopsis thaliana
  G1089  (conserved domain in AA coordinates: 425-500)
MGCAQSKIENEEAVTRCKERKQLMKDAVTARNAFAAAHSAYAMALKNTGAALSDYSHGEFLVSNHSSSSAAAAIASTSSLPTAISPPLPSSTAPVSNSTASSSSAAVPQPIPDTLPPPPPPPPLPLQRAATMPEMNGRSGGGHAGSGLNGIEEDGALDNDDDDDDDDDDSEMENRDRLIRKSRSRGGSTRGNRTTIEDHHLQEEKAPPPPPLANSRPIPPPRQHQHQHQQQQQQPFYDYFFPNVENMPGTTLEDTPPQPQPQPTRPVPPQPHSPVVTEDDEDEEEEEEEEEEEEETVIERKPLVEERPKRVEEVTIELEKVTNLRGMKKSKGIGIPGERRGMRMPVTATHLANVFIELDDNFLKASESAHDVSKMLEATRLHYHSNFADNRGHIDHSARVMRVITWNRSFRGIPNADDGKDDVDLEENETHATVLDKLLAWEKKLYDEVKAGELMKIEYQKKVAHLNRVKKRGGHSDSLERAKAAVSHLHTRYIVDMQSMDSTVSEINRLRDEQLYLKLVHLVEAMGKMWEMMQIHHQRQAEISKVLRSLDVSQAVKETNDHHHERTIQLLAVVQEWHTQFCRMIDHQKEYIKALGGWLKLNLIPIESTLKEKVSSPPRVPNPAIQKLLHAWYDRLDKIPDEMAKSAIINFAAVVSTIMQQQEDEISLRNKCEETRKELGRKIRQFEDWYHKYIQKRGPEGMNPDEADNDHNDEVAVRQFNVEQIKKRLEEEEEAYHRQSHQVREKSLASLRTRLPELFQAMSEVAYSCSDMYRAITYASKRQSQSERHQKPSQGQSS

SEQ ID NO: 231 - DNA, 1064 bp, Arabidopsis thaliana
  G1134
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 232 - protein, 262 aa, Arabidopsis thaliana
  G1134  (conserved domain in AA coordinates: 198-247)
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 233 - DNA, 956 bp, Arabidopsis thaliana
  G1140
atccaagatcctccaactcacagaaaggcagattcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattgggtctttataactatttttctccccaaaaaaaaaaaaaaaaaaaaaaaaaaaaa

SEQ ID NO: 234 - protein, 220 aa, Arabidopsis thaliana
  G1140  (conserved domain in AA coordinates:2-57)
MAREKIRIKKIDNITARQVTFSKRRRGIFKKADELSVLCDADVALIIFSATGKLFEFSSSRMRDILGRYSLHASNINKLMDPPSTHLRLENCNLSRLSKEVEDKTKQLRKLRGEDLDGLNLEELQRLEKLLESGLSRVSEKKGECVMSQIFSLEKRGSELVDENKRLRDKLETLERAKLTTLKEALETESVTTNVSSYDSGTPLEDDSDTSLKLGLPSWE

SEQ ID NO: 235 - DNA, 805 bp, Arabidopsis thaliana
  G1143
aaataagaatataaacacttttgtctgaaaaattatcaaagaagaagaaataaatgggtggaggaagcagatttcaagaaccagtgaggatgagccgtaggaaacaagtaacaaaagagaaggaagaagatgaaaacttcaaatctccaaatcttgaagcagagagacgtagaagagagaagcttcattgtcggcttatggctctgcgatctcatgtccccattgtcaccaacatgactaaagcaagtattgttgaagatgcgattacttacataggagagcttcaaaacaatgttaagaatctcttagagacatttcatgaaatggaagaagctcctcctgagattgatgaagaacaaacggatccaatgataaaacctgaagttgaaactagtgatcttaacgaagagatgaagaaactcggaatcgaggagaatgtgcaattgtgtaagattggggagaggaagttttggttaaagatcataacagagaagagagatgggatctttactaaattcatggaggttatgagatttctcggattcgagattatcgatattagtctaacaacttcaaatggagcaattcttattagtgcctctgttcagacacaggaactctgtgatgttgaacagacaaaagattttcttttggaagttatgagaagcaatccataagtattaattatatacatcttggaaatttcttgatctaataacatttccattggtttttattacattgttgttccattttaaatatgatatgattcagatgaaaaagagtttgtgttacaagccaatga

SEQ ID NO: 236 - protein, 207 aa, Arabidopsis thaliana
  G1143  (conserved domain in AA coordinates:33-82)
MGGGSRFQEPVRMSRRKQVTKEKEEDENFKSPNLEAERRRREKLHCRLMALRSHVPIVTNMTKASIVEDAITYIGELQNNVKNLLETFHEMEEAPPEIDEEQTDPMIKPEVETSDLNEEMKKLGIEENVQLCKIGERKFWLKIITEKRDGIFTKFMEVMRFLGFEIIDISLTTSNGAILISASVQTQELCDVEQTKDFLLEVMRSNP

SEQ ID NO: 237 - DNA, 3323 bp, Arabidopsis thaliana
  G1146
cttctctagcgtcactcttcttcttcattggtcggtagaataaggccaaggaagggatcagttttaagttttgtttcattctttttgtagtggagaaaaagagtttttgaaaatcaaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaagggccgagggacagagaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcagatgtatcccttaaaatcaacgtaaagatgggaggaaggaacacagttctagtagacgccataagctgtagaattccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaacctgagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgtagttcggctttagatttaccaatgtttttcttatgtaaattttgtcggtttggtttaagcctttaggaattagtgtattagggtttttctaaagttgtactttagctgatgataacgttgatgcagtgactttgttaaaacctcctcttctacagtagtgtttacgtcgttcctc

SEQ ID NO: 238 - protein, 988 aa, Arabidopsis thaliana
  G1146  (conserved domain in AA coordinates: 886-896)
MPIRQMKDSSETHLVIKTQPLKHHNPKTVQNGKIPPPSPSPVTVTTPATVTQSQASSPSPPSKNRSRRRNRGGRKSDQGDVCMRPSSRPRKPPPPSQTTSSAVSVATAGEIVAVNHQMQMGVRKNSNFAPRPGFGTLGTKCIVKANHFLADLPTKDLNQYDVTITPEVSSKSVNRAIIAELVRLYKESDLGRRLPAYDGRKSLYTAGELPFTWKEFSVKIVDEDDGIINGPKRERSYKVAIKFVARANMHHLGEFLAGKRADCPQEAVQILDIVLRELSVKRFCPVGRSFFSPDIKTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRAEGQRNDILRTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTSMNKTKGKELELLLAILPDNNGSLYGDLKRICETELGLISQCCLTKHVFKISKQYLADVSLKINVKMGGRNTVLVDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKNSTDRSGNILPGTVVDTKICHPTEFDFYLCSHAGIQGTSRPAHYHVLWDENNFTADGIQSLTNNLCYTYARCTRSVSIVPPAYYAHLAAFRARFYLEPEIMQDNGSPGKKNTKTTTVGDVGVKPLPALKENVKRVMFYC

SEQ ID NO: 239 - DNA, 2054 bp, Arabidopsis thaliana
  G1196
catctgttctgagattgtcttcttcttcttgaaatctttttcatttgtgcaatgattttgaagactacccatctattcagttctttctcttatgatttaagtttcatttagtttttttttctcatccgccattttcgttgactttttgaagcatttctcgaattgactttgttcttcacattgattcattagaatgttctttcataaagtttggatcttttcttcagggcttgattaatttcatatctatgatcttctctgtattgtttttgatccaatcacttctcaaaatttgatccttgtcattggatttagatttagggtttttgtatccttggggatttgaagatcaaaaacagagtctttgagtgatacttctggggaacaaaatggctgcaactgcaatagagccatcttcatctataagtttcacatcttctcacttatcaaacccttctcctgttgttactacttatcactcagctgctaatcttgaagagctcagctctaacttggagcagcttctcactaatccagattgcgattacactgacgcagagatcatcattgaagaagaagctaaccctcggaagcttcgtaactatgttgagaagtcactagtagagaatgttcttcctatcctcttagttgcgtttcattgtgatttgacacagcttcttgatcaatgcattgagagagtggcgagatcagacttagacagattctgtatcgaaaaggagcttcctttagaagtattggaaaaaatcaaacagcttcgagttaagtcggtgaacatacccgaggtggaggataaatcgatagagagaacagggaaagtactcaaggcattggattcagatgatgtagaactcgtgaagcttcttttgactgagtcagatataactctagaccaagccaatggtctacattatgcagtggcatacagtgatccgaaagttgtgacacaggttcttgatctagatatggctgatgttaatttcagaaattccagggggtatacggttcttcatattgctgctatgcgtagagagccaacaattatcataccacttattcaaaaaggagctaatgcttcagatttcacgtttgatggacgcagtgcggtaaatatatgtaggagactcactaggccgaaagattatcataccaaaacctcaaggaaagaacctagtaaataccgcttatgcatcgatatcttggaaagggaaattagaaggaatccattggttagtggggatacacccacttgttcccattcgatgcccgaggatctccaaatgaggttgttatacttagaaaagcgagtgggacttgctcagttgttcttcccagcagaagccaatgtggctatggacgttgctaatgttgaagggacaagcgagtgcacaggtcttctaactccacctccatcaaatgatacaactgaaaacttgggtaaagtcgatttaaatgaaacgccttatgtgcaaacgaaaagaatgcttacacgtatgaaagccctcatgaaaacagttgagacaggtcggagatacttcccatcttgttatgaggttctggataagtacatggatcagtatatggacgaagaaatccctgatatgtcgtatcccgagaaaggcactgtgaaagagagaagacagaagaggatgagatataacgagctgaagaacgacgttaaaaaagcatatagcaaagacaaagtcgcgcggtcttgtctttcttcttcatcaccagcttcttctcttagagaagccttagagaatccaacatgatcttgtcccagataagtaatgctactagagatagttccttggaagaaattagctattttataggttttggtttagaaaacagtggagatcccattttggtattcaggtttattacatggtttaggtttgattttgtattaaaggagatggatttttgaaatgtataaagcaaaacctttcctttttgctttgcttctttctttaaaaaaaaaattgtaatatatggaagtgaaatcgaagcaacgattgagcaaaaaaaaa

SEQ ID NO: 240 - protein, 467 aa, Arabidopsis thaliana
  G1196  (conserved domain in AA coordinates: 179-254)
MAATAIEPSSSISFTSSHLSNPSPVVTTYHSAANLEELSSNLEQLLTNPDCDYTDAEIIIEEEANPRKLRNYVEKSLVENVLPILLVAFHCDLTQLLDQCIERVARSDLDRFCIEKELPLEVLEKIKQLRVKSVNIPEVEDKSIERTGKVLKALDSDDVELVKLLLTESDITLDQANGLHYAVAYSDPKVVTQVLDLDMADVNFRNSRGYTVLHIAAMRREPTIIIPLIQKGANASDFTFDGRSAVNICRRLTRPKDYHTKTSRKEPSKYRLCIDILEREIRRNPLVSGDTPTCSHSMPEDLQMRLLYLEKRVGLAQLFFPAEANVAMDVANVEGTSECTGLLTPPPSNDTTENLGKVDLNETPYVQTKRMLTRMKALMKTVETGRRYFPSCYEVLDKYMDQYMDEEIPDMSYPEKGTVKERRQKRMRYNELKNDVKKAYSKDKVARSCLSSSSPASSLREALENPT

SEQ ID NO: 241 - DNA, 1780 bp, Arabidopsis thaliana
  G1198
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 242 - protein, 481 aa, Arabidopsis thaliana
  G1198  (conserved domain in AA coordinates: 173-223)
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 243 - DNA, 1056 bp, Arabidopsis thaliana
  G1225
atgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctaatcaagaaccgccaccacagcgacaaccaccagctacgaatcgagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaagggtgatcaagcttcaatagttggtggagccatagatttcatcaaagaacttgaacacaaattactatctcttgaagctcaaaaacatcataatgctaaattaaaccagtcggttacttcttcaacaagtcaagactcaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttgttgttattccttcttttaattttatcacatagcacatctttagttttttttttt

SEQ ID NO: 244 - protein, 327 aa, Arabidopsis thaliana
  G1225  (conserved domain in AA coordinates: 78-147)
MTLEALSSNGLLNFLLSETLSPTPFKSLVDLEPLPENDVIISKNTISEISNQEPPPQRQPPATNRGKKRRRRKPRVCKNEEEAENQRMTHIAVERNRRRQMNQHLSVLRSLMPQPFAHKGDQASIVGGAIDFIKELEHKLLSLEAQKHHNAKLNQSVTSSTSQDSNGEQENPHQPSSLSLSQFFLHSYDPSQENRNGSTSSVKTPMEDLEVTLIETHANIRILSRRRGFRWSTLATTKPPQLSKLVASLQSLSLSILHLSVTTLDNYAIYSISAKVEESCQLSSVDDIAGAVHHMLSIIEEEPFCCSSMSELPFDFSLNHSNVTHSL

SEQ ID NO: 245 - DNA, 1362 bp, Arabidopsis thaliana
  G1226
ctgcatttattaagaacagtttagaaagtgtcaacccctaaaggaatgtttttagtttagaggaaagagagagaagaagaagcagcagcagaagttgttaatttgaagactatttgaggaaagacacctatatctaaatactcaaagttacaaaaatattacttcagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgatataaataagaaaaaccaaagaggtgaaattttgggagttttaattattatcttatactttttggattttagattagtagcaaactcgcagtgttctacgatgacattattattggtcacatgaaggtttaggttaaaaaaaaa

SEQ ID NO: 246 - protein, 315 aa, Arabidopsis thaliana
  G1226  (conserved domain in AA coordinates:115-174)
MSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEVMWSNLSRT

SEQ ID NO: 247 - DNA, 1604 bp, Arabidopsis thaliana
  G1229
tttgggcgggtctttctttccctaaatctttcttttattttgctgtttaaaaaaaaaatccaaccataagacaaaacaacgaacgaggaagagagagagagaaggatatatctctaatcacgatgcaggagataataccggattttcttgaagagtgtgaatttgtcgacacttcactagccggagatgatctatttgccatcttagagagtcttgaaggtgccggagagatatctccgacagctgcatctacacctaaagatggaaccacaagttccaaggagttagttaaggatcaagattatgaaaactcatctcctaagaggaaaaagcaaagactagaaaccaggaaagaagaggacgaagaagaagaagacggagacggagaagcagaagaagataataagcaagatgggcaacaaaagatgtctcatgtaaccgtggaacgtaaccggagaaagcaaatgaacgagcacttaaccgttttgcgttctcttatgccttgtttctacgtcaaacggggggaccaagcatcgatcataggaggagttgtggagtacataagcgagttacaacaagttctccaatctttggaagccaagaaacaacgtaaaacctacgccgaagtcctaagcccgagagttgtcccgagccctcgtccttcaccgcctgttctaagcccaagaaaaccgcctcttagcccgcgcatcaaccaccaccagattcaccaccacctacttctccctcccataagtcctcgaacacctcagccaacaagcccataccgggccattccaccgcaactaccactcatcccacagcctccgcttcgctcttacagctcattggccagttgcagcagcttaggagatccacctccatactctcctgcttcatcttcttcatctccttcagttagtagtaaccatgagagtagtgtgatcaatgagcttgttgctaactcaaaatcggctttggctgatgtggaagtgaagttttcaggagctaacgtgctgctcaaaacggtgtcgcataagatcccgggacaagttatgaagataattgctgctcttgaagatttggctcttgagattcttcaggttaatattaacaccgtcgacgaaaccatgcttaattctttcaccatcaagattggaattgagtgccaactaagtgcagaagaactggctcaacaaattcagcaaacattctgctagtaaagaaggatttaatatagcttcgtataaaccttaacgagagagcagtacgtactcactttctctccttagtatccctttaattatcttttcagttttctgcaaagatatggagtttaaaaaaataaaattgttatctaaagttttaatcaaatattgattaattataactaatataggtataagtgagttttaaagattatcagcttcataacagccatcgtcatgtttactttcttttaaattttagaatttagacgtactcctaccatgtaattttatttctgtcattacatcaagcattgtagctgtaattgcatatgaatgaacaatagtgtatgagtgatctcatgaataatattcttcttgcaacacaaaaaaaaaaaa

SEQ ID NO: 248 - protein, 364 aa, Arabidopsis thaliana
  G1229  (conserved domain in AA coordinates: 102-160)
MQEIIPDFLEECEFVDTSLAGDDLFAILESLEGAGEISPTAASTPKDGTTSSKELVKDQDYENSSPKRKKQRLETRKEEDEEEEDGDGEAEEDNKQDGQQKMSHVTVERNRRKQMNEHLTVLRSLMPCFYVKRGDQASIIGGVVEYISELQQVLQSLEAKKQRKTYAEVLSPRVVPSPRPSPPVLSPRKPPLSPRINHHQIHHHLLLPPISPRTPQPTSPYRAIPPQLPLIPQPPLRSYSSLASCSSLGDPPPYSPASSSSSPSVSSNHESSVINELVANSKSALADVEVKFSGANVLLKTVSHKIPGQVMKIIAALEDLALEILQVNINTVDETMLNSFTIKIGIECQLSAEELAQQIQQTFC

SEQ ID NO: 249 - DNA, 1538 bp, Arabidopsis thaliana
  G1255
cagctcaaactctctaggactacactaaatctaactttttgcagagagcaaaagattcaataattgagattgatctcaaaaccaaagctctcgtgctcttgtcgttgatgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttgaggacttgtatgtacatagaagtaaccaataataatgtgacttttacta

SEQ ID NO: 250 - protein, 416 aa, Arabidopsis thaliana
  G1255  (conserved domain in aa coordinates: 18-56)
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 251 - DNA, 859 bp, Arabidopsis thaliana
  G1266
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 252 - protein, 218 aa, Arabidopsis thaliana
  G1266  (conserved domain in AA coordinates: 79-147)
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 253 - DNA, 748 bp, Arabidopsis thaliana
  G1275
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 254 - protein, 173 aa, Arabidopsis thaliana
  G1275  (conserved domain in AA coordinates: 113-169)
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 255 - DNA, 720 bp, Arabidopsis thaliana
  G1305
atggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctag

SEQ ID NO: 256 - protein, 239 aa, Arabidopsis thaliana
  G1305  (conserved domain in AA coordinates:15-118)
MGNRRAPCCDKSQVKRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRLVKRSISSSSSDVTNHSVSSTSSSSSSISSVLQDVIIKSERPNQEEEFGEILVEQMACGFEVDAPQSLECLFDDSQVPPPISKPDSLQTHGKSSDHEFWSRLIEPGFDDYNEWLIFLDNQTC

SEQ ID NO: 257 - DNA, 1011 bp, Arabidopsis thaliana
  G1322
aaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtctaaaacgtactggaaaaagttgtcggctccggtggctgaactatctccgaccagatgtgcggcgagggaacataaccgaagaagaacagcttttgatcattcagcttcatgctaagcttggaaacaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgagtaaaaaaaaaaaaaa

SEQ ID NO: 258 - protein, 206 aa, Arabidopsis thaliana
  G1322  (conserved domain in AA coordinates:26-130)
METTMKKKGRVKATITSQKEEEGTVRKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMKVSSENMMNHQHHCSGNSQSSGMTTQGSSGKAIDTAESFSQAKTTTFNVVEQQSNENYWNVEDLWPVHLLNGDHHVI

SEQ ID NO: 259 - DNA, 1088 bp, Arabidopsis thaliana
  G1323
aagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaaaaaaaaaaaaaa

SEQ ID NO: 260 - protein, 273 aa, Arabidopsis thaliana
  G1323  (conserved domain in AA coordinates: 15-116)
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQHKQGTEDEHSSSLLESYELLIH

SEQ ID NO: 261 - DNA, 981 bp, Arabidopsis thaliana
  G1330
gtaccggcgacctctttgtgggtcactcttcatcaatgggtgacaaaggaaggagcttaaagatcaacaagaacatggaggaattcacgaaagtggaagaagaaatggacgtaaggagaggtccatggacagttgaggaagatttagagctcatcaattacattgctagtcatggtgaaggtcgatggaactctctcgctcgttgcgccgaactcaaaaggaccggaaaaagctgcagacttcggtggctgaactatctccgaccagatgtgcgccgtggaaacataaccctcgaagaacaactcttgattcttgaacttcacacacgttggggcaatagatggtctaagattgcacaatatttaccaggaagaacggataacgagatcaaaaactattggagaacacgtgttcaaaagcatgcaaaacagcttaaatgcgacgtgaacagtcaacaatttaaagacaccatgaagtatctttggatgcctcggctcgtagaaaggatccaagccgcgtccatcgggtctgtttccatgtcatcttgcgtcaccacctcctcagatcagttcgtgatcaacaacaacaacaccaacaacgtggataatttggctttaatgagtaaccctaatggttacatcacgccggataattccagcgtggcagtatctcctgtatcagatttgacggagtgtcaagtgagtagtgaagtgtggaagattggtcaggatgagaatttggtggatccaaaaatgacatcgccgaattatatggataatagcagtggactattaaacggagattttacgaagatgcaagatcaaagtgaccttaattggtttgaaaatattaatgggatggtaccaaattattcggacagtttttggaacattggaaatgatgaagacttctggctcttacaacaacatcaacaagtccacgacaatggaagcttctgaatagacaagaagctatgcggcc

SEQ ID NO: 262 - protein, 307 aa, Arabidopsis thaliana
  G1330  (conserved domain in AA coordinates: 28-134)
MGDKGRSLKINKNMEEFTKVEEEMDVRRGPWTVEEDLELINYIASHGEGRWNSLARCAELKRTGKSCRLRWLNYLRPDVRRGNITLEEQLLILELHTRWGNRWSKIAQYLPGRTDNEIKNYWRTRVQKHAKQLKCDVNSQQFKDTMKYLWMPRLVERIQAASIGSVSMSSCVTTSSDQFVINNNNTNNVDNLALMSNPNGYITPDNSSVAVSPVSDLTECQVSSEVWKIGQDENLVDPKMTSPNYMDNSSGLLNGDFTKMQDQSDLNWFENINGMVPNYSDSFWNIGNDEDFWLLQQHQQVHDNGSF

SEQ ID NO: 263 - DNA, 786 bp, Arabidopsis thaliana
  G1331
atggtggaagaagtttggagaaagggtccatggaccgccgaagaagaccgtcttttgatcgaatacgtccgtgttcacggtgaaggtcgttggaactctgtctctaaactcgcaggattgaaaaggaatggcaaaagctgcagactaagatgggtgaattaccttagaccagacctcaagagaggacagatcactccacatgaagaaagtataatacttgagctacacgctaagtggggaaataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaa

SEQ ID NO: 264 - protein, 261 aa, Arabidopsis thaliana
  G1331  (conserved domain in AA coordinates:8-109)
MVEEVWRKGPWTAEEDRLLIEYVRVHGEGRWNSVSKLAGLKRNGKSCRLRWVNYLRPDLKRGQITPHEESIILELHAKWGNRWSTIARSLPGRTDNEIKNYWRTHFKKKAKPTTNNAEKIKSRLLKRQHFKEQREIELQQEQQLFQFDQLGMKKIISLLEENNSSSSSDGGGDVFYYPDQITHSSKPFGYNSNSLEEQLQGRFSPVNIPDANTMNEDNAIWDGFWNMDVVNGHGGNLGVVAATAACGPRKPYFHNLVIPFC

SEQ ID NO: 265 - DNA, 606 bp, Arabidopsis thaliana
  G1332
atggaatgcaaaagagaagaagggaagtcttacgtgaagagagggttgtggaaaccagaagaagatatgatattaaaaagctatgttgagactcatggtgaaggaaactgggcagacatttctcgtagatccgggttgaagagaggaggaaaaagctgtaggctgagatggaagaactatctaagaccaaatatcaaaagaggaagcatgtcaccacaagaacaagaccttatcatccgcatgcataagcttcttggaaacagatggtcgttgatcgctggtcgccttccaggtcgtactgacaatgaagtgaagaactactggaatactcatttgaacaagaaacctaattcccgaaaacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttag

SEQ ID NO: 266 - protein, 201 aa, Arabidopsis thaliana
  G1332  (conserved domain in AA coordinates:13-116)
MECKREEGKSYVKRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKPNSRKQNAPESIVGATPFTDKPVMSTELRRSHGEGGEEESNTWMEETNHFGYDVHVGSPLPLISHYPDNTLVFDPCFSFTDFFPLL

SEQ ID NO: 267 - DNA, 1011 bp, Arabidopsis thaliana
  G1363
cgtctacctactatggtctggagattagttcgtttattgaactaatgttttagacaatgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatgtgagagagctcccgcaagtggtggatgaggc

SEQ ID NO: 268 - protein, 308 aa, Arabidopsis thaliana
  G1363  (conserved domain in AA coordinates: 174-226)
MQEFHSSKDSLPCPATSWDNSVFTNSNVQGSSSLTDNNTLSLTMEMKQTGFQMQHYDSSSTQSTGGESYSEVASLSEPTNRYGHNIVVTHLSGYKENPENPIGSHSISKVSQDSVVLPIEAASWPLHGNVTPHFNGFLSFPYASQHTVQHPQIRGLVPSRMPLPHNIPENEPIFVNAKQYQAILRRRERRAKLEAQNKLIKVRKPYLHESRHLHALKRVRGSGGRFLNTKKHQESNSSLSPPFLIPPHVFKNSPGKFRQMDISRGGVVSSVSTTSCSDITGNNNDMFQQNPQFRFSGYPSNHHVSVLM

SEQ ID NO: 269 - DNA, 1034 bp, Arabidopsis thaliana
  G1411
taaagaaaaactgaacaaccctaaagtactgtataaatcctatatcaaattttttttttggaagaaaaggctatatttaaaagaaaatcaagcaaaagtagatcctcggatgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaattaggagatttgatcagttacttgtgatgaagtaatgatacatttcccgtcaaaattgagatgatcatatgcttcctgaatgtttttgagtgtcatttttgtcttccgcgttaagatttattgaacgtgttttcttgtttttttggttaaaaaaaaaaaaaaaaaaaaaaaaaaaaaa

SEQ ID NO: 270 - protein, 248 aa, Arabidopsis thaliana
  G1411  (conserved domain in AA coordinates: 87-154)
MYGKRPFGGDESEEREEDENLFPVFSARSQHDMRVMVSALTQVIGNQQSKSHDNISSIDDNYPSVYNPQDPNQQVAPTHQDQGDLRRRHYRGVRQRPWGKWAAEIRDPKKAARVWLGTFETAESAALAYDEAALKFKGSKAKLNFPERVQLGSNSTYYSSNQIPQMEPQSIPNYNQYYHDASSGDMLSFNLGGGYGSGTGYSMSHDNSTTTAATTSSSSGGSSRQQEEQDYARFWRFGDSSSSPHSGY

SEQ ID NO: 271 - DNA, 1651 bp, Arabidopsis thaliana
  G1417
tctatctctatctatctctctttgtctgcaaatggaagaacatattcaagatcgccgtgaaattgcgttcttacactcaggagaatttctccacggagattctgactcaaaggatcatcaaccgaacgagtctccggtggaacgtcatcacgagtcgtctatcaaagaagttgatttcttcgctgctaaaagtcagccgtttgatcttggtcatgtgagaacaacgacgatcgttggatcatctggttttaatgatggattaggtttggtaaattcatgtcatggaacatcaagcaatgatggcgatgacaaaaccaaaactcaaattagtagactgaagttggagctagagaggcttcacgaggagaatcacaaactgaagcatttattagatgaggtcagtgagagttacaacgacctccaaagaagagttttgttagcaagacaaacacaagtggaaggtcttcatcataaacaacatgaggatgtacctcaagctggttcctcacaagctctagagaacagaagaccaaaggatatgaaccatgaaactccggccaccaccttgaaacgacggtctccagacgacgtggatggtcgtgatatgcaccgaggatcaccaaaaactcctcgaatagaccaaaacaagagtactaatcatgaagaacaacaaaaccctcatgatcaattaccctatagaaaagctagggtttccgttagagctagatctgatgccactacggtaaatgacggatgtcaatggagaaaatacggtcagaaaatggcgaaagggaatccatgtcctcgcgcttattatcgttgcaccatggccgttggatgtcctgtccgtaaacaggtccaacgatgcgcggaggatacaactatcttgacaacaacgtacgaaggaaaccataaccatcctcttcccccgtcagccacagccatggctgcaaccacctccgccgcagcagccatgctcttatcaggctcctcctccagcaacctccaccaaacactctctagcccctccgccacgtcatcatcatccttctaccataacttcccatacacctccacaatcgcaacactctctgcctcagctcctttccccaccataaccttagacctcaccaacccacctcgaccgctacaaccgccaccgcagtttctaagccagtatggtcccgccgcgtttttaccaaacgctaatcaaattaggtctatgaataataataaccagcagttattaatacctaatttgtttggcccacaagccccaccacgtgaaatggtcgattcagttagggctgcgattgcgatggatccgaacttcacggcggcacttgcggccgcgatctcaaacattatcggaggaggtaataacgacaacaataataatactgatattaatgataacaaggttgatgcaaaaagtggagggagtagtaacggagattcgccacagcttcctcagtcttgcaccactttctctacaaactaattttactaccattattatatgttatcttattatatattacacacacatattatacattatgcgtatcttaagtttttttttgggggccattatatatgaatgatatggagatcactgagagagagagagagctattatgggttttttttt

SEQ ID NO: 272 - protein, 489 aa, Arabidopsis thaliana
  G1417  (conserved domain in AA coordinates: 239-296)
MEEHIQDRREIAFLHSGEFLHGDSDSKDHQPNESPVERHHESSIKEVDFFAAKSQPFDLGHVRTTTIVGSSGFNDGLGLVNSCHGTSSNDGDDKTKTQISRLKLELERLHEENHKLKHLLDEVSESYNDLQRRVLLARQTQVEGLHHKQHEDVPQAGSSQALENRRPKDMNHETPATTLKRRSPDDVDGRDMHRGSPKTPRIDQNKSTNHEEQQNPHDQLPYRKARVSVRARSDATTVNDGCQWRKYGQKMAKGNPCPRAYYRCTMAVGCPVRKQVQRCAEDTTILTTTYEGNHNHPLPPSATAMAATTSAAAAMLLSGSSSSNLHQTLSSPSATSSSSFYHNFPYTSTIATLSASAPFPTITLDLTNPPRPLQPPPQFLSQYGPAAFLPNANQIRSMNNNNQQLLIPNLFGPQAPPREMVDSVRAAIAMDPNFTAALAAAISNIIGGGNNDNNNNTDINDNKVDAKSGGSSNGDSPQLPQSCTTFSTN

SEQ ID NO: 273 - DNA, 820 bp, Arabidopsis thaliana
  G1419
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 274 - protein, 221 aa, Arabidopsis thaliana
  G1419  (conserved domain in AA coordinates: 69-137)
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 275 - DNA, 799 bp, Arabidopsis thaliana
  G1449
tagacagagagaaatagaaatagagagagagagacatgaagagcactctcaatagagaagagaaggaagcatgaagctagctctgcagcttcaaggtctcattaatggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattaaaacttggatcggtcaaggctgtgattgcgcagttacgagacgtgtaagatttaggcattgatgaagagacttgaggcgggacggagctattgctgcatattgcaacaaaggccttgaagaagttggagaattgattgatgcatatatttatttatatgacacctttgagtgtgttttttcttataaataaatcacaatatccaagacttctctttaaa

SEQ ID NO: 276 - protein, 158 aa, Arabidopsis thaliana
  G1449  (conserved domain in AA coordinates: 48-53,74-107,122-152)
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 277 - DNA, 2816 bp, Arabidopsis thaliana
  G1451
tttgtacttccggagctaaagagttatagctactgtagtagctggaagtgaagaagattttttaatagattgtacggaaaaattagggttttcaaagtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcgggagccctttgtttcccatttgaagtcgtttccactcatctttatatgccattcgttcgcatctctctcgttttgacgtttttagaaagaaacataatcatatttgtgagtatgggtcctgaaactttaggacgtactttagcttgtattagacagacactctcgtcataaacataagaacctttatgtagctgtctcagggtaactaaacttttctag

SEQ ID NO: 278 - protein, 811 aa, Arabidopsis thaliana
  G1451  (conserved domain in AA coordinates: 22-357)
MKLSTSGLGQQGHEGEKCLNSELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEPLTTFPMYPSLFPLRLKRPWHAGTSSLPDGRGDLGSGLTWLRGGGGEQQGLLPLNYPSVGLFPWMQQRLDLSQMGTDNNQQYQAMLAAGLQNIGGGDPLRQQFVQLQEPHHQYLQQSASHNSDLMLQQQQQQQASRHLMHAQTQIMSENLPQQNMRQEVSNQPAGQQQQLQQPDQNAYLNAFKMQNGHLQQWQQQSEMPSPSFMKSDFTDSSNKFATTASPASGDGNLLNFSITGQSVLPEQLTTEGWSPKASNTFSEPLSLPQAYPGKSLALEPGNPQNPSLFGVDPDSGLFLPSTVPRFASSSGDAEASPMSLTDSGFQNSLYSCMQDTTHELLHGAGQINSSNQTKNFVKVYKSGSVGRSLDISRFSSYHELREELGKMFAIEGLLEDPLRSGWQLVFVDKENDILLLGDDPWESFVNNVWYIKILSPEDVHQMGDHGEGSGGLFPQNPTHL

SEQ ID NO: 279 - DNA, 1371 bp, Arabidopsis thaliana
  G1452
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 280 - protein, 373 aa, Arabidopsis thaliana
  G1452  (conserved domain in AA coordinates: 30-177)
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 281 - DNA, 1319 bp, Arabidopsis thaliana
  G1463
tatccttcgcaagacccttcctctatataaggaagttcatttcatttggagaggacacgctgacaagctgactctagcagatctggtaccgtcgacagtttgagatttgcttcatccggtttttttattttctgcaaaatatgtcactctctcccattttgttcatatataatatgtttgaagtttgatcaacttagtatgcgtttctttttctctctagttcctctgtttcttggtcgatttagtttcgttatggcggacacactgctcaacgcagaagacgaagtaataatctcacgttatctgaagcctatgatcgttaacagagtatcatggcctgatctcttcatcgaagacgcagacgtgttcaacaaggatccatatgtgaagttccatgctgagatccctagcttcgtgatcgttaaaccacgaacaaaggcttgtggtaaaaccgatggatgtgattcgggttgctggaggatcattggtcgtgataagctgataaagtcggaggagactggtaagattctagggttcaagaagatactcaagttctgcctaaagtggaaacctagagaatacaagagaagtttggtaatggaagagtataggcttaccaataacttcaactggaagcaagatcatgtgatttgcaagattcggcttttgtttgaagcagaaattagtttcttgctagccaagcatttctacactacatcagactcacttcctcgaaatgtgctgttgccagcttatggattctgttcaccagataaacaagaggaggacgaattttatccggtgacgataatgatttcagaaggaaaagattggcctagctacgttaccaacaacgtgtattgtctgcatccatcggagcttgtgaatgttcacgatgggaagtttcatgataacggaatctgcatcttcgctaacaggacttgtggtgtaaccgataaatgcaatgaaggttactggaagattaagcaccgtgagaagctgatcatgtcacggtacgggcagaccattggttggaagaaagtttttcagttttatgaaacggagaaagaaagacattttggtaatggagaagaagtgaaggtaacttggactctaaaagagtataggcttaccagaaaaatgaacaagaataaagtggtgtgcgttatcaagtataaggtaaagtgtttaccgaggataactagctagggacttctactcttggtttcatgatcgatgcgaccgctctagacaggcctcgtaccggatcctctagctagagctttcgttcgtatcatcggtttcgacaacgttcgtca

SEQ ID NO: 282 - protein, 336 aa, Arabidopsis thaliana
  G1463  (conserved domain in AA coordinates:9-156)
MRFFFSLVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 283 - DNA, 735 bp, Arabidopsis thaliana
  G1471
atggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataa

SEQ ID NO: 284 - protein, 244 aa, Arabidopsis thaliana
  G1471  (conserved domain in AA coordinates: 49-70)
MENQSMSSSSSSTHKHDQKLKSSVVAMEVLEEKETVNNPPQYYNKIYICYLCKRAFPTPHALGGHGTTHKEDRELERQQIESRLSNKDKSNLLFGGSSQDVLSNDNHLGLSLGPLKSIEGSSSSNNVNPLLNVGVPRGTTDMNMNNYSSHALSTDDINLDLTLGPSKSIGDSNNIINNNTNSSFDGNLIIPVRPRVSRYHFVAGNPLDSISRNIPPSITFPHLNINLSHDSFSLQENGSGSSHS

SEQ ID NO: 285 - DNA, 354 bp, Arabidopsis thaliana
  G1478
atgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctga

SEQ ID NO: 286 - protein, 117 aa, Arabidopsis thaliana
  G1478  (conserved domain in aa coordinates: 32-76)
MCRGFEKEEERRSDNGGCQRLCTESHKAPVSCELCGENATVYCEADAAFLCRKCDRWVHSANFLARRHLRRVICTTCRKLTRRCLVGDNFNVVLPEIRMIARIEEHSSDHKIPFVFL

SEQ ID NO: 287 - DNA, 1131 bp, Arabidopsis thaliana
  G1482
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 288 - protein, 331 aa, Arabidopsis thaliana
  G1482  (conserved domain in aa coordinates: 5-63)
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 289 - DNA, 996 bp, Arabidopsis thaliana
  G1488
atggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttga

SEQ ID NO: 290 - protein, 331 aa, Arabidopsis thaliana
  G1488  (conserved domain in AA coordinates: 221-246)
MEDEAHEFFHTSDFAVDDLLVDFSNDDDEENDVVADSTTTTTITDSSNFSAADLPSFHGDVQDGTSFSGDLCIPSDDLADELEWLSNIVDESLSPEDVHKLELISGFKSRPDPKSDTGSPENPNSSSPIFTTDVSVPAKARSKRSRAAACNWASRGLLKETFYDSPFTGETILSSQQHLSPPTSPPLLMAPLGKKQAVDGGHRRKKDVSSPESGGAEERRCLHCATDKTPQWRTGPMGPKTLCNACGVRYKSGRLVPEYRPAASPTFVLAKHSNSHRKVMELRRQKEMSRAHHEFIHHHHGTDTAMIFDVSSDGDDYLIHHNVGPDFRQLI

SEQ ID NO: 291 - DNA, 1424 bp, Arabidopsis thaliana
  G1494
tcgacagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 292 - protein, 430 aa, Arabidopsis thaliana
  G1494  (conserved domain in aa coordinates: 261-311)
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 293 - DNA, 1306 bp, Arabidopsis thaliana
  G1496
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 294 - protein, 335 aa, Arabidopsis thaliana
  G1496  (conserved domain in AA coordinates: 184-248)
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 295 - DNA, 902 bp, Arabidopsis thaliana
  G1499
tcgactccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 296 - protein, 224 aa, Arabidopsis thaliana
  G1499  (conserved domain in AA coordinates: 118-181)
MNNYNMNPSLFQNYTWNNIINSSNNNNKNDDHHHQHNNDPIGMAMDQYTQLHIFNPFSSSHFPPLSSSLTTTTLLSGDQEDDEDEEEPLEELGAMKEMMYKIAAMQSVDIDPATVKKPKRRNVRISDDPQSVAARHRRERISERIRILQRLVPGGTKMDTASMLDEAIRYVKFLKRQIRLLNNNTGYTPPPPQDQASQAVTTSWVSPPPPPSFGRGGRGVGELI

SEQ ID NO: 297 - DNA, 1146 bp, Arabidopsis thaliana
  G1519
atgaggcttaatggggattcgggtccgggtcaggatgaacccggttcgagcgggtttcacggcggaatcagacgattcccgttagcagctcagccggagattatgagagctgctgagaaagacgatcaatacgcttctttcatccacgaagcttgccgcgatgccttccgacaccttttcggtacaagaatcgctcttgcttaccagaaggagatgaagctacttggacagatgctttactatgttcttacgacaggttcagggcaacaaactttaggagaggaatattgtgacattatacaggttgcagggccttatggactctctcctacaccagctagacgtgctttgttcatattgtaccagaccgcagttccatatatcgcagagagaattagcactcgagctgctacgcaagcagtcacctttgatgagtctgatgagttttttggtgatagtcatatccactcaccaagaatgatagatcttccatcttcatctcaagttgaaacttcaacttctgtagtatctaggttaaacgatagacttatgagatcgtggcaccgagctattcagcgatggcctgtggttcttcctgttgcccgcgaagtcttacaactggttttgcgtgccaatctgatgctcttctactttgaaggtttttattatcatatatcgaaacgtgcatccggggttcgttatgttttcataggaaagcaactgaatcagagacctagataccaaattcttggggttttccttctaatccaattgtgcatccttgctgctgagggcttgcgtcggagtaatttgtcatctatcactagctccattcagcaggcttctataggatcttatcaaacttcaggagggagaggtttacctgttttaaatgaagaggggaatttgataacttcggaagctgaaaagggaaactggtctacctccgattcaacttcaacggaggcagtagggaaatgcactctctgcttaagcacccgtcagcacccaacggccactccttgtggtcatgtgttttgttggagctgcattatggaatggtgcaacgagaagcaagaatgccctctttgtcgaacgcccaatacccattcaagtttggtttgtttgtatcattctgatttttag

SEQ ID NO: 298 - protein, 381 aa, Arabidopsis thaliana
  G1519  (conserved domain in AA coordinates: 327-364)
MRLNGDSGPGQDEPGSSGFHGGIRRFPLAAQPEIMRAAEKDDQYASFIHEACRDAFRHLFGTRIALAYQKEMKLLGQMLYYVLTTGSGQQTLGEEYCDIIQVAGPYGLSPTPARRALFILYQTAVPYIAERISTRAATQAVTFDESDEFFGDSHIHSPRMIDLPSSSQVETSTSVVSRLNDRLMRSWHRAIQRWPVVLPVAREVLQLVLRANLMLFYFEGFYYHISKRASGVRYVFIGKQLNQRPRYQILGVFLLIQLCILAAEGLRRSNLSSITSSIQQASIGSYQTSGGRGLPVLNEEGNLITSEAEKGNWSTSDSTSTEAVGKCTLCLSTRQHPTATPCGHVFCWSCIMEWCNEKQECPLCRTPNTHSSLVCLYHSDF

SEQ ID NO: 299 - DNA, 3090 bp, Arabidopsis thaliana
  G1526
atgggaacgaaagtctcagacgatcttgtttccaccgtcagatcagtcgtgggttccgattactcagatatggatataatcagggctttacacatggcgaatcatgatccaacggctgctatcaatataatcttcgacactccaagtttcgccaaacctgatgtagccactcctaccccgagcggctctaatggagggaagcgagttgatagtggattaaagggctgtacttttggtgacagcggaagtgttggagcgaatcatcgcgtggaggaagaaaatgagagtgttaatggtggaggagaagagagtgtttcagggaatgagtggtggtttgttggttgttctgaattggctgggttatcgacatgtaaaggaaggaaattgaagtctggtgatgaattggtgttcacgtttccgcatagtaaaggattaaagcctgagactacgcctgggaagcgcggttttgggcggggaaggccagctttgcgtggtgcttctgatatcgttaggttctctacaaaggattcaggagagattggtagaataccaaacgagtgggctcggtgtcttctaccacttgtgagagacaagaaaattaggatagaaggcagttgcaagtcggcgcctgaagctttgagcatcatggatacaattcttctgtctgtaagcgtgtacattaatagttccatgtttcaaaagcatagtgcgacttcatttaagacagctagtaatacggcagaggaatcaatgttccatcctctcccaaatctctttcggttactcggtttgatcccctttaagaaggcagagtttactccagaggatttttactctaagaagcgacctttgagttccaaggatggttctgctattcctacttcgttgcttcaattaaacaaggtcaagaatatgaatcaagatgcaaacggagatgaaaatgagcagtgtatcagcgatggtgatcttgataacattgttggtgttggggacagttctggattaaaggaaatggaaactccacatacacttctgtgtgagcttcgtccataccaaaagcaggcacttcattggatgacccaactggagaaaggaaattgcactgatgaggcagcaacaatgcttcacccgtgttgggaagcatactgtttagcagacaagagggaactggttgtctacctgaattcttttactggtgatgctacaatacacttccctagcacacttcaaatggcaagaggaggaatattagcagacgcaatgggtcttggaaagactgtaatgaccatatcccttttgcttgcccattcttggaaagctgcatcaactgggtttctatgccccaactatgaaggagacaaagtgatcagcagttctgtagatgatctcactagtcccccggtgaaggcaaccaaatttctaggctttgataagaggcttcttgaacaaaaaagtgtacttcaaaatggtggtaacctgattgtatgtccgatgacacttttaggacagtggaagacagagattgaaatgcatgcaaagcctgggtctctatctgtctatgttcactatgggcaaagcaggccgaaggatgcaaaacttctttcccagagtgatgtggtaatcaccacatatggagttctaacatccgaattctcgcaagagaactcagcagaccatgaaggaatttatgcagttcgatggtttaggattgttcttgacgaggcacataccatcaaaaactcaaaaagccaaatttccttggctgctgcagctctggttgctgataggcgttggtgtcttacgggtactcctattcagaacaatctggaggatttatacagccttctacggtttttgaggattgaaccatggggaacttgggcatggtggaataaacttgtccaaaagccatttgaagagggtgatgagagagggttaaagctagtgcagtctatcttaaaacctatcatgcttaggagaacaaagtctagcacagaccgagaaggaaggccgattcttgttctaccccctgctgatgcacgggtcatttactgtgaactttcggagtctgagagggatttctacgacgcgctatttaaaagatccaaggtcaaatttgatcaatttgttgaacaaggcaaagttcttcataactatgcttcgatcctggaactgcttttgcgtcttcgacaatgttgtgatcacccatttttagtaatgagtcgaggggatacagcggaatactctgatctgaataagctttctaaacgtttccttagtggaaagtcttctggcttagaaagggaaggaaaagatgtaccgtcagaggcttttgttcaggaggtggtagaggaactgcgcaaaggagagcaaggagagtgtccaatatgccttgaagcacttgaggatgctgtattaacgccatgtgctcatagattatgtcgtgagtgtctcttggcaagttggagaaattctacttctgggttatgtcctgtgtgtaggaacactgtaagcaaacaagaactcatcacagcaccaaccgaaagtagattccaggttgacgtggaaaagaattgggtggaatcatcgaaaatcactgctcttctggaagagcttgaaggtcttcgttcttcaggctctaagagcattctctttagccagtggaccgctttcctcgatctcctccaaattcccctctctcggaataacttttcatttgtccgtcttgatggcacgctaagtcagcagcaacgagagaaggtccttaaagaattttccgaagatggcagtatcctggtactgttgatgtctctaaaagctggtggcgttgggataaatctaacagctgcgtccaatgcttttgtcatggatccatggtggaacccagcggtagaggaacaagctgttatgcgtattcatcgtatagggcaaactaaggaagtcaaaatcagaagattcatcgttaagggaacggttgaagagagaatggaggcggttcaggcgaggaagcagagaatgatctctggggctttaaccgatcaagaagtacgaagtgcacgtatagaggaactcaagatgttatttacctga

SEQ ID NO: 300 - protein, 1029 aa, Arabidopsis thaliana
  G1526  (conserved domain in AA coordinates: 493-620, 864-1006)
MGTKVSDDLVSTVRSVVGSDYSDMDIIRALHMANHDPTAAINIIFDTPSFAKPDVATPTPSGSNGGKRVDSGLKGCTFGDSGSVGANHRVEEENESVNGGGEESVSGNEWWFVGCSELAGLSTCKGRKLKSGDELVFTFPHSKGLKPETTPGKRGFGRGRPALRGASDIVRFSTKDSGEIGRIPNEWARCLLPLVRDKKIRIEGSCKSAPEALSIMDTILLSVSVYINSSMFQKHSATSFKTASNTAEESMFHPLPNLFRLLGLIPFKKAEFTPEDFYSKKRPLSSKDGSAIPTSLLQLNKVKNMNQDANGDENEQCISDGDLDNIVGVGDSSGLKEMETPHTLLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEGDERGLKLVQSILKPIMLRRTKSSTDREGRPILVLPPADARVIYCELSESERDFYDALFKRSKVKFDQFVEQGKVLHNYASILELLLRLRQCCDHPFLVMSRGDTAEYSDLNKLSKRFLSGKSSGLEREGKDVPSEAFVQEVVEELRKGEQGECPICLEALEDAVLTPCAHRLCRECLLASWRNSTSGLCPVCRNTVSKQELITAPTESRFQVDVEKNWVESSKITALLEELEGLRSSGSKSILFSQWTAFLDLLQIPLSRNNFSFVRLDGTLSQQQREKVLKEFSEDGSILVLLMSLKAGGVGINLTAASNAFVMDPWWNPAVEEQAVMRIHRIGQTKEVKIRRFIVKGTVEERMEAVQARKQRMISGALTDQEVRSARIEELKMLFT

SEQ ID NO: 301 - DNA, 1227 bp, Arabidopsis thaliana
  G1540
atctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcgggattaaagctctttcctctctctctctctttcgtactcgtatgttcacaactatgcttcgctagtgattaatgatgcagttgttatattagtagttaactagttatctctcgttatgtgtaatttgtaattactagctaagtatcgtctaggtttaattgtaattgacaaccgtttatctctatgatgaataagttaaatttatatat

SEQ ID NO: 302 - protein, 291 aa, Arabidopsis thaliana
  G1540  (conserved domain in AA coordinates: 35-98)
MEPPQHQHHHHQADQESGNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQDEEECGGDAYLEHRRTLPLFPMHGEDHINGGSGAIWKYGQSEVRPCASLELRLN

SEQ ID NO: 303 - DNA, 828 bp, Arabidopsis thaliana
  G1543
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 304 - protein, 275 aa, Arabidopsis thaliana
  G1543  (conserved domain in AA coordinates: 135-195)
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAIKVGPTTVNSASSLTMCPRCERVTPAASPSRAVVPVPAKKTFPPQERDR

SEQ ID NO: 305 - DNA, 896 bp, Arabidopsis thaliana
  G1634
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 306 - protein, 277 aa, Arabidopsis thaliana
  G1634  (conserved domain in AA coordinates: 129-180)
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 307 - DNA, 954 bp, Arabidopsis thaliana
  G1637
atggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatga

SEQ ID NO: 308 - protein, 317 aa, Arabidopsis thaliana
  G1637  (conserved domain in AA coordinates: 109-173)
MVKETVTVAKTCSHCGHNGHNARTCLNGVNKASVKLFGVNISSDPIRPPEVTALRKSLSLGNLDALLANDESNGSGDPIAAVDDTGYHSDGQIHSKKGKTAHEKKKGKPWTEEEHRNFLIGLNKLGKGDWRGIAKSFVSTRTPTQVASHAQKYFIRLNVNDKRKRRASLFDISLEDQKEKERNSQDASTKTPPKQPITGIQQPVVQGHTQTEISNRFQNLSMEYMPIYQPIPPYYNFPPIMYHPNYPMYYANPQVPVRFVHPSGIPVPRHIPIGLPLSQPSEASNMTNKDGLDLHIGLPPQATGASDLTGHGVIHVK

SEQ ID NO: 309 - DNA, 1300 bp, Arabidopsis thaliana
  G1640
ttcgccagatccttcctctatataaggaagttcatttcatttggagaggtttcgctgacaagctgctctagcttatctggtaccgtcgacctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattggcggccgctctagacaggcctcgtaccggatctctagctagagctttcgttcgtatcatcggtttcgacaacgttcgtcaagt

SEQ ID NO: 310 - protein, 342 aa, Arabidopsis thaliana
  G1640  (conserved domain in AA coordinates: 14-115)
MGRAPCCEKIGLKRGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRKIYAFTAVSGDGHNLLVNDVVLKKSCSSSSGAKNNNKTKKKKKGRTSRSSMKKHKQMVTASQCFSQPKELESDFSEGGQNGNFEGESLGPYEWLDGELERLLSSCVWECTSEEAVIGVNDEKVCESGDNSSCCVNLFEEEQGSETKIGHVGITEVDHDMTVEREREGSFLSSNSNENNDKDWWVGLCNSSEVGFGVDEELLDWEFQGNVTCQSDDLWDLSDIGEITLE

SEQ ID NO: 311 - DNA, 1144 bp, Arabidopsis thaliana
  G1645
cgtcgacctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtggc

SEQ ID NO: 312 - protein, 359 aa, Arabidopsis thaliana
  G1645  (conserved domain in AA coordinates: 90-210)
MFITEKQVWMDEIVARRASSSWDFPFNDINIHQHHHRHCNTSHEFEILKSPLGDVAVHEEESNNNNPNFSNSESGKKETTDSGQSWSSSSSKPSVLGRGHWRPAEDVKLKELVSIYGPQNWNLIAEKLQGRSGKSCRLRWFNQLDPRINRRAFTEEEEERLMQAHRLYGNKWAMIARLFPGRTDNSVKNHWHVVMARKYREHSSAYRRRKLMSNNPLKPHLTNNHHPNPNPNYHSFISTNHYFAQPFPEFNLTHHLVNNAPITSDHNQLVLPFHCFQGYENNEPPMVVSMFGNQMMVGDNVGATSDALCNIPHIDPSNQEKPEPNDAMHWIGMDAVDEEVFEKAKQQPHFFDFLGLGTA

SEQ ID NO: 313 - DNA, 800 bp, Arabidopsis thaliana
  G1646
gatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaagggtaagtgaattctagtag

SEQ ID NO: 314 - protein, 250 aa, Arabidopsis thaliana
  G1646  (conserved domain in AA coordinates: 72-162)
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 315 - DNA, 1387 bp, Arabidopsis thaliana
  G1652
agcaagtccaaatctccctctctctctctctatctatctctctatagaagattttttaactaagaagctagcgatcatggccacagcgatgaacgttttctctaccaaatggtcctccgaattggatatagaagaatatagtatcatccaccaattccacatgaactcactcgtcggagatgttccacagtctctctcatctcttgatgataccaccacttgttataaccttgatgcttcttgtaataaaagtttggtagaagaaagaccttcaaagatcctcaagaccactcacatatcaccaaacttacatcctttttcttcttctaatcctcctcctccaaagcaccagccctcttctaggattctttcttttgaaaagacaggtttacatgttatgaatcacaactctccaaacttaatatttagccccaaggacgaagaaattggattaccagagcataagaaagccgagctgataataagagggacaaagagagctcaatccttgactcgaagccaatcaaatgctcaagatcacatactggcagagagaaaacggagagagaagcttactcaaagatttgtagctctttccgcgctaattcctggcctaaagaagatggacaaggcttctgtgttgggagatgcaataaagcatataaagtacctccaagagagtgtgaaagagtatgaggaacaaaagaaggaaaagacaatggaatcagtggttcttgtaaagaagtctagtctggttttagatgaaaatcatcaaccatcatcatcatcttcctcagatggaaatcgcaatagctcgagctcaaatcttccagaaatagaagttagggtttcaggaaaagatgttcttattaagatcctatgcgagaagcaaaagggtaatgtgatcaagattatgggggagattgaaaagcttggtttgtctatcaccaacagcaatgtcttgccctttggacccacttttgacatctctattatcgctcagaagaataacaattttgatatgaaaatcgaggatgttgtgaagaacttgagttttggcttatcaaagctcacttaattggtttcacgttacatacatatacacattcatcatcgatttctccgatcgaagaatccaaaatcagtttttccatgaaagtggttttttagttgttaagtttgttgtatggagattcttaagtcatttaaagatccttgttcttgtgttgttaagtgtgctttaagatgcatatcatcaaatgtttagtaattatttctctccagtttcatttgggacggaatttttttcgcagttgttggatatatatttcctgcgatgtaaagcatttcgttagtttaataaacgtccgatatgtttctttgaaaa

SEQ ID NO: 316 - protein, 333 aa, Arabidopsis thaliana
  G1652  (conserved domain in AA coordinates:143-215)
MATAMNVFSTKWSSELDIEEYSIIHQFHMNSLVGDVPQSLSSLDDTTTCYNLDASCNKSLVEERPSKILKTTHISPNLHPFSSSNPPPPKHQPSSRILSFEKTGLHVMNHNSPNLIFSPKDEEIGLPEHKKAELIIRGTKRAQSLTRSQSNAQDHILAERKRREKLTQRFVALSALIPGLKKMDKASVLGDAIKHIKYLQESVKEYEEQKKEKTMESVVLVKKSSLVLDENHQPSSSSSSDGNRNSSSSNLPEIEVRVSGKDVLIKILCEKQKGNVIKIMGEIEKLGLSITNSNVLPFGPTFDISIIAQKNNNFDMKIEDVVKNLSFGLSKLT

SEQ ID NO: 317 - DNA, 1690 bp, Arabidopsis thaliana
  G1672
ccattcctgacgtccgggatgacgcacaatcccactatccttcgcaagacccttcctctatataaggaagttcatttcatttggagaggacacgctgacaagctgactctagcagatctggtaccgatcactcccgtctttatcaaattcttcttcctcttacattttccctatccaatcgatctcacgcagatctgatcaatttctcatcaaatcatttagagatcaaaagaaaactatgaagaatagtaaatgtaacctcatagattcaaagctcgaagaacatcatcatctttgcggatcaaaacattgtcctggatgtggtcgcatgattcaagctgctactaaaccaaattgggttggattgccggcaggagtgaaattcgatccgacagatcaagaacttatagaacatttagaagcaaaagtgaagggaaaagaagaaaataagaaatggtcgtcgtctcatccacttatagatgaatttattcccaccattgatggagaagatggaatatgttacactcatcctcagaagcttccaggggtgacaagagatggcttgagcaaacacttcttccacaaaccatcaagagcttacacaaccggaacaagaaaacgacgtaaaataattcaaaccgatcacgactctgagttaaccggatcatcagaaaccaggtggcacaaaacgggcaaaacaagaccggttatgatcaacggtcaacaaagaggatgcaagaagatattagtactctacacaaacttcggcaagaatcgtcgaccggagaaaacaaattgggtgatgcatcaatatcatttagggattaatgaggaagagagagaaggagaacttgtggtctccaagatattttatcagacacaaccaagacagtgtgttagtaatactaattggtctgatcaccatggttccaaggacgtgatcggaattggtgtcggagatgagatttccagcgtagctgccacgttgcagagtcttggctccggtgacgtcgtttctagggttaatatgcatccccatacaagatcctttgatgaggggacagccgaagcttcaaagggaagagagaaccagcatgtgtctggcacgtgcgaggaagtacatgatgggatcataacatcatcaatgtcatctcatcatatgattcatgatcatcataatcaacatcatcaaatcggagatagaagagaatttcacatgtcatcatcatatcccatgacccctactatcacatcacaacatgagtcaatcttccatgttacaagtactatgccctttcagcggcagcaattaaggggtcggtcgtctggttcgggattagaagacctaattatgggttgtaccacagctacgtgtacagaagacaataatcacaaatgattaaattcgcaggagcattcagaagcaaaccctcagcgaaatgcagagtggttaacgtttccacaattctggaaccaagccgaatcagatgatcaaaaccgaagattttaacagaaccaaaaggaagcagagaaatcttgcaaaaagctcctgcttagctgttgatcaatgccggaaatgctgagctatgactgactagtctctgccatttaacttacaatatcaccagaggttgcgatgaatgttgattcgctcaaaggagagcggccgctctagacaggcctcgtaccg

SEQ ID NO: 318 - protein, 386 aa, Arabidopsis thaliana
  G1672  (conserved domain in AA coordinates: 41-194)
MKNSKCNLIDSKLEEHHHLCGSKHCPGCGRMIQAATKPNWVGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHLGINEEEREGELVVSKIFYQTQPRQCVSNTNWSDHHGSKDVIGIGVGDEISSVAATLQSLGSGDVVSRVNMHPHTRSFDEGTAEASKGRENQHVSGTCEEVHDGIITSSMSSHHMIHDHHNQHHQIGDRREFHMSSSYPMTPTITSQHESIFHVTSTMPFQRQQLRGRSSGSGLEDLIMGCTTATCTEDNNHK

SEQ ID NO: 319 - DNA, 1130 bp, Arabidopsis thaliana
  G1677
cagtactaattctgtgtgtgttaatggttctagttatggatgatgaagagagtaacaacgttgaaagatatgacgacgtcgtattgccagggtttaggttccatcccactgatgaagaactcgtaagtttctacttgaaacggaaggttttacacaaatctcttccctttgatctcatcaagaaagtcgacatttacaaatacgatccatgggacctcccaaagcttgcagcgatgggggaaaaagagtggtacttttattgtcctagagacaggaaataccgcaacagcacaagacctaaccgagtaactggaggtggcttctggaaagcaaccggaacagaccggcctatatactcattggactccactcgatgcatcggtttgaagaaatcacttgtgttctaccgtggtcgagctgctaaaggagtcaaaaccgattggatgatgcatgaatttcgtctcccttctctctctgactctcatcactcatcatatcccaattacaataacaagaagcaacaccttaacaataacaacaacagcaaggagcttccttcaaacgatgcttgggcgatatgtagaatatttaagaagacaaatgcagtatcctcacaaagatcaatcccacaatcttgggtttatccaacgattcctgacaacaatcaacagtcacacaacaacaccgcaactctcttagcttcatcagacgttctcagccacatatcaacaagacaaaactttattccttctccagtcaacgaacccgcaagcttcacagaatcagctgcttcttacttcgcgtctcagatgctcggagtcacgtacaatacagccagaaacaacggaacaggggatgctctgtttctgagaaacaatggaacaggggatgctctggttctgagcaacaatgagaataactacttcaacaacttgactggagggttgactcatgaggttccgaatgtaagatcaatggtgatggaggagactacggggagtgagatgtcggcgacgtcgtattccactaacaattaagatcatagtactattaacacttgaattagtgtagacgttgatcatcgctaatatgtattaatttttcttgtcttactataaacgaaaaaaaaa

SEQ ID NO: 320 - protein, 337 aa, Arabidopsis thaliana
  G1677  (conserved domain in AA coordinates:17-181)
MVLVMDDEESNNVERYDDVVLPGFRFHPTDEELVSFYLKRKVLHKSLPFDLIKKVDIYKYDPWDLPKLAAMGEKEWYFYCPRDRKYRNSTRPNRVTGGGFWKATGTDRPIYSLDSTRCIGLKKSLVFYRGRAAKGVKTDWMMHEFRLPSLSDSHHSSYPNYNNKKQHLNNNNNSKELPSNDAWAICRIFKKTNAVSSQRSIPQSWVYPTIPDNNQQSHNNTATLLASSDVLSHISTRQNFIPSPVNEPASFTESAASYFASQMLGVTYNTARNNGTGDALFLRNNGTGDALVLSNNENNYFNNLTGGLTHEVPNVRSMVMEETTGSEMSATSYSTNN

SEQ ID NO: 321 - DNA, 755 bp, Arabidopsis thaliana
  G1749
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtgt

SEQ ID NO: 322 - protein, 158 aa, Arabidopsis thaliana
  G1749  (conserved domain in AA coordinates:84-155)
MENSENVPSYDQNINFTPNLTRDQEHVIMVSALQQVISNVGGDTNSNAWEADLPPLNAGPCPLCSVTGCYGCVFPRHEAIIKKEKKHKGVRKKPSGKWAAEIWDPSLKVRRWLGTFPTAEMAAKAYNDAAAEFVGRRSARRGTKNGEEASTKKTTEKN

SEQ ID NO: 323 - DNA, 1136 bp, Arabidopsis thaliana
  G1750
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 324 - protein, 335 aa, Arabidopsis thaliana
  G1750  (conserved domain in AA coordinates: 107-173)
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 325 - DNA, 1031 bp, Arabidopsis thaliana
  G1756
atatgtacttgtacaccaacccaccaaaagagataaaagaggaaacaaaaactcgaaaagagagagatatatgggtgaggtggcttatatggacgaaggagacctagaagcaatagtcagaggctactccggctccggagacgcgttttccggcgaaagttccggtacgttttcaccttcgttttgcctaccgatggagacgtctagtttctacgaaccggagatggagacaagtggcttagatgagctcggtgaactttacaaacccttttaccctttctccacacaaacgatcctcacaagctcggtctctctccctgaagattcaaaacctttccgagatgacaagaaacaacgatcacatggttgtcttttatccaacggatcaagagctgatcatatccgaatttcagaatccaaatcaaagaaaagcaagaagaatcaacagaagagagttgttgagcaagtgaaagaagagaatctgttgtcggacgcatgggcgtggcgtaaatacgggcagaaacccatcaaaggatctccatacccaaggagttattacagatgcagtagctcaaaagggtgtttggcaagaaaacaagtcgaaagaaatcctcaaaacccggagaaattcaccataacatacactaatgagcacaatcatgaactaccaacccggagaaactcattagccggttcgactcgagcaaaaacttcccaacccaaaccaaccttaaccaaaaaatccgaaaaagaagttgtttcttcccctacaagtaatcctatgatcccatccgctgatgaatcttctgttgcggttcaagaaatgagcgttgcggaaacgagtacgcaccaagcggctggagcaatcgagggccgccgcttgagtaacggtttaccatcggatttgatgtccgggagcggaacttttccaagttttaccggtgacttcgatgaactattgaatagccaagagttcttcagtgggtatttatggaattactagagagcattaggtgtatgtatatatatat

SEQ ID NO: 326 - protein, 310 aa, Arabidopsis thaliana
  G1756  (conserved domain in aa coordinates: 138-200)
MGEVAYMDEGDLEAIVRGYSGSGDAFSGESSGTFSPSFCLPMETSSFYEPEMETSGLDELGELYKPFYPFSTQTILTSSVSLPEDSKPFRDDKKQRSHGCLLSNGSRADHIRISESKSKKSKKNQQKRVVEQVKEENLLSDAWAWRKYGQKPIKGSPYPRSYYRCSSSKGCLARKQVERNPQNPEKFTITYTNEHNHELPTRRNSLAGSTRAKTSQPKPTLTKKSEKEVVSSPTSNPMIPSADESSVAVQEMSVAETSTHQAAGAIEGRRLSNGLPSDLMSGSGTFPSFTGDFDELLNSQEFFSGYLWNY

SEQ ID NO: 327 - DNA, 1095 bp, Arabidopsis thaliana
  G1765
tccttcgcaagacccttcctctatataaggaagttcatttcatttggagaggacacgctgacaagctgactctagcagatctggtaccgtcgacaagaatgacttgattggtgttctaaagagatcgatgtagtgaagatgagtggcgaaggtaacttaggtaaggatcatgaagaagaaaacgaagcaccacttcctgggttcaggtttcatccgacggatgaagagcttttaggatactatcttcgaagaaaagtagagaacaaaaccatcaaactcgaacttatcaaacagatcgatatctataagtacgatccttgggatcttccaagagtgagcagcgtcggagaaaaggagtggtacttcttctgcatgagaggtaggaaatacaggaatagcgttcgaccaaaccgagtgaccggttcaggtttctggaaagccactggtattgataaaccggtttactccaatcttgactgtgttggtctcaagaaatctctggtttactatcttggttcagccggtaaaggcaccaaaaccgattggatgatgcatgaattccgcctcccctccaccacgaaaaccgactctccagctcaacaagcagaggtatggacactttgcagaatcttcaaacgagtcacatctcaaagaaacccaaccatcttaccaccaaaccgaaaaccggttatcactttaaccgacacttgttctaagaccagcagcttagattccgaccacacgagccaccgtacagtagattccatgtcccacgagccgccgcttccacagccacagaatccttattggaaccaacatatagttggttttaatcaaccgacatatactggtaatgataataacctcctgatgagtttctggaacggcaacggtggagatttcataggagactcagcaagttgggatgaacttagatctgttatagatggcaacactaaaccctagtaataaagtttccttttttcagctttgtacaaaaagataaaacaaacggcaaccgctctagacaggcctcgtaccgggatcctctagctagagctttcgtttcgtatcatcggtttcgacaacgttcgt

SEQ ID NO: 328 - protein, 275 aa, Arabidopsis thaliana
  G1765  (conserved domain in AA coordinates: 20-140)
MSGEGNLGKDHEEENEAPLPGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHEFRLPSTTKTDSPAQQAEVWTLCRIFKRVTSQRNPTILPPNRKPVITLTDTCSKTSSLDSDHTSHRTVDSMSHEPPLPQPQNPYWNQHIVGFNQPTYTGNDNNLLMSFWNGNGGDFIGDSASWDELRSVIDGNTKP

SEQ ID NO: 329 - DNA, 2006 bp, Arabidopsis thaliana
  G1777
ctcgtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttca

SEQ ID NO: 330 - protein, 593 aa, Arabidopsis thaliana
  G1777  (conserved domain in AA coordinates:124-247)
MDDNLSGEEEDYYYSSDQESLNGIDNDESVSIPVSSRSNTVKVITKESLLAAQREDLRRVMELLSVKEHHARTLLIHYRWDVEKLFAVLVEKGKDSLFSGAGVTLLENQSCDSSVSGSSSMMSCDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSCSSQAHSPCSCVMWELWRKKCFDESETVNWITVHTKPCPKCHKPVEKNGGCNLVTCLCRQSFCWLCGEATGRDHTWARISGHSCGRFQEDKEKQMERAKRDLKRYMHYHNRYKAHIDSSKLEAKLSNNISKKVSISEKRELQLKDFSWATNGLHRLFRSRRVLSYSYPFAFYMFGDELFKDEMSSEEREIKQNLFEDQQQQLEANVEKLSKFLEEPFDQFADDKVMQIRIQVINLSVAVDTLCENMYECIENDLLGSLQLGIHNITPYRSNGIERASDFYSSQNSKEAVGQSSDCGWTSRLDQALESGKSEDTSCSSGKRARIDESYRNSQTTLLDLNLPAEAIERK

SEQ ID NO: 331 - DNA, 696 bp, Arabidopsis thaliana
  G1792
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 332 - protein, 139 aa, Arabidopsis thaliana
  G1792  (conserved domain in aa coordinates: 17-85)
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 333 - DNA, 1818 bp, Arabidopsis thaliana
  G1793
agtgatttattgattaacccaaacacaaaataaacagatttgactcaaaaagaagaaaatgaattctaacaactggcttggctttcctctttcaccgaacaactcttctttgcctcctcatgaatacaaccttggcttggtcagcgaccatatggacaacccttttcaaacacaagagtggaatatgatcaatccacacggtggaggaggagatgaaggaggagaggttccaaaagtggccgattttctcggtgtgagcaaaccggacgaaaaccaatccaaccacctagtagcttacaacgactcagactactacttccataccaatagcttgatgcctagcgtccaatcaaacgatgtcgttgtagcagcttgtgactccaatactcctaacaacagtagctatcatgagcttcaagagagtgctcacaatctacagtcacttactttgtccatggggaccaccgctggtaataatgttgtagacaaagcttcaccatccgagaccaccggggataacgctagcggtggagcactagccgttgttgagacggccacgccaagacgtgcattggacactttcggacaacgaacctcgatctatcgtggtgtcacaagacatcgatggactggtcgatatgaggctcatctatgggataatagttgtagaagggaaggccagtctaggaaaggaagacaagtttacttgggtggatatgacaaagaagataaagcagcaagatcatatgatctagctgcacttaagtactggggtccttcaactactactaatttccccattacaaactacgagaaagaagtagaggaaatgaagcacatgacgagacaagagttcgtggctgccattagaaggaaaagtagtggattttcgagaggcgcttcgatgtatcgaggagttacaaggcatcaccaacatggaagatggcaagcaaggatcggccgagtcgccggaaacaaagacctctacttgggaacttttagcactgaggaagaagcagcagaagcttacgatatagctgcaataaagtttagaggacttaatgcagtgaccaacttcgagatcaaccggtacgacgtgaaagccattctagagagtagcactcttcccatcggaggaggcgcagctaaacggctcaaagaagctcaagctcttgagtcttcaaggaaacgcgaggcggagatgatagcccttggttcaagtttccagtacggtggtggctcgagcacaggctctggctccacctcatcaagacttcagcttcaaccttaccctctaagcattcaacaaccattagagccttttctatctcttcagaacaatgacatctctcattacaacaacaacaatgctcacgattcctcctcttttaatcaccatagctatatccagacacaacttcatctccaccaacagaccaacaattacttgcagcaacagtcgagccagaactctcagcagctctacaatgcgtatcttcatagcaatccggctctgcttcatggacttgtctctacctctatcgttgacaacaataataacaatggaggctctagtgggagctacaacactgcagcatttcttgggaaccacggtattggtattgggtccagctcgactgttggatcgaccgaggagtttccaaccgttaaaacagattacgatatgccttccagtgatggaaccggagggtatagtggttggaccagtgagtctgttcaggggtcaaaccctggtggtgttttcactatgtggaatgagtaaacaaggatctctttcttgcggcacaaggaatgggt

SEQ ID NO: 334 - protein, 574 aa, Arabidopsis thaliana
  G1793  (conserved domain in AA coordinates:179-255, 281-349)
MNSNNWLGFPLSPNNSSLPPHEYNLGLVSDHMDNPFQTQEWNMINPHGGGGDEGGEVPKVADFLGVSKPDENQSNHLVAYNDSDYYFHTNSLMPSVQSNDVVVAACDSNTPNNSSYHELQESAHNLQSLTLSMGTTAGNNVVDKASPSETTGDNASGGALAVVETATPRRALDTFGQRTSIYRGVTRHRWTGRYEAHLWDNSCRREGQSRKGRQVYLGGYDKEDKAARSYDLAALKYWGPSTTTNFPITNYEKEVEEMKHMTRQEFVAAIRRKSSGFSRGASMYRGVTRHHQHGRWQARIGRVAGNKDLYLGTFSTEEEAAEAYDIAAIKFRGLNAVTNFEINRYDVKAILESSTLPIGGGAAKRLKEAQALESSRKREAEMIALGSSFQYGGGSSTGSGSTSSRLQLQPYPLSIQQPLEPFLSLQNNDISHYNNNNAHDSSSFNHHSYIQTQLHLHQQTNNYLQQQSSQNSQQLYNAYLHSNPALLHGLVSTSIVDNNNNNGGSSGSYNTAAFLGNHGIGIGSSSTVGSTEEFPTVKTDYDMPSSDGTGGYSGWTSESVQGSNPGGVFTMWNE

SEQ ID NO: 335 - DNA, 1562 bp, Arabidopsis thaliana
  G1794
tctttctttcttcctctttgtctctgtttcttgtttctctctctctctctctacagagttttctttccctcgaagaaaaagaatatttttaaatttaattttctctgcgtttataagctttaagtttcagaggaggaggatttagaaggagggttttgtatgtgtgtcttaaaagtggcaaatcaggaagataacgttggcaaaaaagccgagtctattagagacgatgatcatcggacgttatctgaaatcgatcaatggctttacttattcgcagccgaagacgaccaccaccgtcatagcttccctacgcagcagccgcctccatcgtcgtcgtcctcatctcttatctcaggtttcagtagagagatggagatgtctgctattgtctctgctttgactcacgttgttgctggaaatgttcctcagcatcaacaaggaggcggtgaaggtagcggagaagggacttcgaattcgtcttcttcctcggggcagaaaaggaggagagaggtggaggaaggtggcgccaaagcggttaaggcagctaatactttgacggttgatcaatatttctccggtggtagctctacttctaaagtgagagaagcttcgagtaacatgtcaggtccgggcccaacatacgagtatacaactacggcaactgctagtagcgaaacgtcgtcgtttagtggggaccaacctcggcgaagatacagaggagttagacaaagaccatggggaaagtgggcggctgagattcgagatccatttaaagcagctagagtttggctcggtacgttcgacaatgctgaatcagcagcaagagcttacgacgaagctgcacttcggtttagaggcaacaaagccaaactcaacttccctgaaaacgtcaaactcgttagacctgcttcaaccgaagcacaacctgtgcaccaaaccgctgctcaaagaccgacccagtcaaggaactcgggttcaacgactacccttttgcccataagacctgcttcgaatcaaagcgttcattcgcagccgttgatgcaatcatacaacttgagttactctgaaatggctcgtcaacaacaacagtttcagcaacatcatcaacaatctttggatttatacgatcaaatgtcgtttccgttgcgtttcggtcacactggaggttcaatgatgcaatctacgtcgtcatcatcatctcattctcgtcctctgttttccccggctgctgttcagccgccaccagaatcagctagcgaaaccggttatctccaggatatacaatggccatcagacaagactagtaataactacaataatagtccatcctcctgatgacttgcttcattttatttgtttcactatagagtaatagaaaacaggaaaatgattatatgttatagagttatttttccaaatattatagggtttaggttgtttgtattgttctgctttcatcctctcatgctttttttcttaatttattatatttttgcattataatttcgtttcattgtaacaaacattaaaaagaccacatggagaaaggaaaaaaaagagag

SEQ ID NO: 336 - protein, 391 aa, Arabidopsis thaliana
  G1794  (conserved domain in AA coordinates: 182-249)
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 337 - DNA, 1716 bp, Arabidopsis thaliana
  G1804
tatctctctctttctcaaaacctttcagtcaaaattctccggcggcttttaaactatgtgaaggaggagaacctccataacaagaagcggattctctcagttttccggcggcggaggaacacaaagccaccggtttttagacacacagatttcattttcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagcatatacagtggaattggaagctgaacttaaccagttgaaagaagagaatgcgcagctaaaacatgcattggcggagttggagaggaagaggaagcaacagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgaggaatgaggttatagaatctttatactttgatgttttctgtgttggtaggaggaacaccatctgatctgctttactagtgttccctgtgaacaaagaaagtgattctgtgtttcaacatcatcaatctttggaaa

SEQ ID NO: 338 - protein, 442 aa, Arabidopsis thaliana
  G1804  (conserved domain in AA coordinates: 357-407)
MVTRETKLTSEREVESSMAQARHNGGGGGENHPFTSLGRQSSIYSLTLDEFQHALCENGKNFGSMNMDEFLVSIWNAEENNNNQQQAAAAAGSHSVPANHNGFNNNNNNGGEGGVGVFSGGSRGNEDANNKRGIANESSLPRQGSLTLPAPLCRKTVDEVWSEIHRGGGSGNGGDSNGRSSSSNGQNNAQNGGETAARQPTFGEMTLEDFLVKAGVVREHPTNPKPNPNPNQNQNPSSVIPAAAQQQLYGVFQGTGDPSFPGQAMGVGDPSGYAKRTGGGGYQQAPPVQAGVCYGGGVGFGAGGQQMGMVGPLSPVSSDGLGHGQVDNIGGQYGVDMGGLRGRKRVVDGPVEKVVERRQRRMIKNRESAARSRARKQAYTVELEAELNQLKEENAQLKHALAELERKRKQQYFESLKSRAQPKLPKSNGRLRTLMRNPSCPL

SEQ ID NO: 339 - DNA, 1740 bp, Arabidopsis thaliana
  G1818
taacaaatcaaataattagagaaataaccaaaatttaacttttagagggactacaggatttgtactttgtacattcatatattattgttatatatcgtttcatacattaatttgaaccaatgtaaattaagtaaaattcaatttaacatcatgagcaaattcttattaaaattctcttaaaattttgagcaaattatgctttcacatttaacatttgaaaacatcatttttaacaagatattcaaaactaagttttgtacagcaaaattttaactttcaattttatagagaaaaaggtatttttttttttgtttcatttttataagactattatttggtatataatatacactttaagtaaaaacaaatctctttcttttttcttcttataataccaaccacaagtctgtcagtcacacacatacagttaataacattaaatattcttaacaaactactaaataggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacttgaatttctttttgagttctgcttatgttttcaatgttatgttttttagttgttgaatgtatttctgttgttttgtccaaaaaaaaaaaagaatgtatttctgttgttgtctttcaaatgaatctaatggtttatgaatattggctttagattaatttatgcatacaaaaacacaaggattacggataaaaaagtcctcagtttacccatggaaacataatcttctagtgattccttatgagagtagaaaagaatcatatattataatctatttcataagagatagggtactgtaaacaaggatgtttattcggctatttcttttttttttaatcacttttacttgtcaagactcttttgtgtttgcagctttttgttagattacattctagaggcaacaagatccagagatctagcaaaaaaaacttattttgaaacctgaatctattttaaaaattttccaactcatttttcgttcttattctttgttttccaacggaatttggcgcacaaacgatttatttgaattttgtctttcaag

SEQ ID NO: 340 - protein, 186 aa, Arabidopsis thaliana
  G1818  (conserved domain in AA coordinates: 36-113)
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 341 - DNA, 609 bp, Arabidopsis thaliana
  G1820
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattga

SEQ ID NO: 342 - protein, 202 aa, Arabidopsis thaliana
  G1820  (conserved domain in AA coordinates: 70-133)
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 343 - DNA, 668 bp, Arabidopsis thaliana
  G1836
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 344 - protein, 187 aa, Arabidopsis thaliana
  G1836  (conserved domain in AA coordinates: 30-164)
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 345 - DNA, 1941 bp, Arabidopsis thaliana
  G1838
ttccttggcattctctttagaactttcgtacaaaatgcaaaacctgaacctctaaagctaaaaaaaaagattagagactgtaactgcttttatcagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagacttctattcaccgcactaaccgatgacccgaggcttatcttcttgattctggctataaggatgaatctttcaagttccttttttaactgtaggctaagacagaagtagaggggagaaaagttgaagaatctgaaacttttggggtcaattttgtattaatgtttttcttttgtcaagggtggattatcggttttattacttattttttgaatgtaatcggcctataacggtataactctgtttccatttatgaatatttttctcaaattgaaaaaaaaaaaaaaaaaa

SEQ ID NO: 346 - protein, 498 aa, Arabidopsis thaliana
  G1838  (conserved domain in AA coordinates:229-305, 330-400)
MAPPMTNCLTFSLSPMEMLKSTDQSHFSSSYDDSSTPYLIDNFYAFKEEAEIEAAAASMADSTTLSTFFDHSQTQIPKLEDFLGDSFVRYSDNQTETQDSSSLTPFYDPRHRTVAEGVTGFFSDHHQPDFKTINSGPEIFDDSTTSNIGGTHLSSHVVESSTTAKLGFNGDCTTTGGVLSLGVNNTSDQPLSCNNGERGGNSNKKKTVSKKETSDDSKKKIVETLGQRTSIYRGVTRHRWTGRYEAHLWDNSCRREGQARKGRQVYLGGYDKEDRAARAYDLAALKYWGSTATTNFPVSSYSKELEEMNHMTKQEFIASLRRKSSGFSRGASIYRGVTRHHQQGRWQARIGRVAGNKDLYLGTFATEEEAAEAYDIAAIKFRGINAVTNFEMNRYDIEAVMNSSLPVGGAAAKRHKLKLALESPSSSSSDHNLQQQQLLPSSSPSDQNPNSIPCGIPFEPSVLYYHQNFFQHYPLVSDSTIQAPMNQAEFFLWPNQSY

SEQ ID NO: 347 - DNA, 1009 bp, Arabidopsis thaliana
  G1841
cattccgaaaagtacttgtttattggtgttattcatcgctgctcaaggtggcaaaccaaggagaacaagaagagtccagggccaatgagcctgagggtatcaaatcagtgattgatgacatctacatttttgaagacgaccctgtggttgataggttcaataggtttggcacggagatgtctgccatggtctcggccttgacacaggtggtttctgctcgctctcagactgaggctgaaggtgctcactctcagactgaggctgaaggtgctcactcttcttcctcttcggctggacataaaagaggatggcttggaatcgattctgctcctattccctcatcatttgctcgtgtagactcttcacataatccgatcgaagaatccatgagcaaggcatttccagaggaagcaagggagaaaaaaaggaggtacagaggagtaaggcagagaccatggggcaaatgggcagctgagatacgtgatccacatagagccgctagggtttggctcgggacgtttgatacagcggaggccgcggctagagcctacgacgaggctgcactccggttccgtggaaataaagcaaagctaaatttcccagaggatgtaaggattcttcctcctccccctcctcttcttcgttcaccagctgacacggtggcgaataaagcagaagaggatctgataaattattggagttatacaaagttgttgcaaagttcaggccaacggtcatttctcgagcgaggacaagaagagagtagtaacatatttgaacattcaccaatggaacaacctctgcctccttcaagttctggtccaagttcctctaattttcctgcaccttctctacctaatacatagtttcacttttattaaagctctacaaatacaattaaatacatagctaaatgaaaatgattttcttgtctgtataccttcttaagtgctaaacaatatattgtactctttgttttccttaactaaaaaaaaaaaaaaaaaaaaaa

SEQ ID NO: 348 - protein, 229 aa, Arabidopsis thaliana
  G1841  (conserved domain in AA coordinates: 83-150)
MSAMVSALTQVVSARSQTEAEGAHSQTEAEGAHSSSSSAGHKRGWLGIDSAPIPSSFARVDSSHNPIEESMSKAFPEEAREKKRRYRGVRQRPWGKWAAEIRDPHRAARVWLGTFDTAEAAARAYDEAALRFRGNKAKLNFPEDVRILPPPPPLLRSPADTVANKAEEDLINYWSYTKLLQSSGQRSFLERGQEESSNIFEHSPMEQPLPPSSSGPSSSNFPAPSLPNT

SEQ ID NO: 349 - DNA, 1059 bp, Arabidopsis thaliana
  G1842
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 350 - protein, 196 aa, Arabidopsis thaliana
  G1842  (conserved domain in AA coordinates: 2-57)
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSKLEESNVDNVSVDSLISMEEQLETALSVIRAKKTELMMEDMKSLQEREKLLIEENQILASQVGKKTFLVIEGDRGMSRENGSGNKVPETLSLLK

SEQ ID NO: 351 - DNA, 818 bp, Arabidopsis thaliana
  G1843
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 352 - protein, 200 aa, Arabidopsis thaliana
  G1843  (conserved domain in AA coordinates: 2-57)
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 353 - DNA, 1927 bp, Arabidopsis thaliana
  G1852
catctgatctgctctcgaagacgaaagcttcgagtactggttgaagctaaagctatgggacacgtgaatctacctgcatcaaagcgtggtaaccctcgtcaatggcgtctcctcgacatcgtaaccgctgctttcttcggtatcgtacttctcttcttcatccttttattcactcctcttggtgattccatggcggcttctggtcggcaaacgctgcttctctctacggcgtcagatccgaggcaacggcagcgattagtgactttggttgaagctggtcagcatttgcaaccgatcgagtattgtcctgcggaagctgttgctcatatgccttgtgaggatccgagaaggaatagtcagcttagtagagagatgaatttctatagggagagacattgtcctttgcctgaggagactccgctctgtttgattcctccgccttctggttataaaattcctgttccgtggcctgagagtcttcacaagatttggcatgcaaacatgccatataacaaaattgctgaccggaaaggtcatcaaggatggatgaaaagggaaggggaatactttactttcccaggcggtggcacgatgtttcctggcggagctggccaatacattgaaaagcttgcacagtatattccgcttaatggtggaactttgagaactgctcttgacatgggatgcggggtagctagttttggaggtactctactatctcaaggcattctagccctctcatttgctccaagagattcacataaatctcaaattcagttcgctttggaaagaggagtgcctgcatttgttgccatgcttggcactcgtagactcccctttcctgcatactcctttgacctgatgcactgttcccgatgtttgattccttttacggcttacaatgcaacttacttcatcgaagtagataggttactgcgccctggaggatatcttgtaatctctggcccacctgtacaatggcctaaacaagacaaagaatgggctgatcttcaggcggtggctagagctttgtgctatgagctaattgcggttgatggaaacactgtcatctggaagaagcctgttggagattcatgtctacctagccagaatgagtttgggcttgagttgtgtgatgagtctgttccgccaagtgatgcatggtattttaaattgaagaggtgtgttaccaggccatcatccgtcaaaggagaacacgctttgggaactatatccaagtggccggagaggcttactaaagttccttctagggccattgtcatgaaaaacggattggatgtgtttgaagcagatgcaaggcggtgggcaagacgcgttgcttattacagggattctcttaacttgaagctgaaatctccaactgtccgcaatgtcatggacatgaacgcattcttcggaggctttgcagcaacccttgcatctgatcctgtgtgggttatgaatgtcattccagctcggaagccattaactcttgacgtgatttatgacagaggtctcatcggtgtttaccatgattggtgtgaaccattttcaacatatccccgcacgtatgatttcatccatgtatcaggaattgaatcactgataaaacgacaagactcaagcaaatcgaggtgtagcctagtagatctaatggtagagatggacagaatattacgtccagaaggaaaggttgtgatccgagactctcctgaggtgctagataaagtcgcacgaatggctcatgctgtaagatggtcttcttccatacacgagaaagaacctgaatcccatggaagagagaagattcttatcgcaaccaaatctctctggaaattgccatcaaactcccactgaagacacaaaagaagaagaaaagaagaagctcttctcaatcttgtaggtactgtcacttgctctccagccc

SEQ ID NO: 354 - protein, 600 aa, Arabidopsis thaliana
  G1852  (conserved domain in AA coordinates: 1-600)
MGHVNLPASKRGNPRQWRLLDIVTAAFFGIVLLFFILLFTPLGDSMAASGRQTLLLSTASDPRQRQRLVTLVEAGQHLQPIEYCPAEAVAHMPCEDPRRNSQLSREMNFYRERHCPLPEETPLCLIPPPSGYKIPVPWPESLHKIWHANMPYNKIADRKGHQGWMKREGEYFTFPGGGTMFPGGAGQYIEKLAQYIPLNGGTLRTALDMGCGVASFGGTLLSQGILALSFAPRDSHKSQIQFALERGVPAFVAMLGTRRLPFPAYSFDLMHCSRCLIPFTAYNATYFIEVDRLLRPGGYLVISGPPVQWPKQDKEWADLQAVARALCYELIAVDGNTVIWKKPVGDSCLPSQNEFGLELCDESVPPSDAWYFKLKRCVTRPSSVKGEHALGTISKWPERLTKVPSRAIVMKNGLDVFEADARRWARRVAYYRDSLNLKLKSPTVRNVMDMNAFFGGFAATLASDPVWVMNVIPARKPLTLDVIYDRGLIGVYHDWCEPFSTYPRTYDFIHVSGIESLIKRQDSSKSRCSLVDLMVEMDRILRPEGKVVIRDSPEVLDKVARMAHAVRWSSSIHEKEPESHGREKILIATKSLWKLPSNSH

SEQ ID NO: 355 - DNA, 1316 bp, Arabidopsis thaliana
  G1863
ccattatccttaaagtaaccaacacttctctctctctttcttcaatggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattgaccagtgtaaaaccaacacaacaatgcggtttttactgtgtttttggtttttatccaaatttcctgtataaagagg

SEQ ID NO: 356 - protein, 398 aa, Arabidopsis thaliana
  G1863  (conserved domain in AA coordinates: 77-186)
MDLQLKQWRSQQQQQHQTESEEQPSAAKIPKHVFDQIHSHTATSTALPLFTPEPTSSKLSSLSPDSSSRFPKMGSFFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVETPTTVNATATSMASSVAAAATTTTATTTSTFAFGGGGGSEEVVGQGGSFFFSGSSNSSSELLHLSQSCSEMKQESNNMNNKRPYESHIGFSNNRSDGGHILRPFFDDWPRSSLQEADNSSSPMSSATCLSISMPGNSSSDVSLKLSTGNEEGARSNNNGRDQQNMSWWSGGGSNHHHHNMGGPLAEALRSSSSSSPTSVLHQLGVSTQAFH

SEQ ID NO: 357 - DNA, 1320 bp, Arabidopsis thaliana
  G1880
atgttgtccaacaagaacacaaacacatgttgtgtggtttcttcttcttcttctgatcctttcctctcctcttcagaaaatggggtcaccaccacaaacacatccactcagaagaggaaaagaagacctgcaggtaccccagatccagatgcagaagttgtgtctttatcaccaagaactcttcttgaatcagacagatacatatgtgagatctgtaaccaagggtttcaaagagaccagaatctccagatgcatagaagacgtcacaaagttccatggaagcttcttaaaagagacaacaacatagaggtgaagaaacgagtctatgtttgccctgaacccacttgccttcaccataatccttgtcatgctctgggagatcttgtcggcatcaaaaaacatttcagaagaaaacatagtaaccataagcaatgggtttgtgagagatgctctaaaggttatgctgttcaatctgattacaaagctcatctcaaaacttgtggtactagaggacattcttgtgactgtggtcgtgtcttctccagggtggagagttttattgaacatcaagataattgttccgcacggagagttcaccgtgaaccgcctcgaccaccacaaaccgcggtaacagtcccggcatgctcttctagaaccgcctcaaccgtcagcactccgtctagtgaaaccaattacggcggtacagttgcggttacgactcctcaacctctagaaggccgtccaattcatcagagaatctcatcttcaattctcaccaactcatcaaacaatctcaacctcgaactccaacttcttccattatcgtcgaatcaaaaccctaatcaagaaaaccaacaacaaaaagttaaagaaccatctcatcatcataatcataatcatgataccacaaacttaaacctctccattgcaccatcatcatcatatcaacattacaacaactttgatcgtataaaagagattatggcgagcgagcaaattatgaagatagcgatgaaggagaaagcttacgctgaggaagctaaaagagaagccaagaggcaacgagagatagcggaaaacgagtttgcaaatgccaaaaagattaggcaaaaagcacaagctgaactcgagagagctaagtttttaaaggaacaatctatgaagaagataagttcaacgatcatgcaggtcacttgtcaaacatgtaaaggacagtttcaagcagttgcggttccggcggctacggctgatgagacgtctcttgtcgtgagttacatgtcgtcagcgaatactgacggagagttggaaaatggtttttaa

SEQ ID NO: 358 - protein, 439 aa, Arabidopsis thaliana
  G1880  (conserved domain in aa coordinates: 69-89, 111-139)
MLSNKNTNTCCVVSSSSSDPFLSSSENGVTTTNTSTQKRKRRPAGTPDPDAEVVSLSPRTLLESDRYICEICNQGFQRDQNLQMHRRRHKVPWKLLKRDNNIEVKKRVYVCPEPTCLHHNPCHALGDLVGIKKHFRRKHSNHKQWVCERCSKGYAVQSDYKAHLKTCGTRGHSCDCGRVFSRVESFIEHQDNCSARRVHREPPRPPQTAVTVPACSSRTASTVSTPSSETNYGGTVAVTTPQPLEGRPIHQRISSSILTNSSNNLNLELQLLPLSSNQNPNQENQQQKVKEPSHHHNHNHDTTNLNLSIAPSSSYQHYNNFDRIKEIMASEQIMKIAMKEKAYAEEAKREAKRQREIAENEFANAKKIRQKAQAELERAKFLKEQSMKKISSTIMQVTCQTCKGQFQAVAVPAATADETSLVVSYMSSANTDGELENGF

SEQ ID NO: 359 - DNA, 1503 bp, Arabidopsis thaliana
  G1895
cgtcgaccacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcatgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattctgtagtactagtgtc

SEQ ID NO: 360 - protein, 317 aa, Arabidopsis thaliana
  G1895  (conserved domain in AA coordinates: 58-100)
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSMLLESQSIKNETSMATNNHVWYPVPMTREKTQEFSFFSNGAETKSSNNRFVPETYLNLQANPAAMARSMNFRESI

SEQ ID NO: 361 - DNA, 615 bp, Arabidopsis thaliana
  G1902
atgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactga

SEQ ID NO: 362 - protein, 204 aa, Arabidopsis thaliana
  G1902  (conserved domain in AA coordinates:31-59)
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 363 - DNA, 1200 bp, Arabidopsis thaliana
  G1903
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 364 - protein, 399 aa, Arabidopsis thaliana
  G1903  (conserved domain in AA coordinates: 134-180)
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 365 - DNA, 1521 bp, Arabidopsis thaliana
  G1919
atggagtacgatggacggagaccctactctgttctaacgagaaatgaaattaccgtaaagatgaagaaacagatcaatgaaatctctgacatcttcttcatatcaaactccgatgcgaccgtacttcttatgtatctccgatgggactcgcttcgtgtttcagagcgtttaggtgaaaacaaggagaaattattgatggattcaggtttgaaatcagtcatgatcgatcccagtccagattcatctagcgagattagcttggagactgatgtttatgagtttgatggtgataatgatttaatctccatgcccttttgttctcacaagttcgactcaaaatattggagagagtatcttgagaagaatttctactatgtggagaaaatccaaaccacaatctcttgtcctgatcaagattgtcgatctgcggttggaccagacacgattgagaaactaacagtacgtgatcaagagatgtacgagaggtacatttggagatcttacattgaaggaaacaaggtattgatgatcaaacagtgtcctgcacggaattgcgattatgttattgagtttcatcaagagaatgatgatgatgatgagtatagtttaaacgtggtgtgtatctgtggtcatatcttctgttggagatgcagacttgagtcacacagaccagtgagttgtaacaaggcctctgattggttgtgtagtgccacaatgaaaatatcagatgaatcatttagcctttatccgaccaaaaccaagacagtgacttgccctcattgcctctgttctctggagtctgatacaaaaatgccccagttcttgacttgtgtctgcaggcttcgtttctgttcgaggtgtttgcggtcagaggaagcccacaaaattgaagcagtagactctggattctgtattaaaacagaagtggggattttatgtgaggatcgctggaacgtgtgtcagaagttactggagcaagccaaatccgatctagaagctttcgaggaaaccaacatcaagaaaccgagtgacttattaagggagcaagacattatgattataagagaagggttgatgttgattgttcaatgcagacgagtccttaaatggtgttgtgtgtatgactatttccacacagagtatgagaactcgaaggagtatctacgatacctccaaggaaatgcaatcgccacgctccagagttactcaaacactttacaagagcaaaaagatatcgtcctcgctgcagctacttatgaagagtgtactttcttcagacatacgatacctactgcgacaagcaacattggtaactacttttatgattttatgaaaactttacaagatggtttggtcgatgtaaaggtgaagtcatacaacggcgggactggtcctttctggtactgtgatcgctgcacgtatgcaaacacttgggaggataatgagtgtgagatgtgctatgatgatagtgcctctcttgtgggagagataagtgatttgtttcttaacaaagtttcttaa

SEQ ID NO: 366 - protein, 506 aa, Arabidopsis thaliana
  G1919  (conserved domain in AA coordinates:214-287)
MEYDGRRPYSVLTRNEITVKMKKQINEISDIFFISNSDATVLLMYLRWDSLRVSERLGENKEKLLMDSGLKSVMIDPSPDSSSEISLETDVYEFDGDNDLISMPFCSHKFDSKYWREYLEKNFYYVEKIQTTISCPDQDCRSAVGPDTIEKLTVRDQEMYERYIWRSYIEGNKVLMIKQCPARNCDYVIEFHQENDDDDEYSLNVVCICGHIFCWRCRLESHRPVSCNKASDWLCSATMKISDESFSLYPTKTKTVTCPHCLCSLESDTKMPQFLTCVCRLRFCSRCLRSEEAHKIEAVDSGFCIKTEVGILCEDRWNVCQKLLEQAKSDLEAFEETNIKKPSDLLREQDIMIIREGLMLIVQCRRVLKWCCVYDYFHTEYENSKEYLRYLQGNAIATLQSYSNTLQEQKDIVLAAATYEECTFFRHTIPTATSNIGNYFYDFMKTLQDGLVDVKVKSYNGGTGPFWYCDRCTYANTWEDNECEMCYDDSASLVGEISDLFLNKVS

SEQ ID NO: 367 - DNA, 1695 bp, Arabidopsis thaliana
  G1927
atggttgattcttctcgtgattcgtgtttcaaagctggtaagtttagtgctccaggttttcgatttcaccctactgatgaagagcttgtggtttattatcttaagaggaagatctgttgtaaaaaacttcgagtcaatgccattggtgtcgttgatgtttacaaagtcgatccttctgaattgcctggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtga

SEQ ID NO: 368 - protein, 564 aa, Arabidopsis thaliana
  G1927  (conserved domain in AA coordinates:17-188)
MVDSSRDSCFKAGKFSAPGFRFHPTDEELVVYYLKRKICCKKLRVNAIGVVDVYKVDPSELPGLSMLKTGDRQWFFFTPRNRKYPNAARSSRGTATGYWKATGKDRVIEYNSRSVGLKKTLVFYRGRAPNGERTDWVMHEYTMDEEELGRCKNAKEYYALYKLYKKSGAGPKNGEQYGAPFQEEEWVDSDSEDADSVAVPDYPVVRYENGPCVDDTKFCNPVKLQLEDIEKLLNEIPDAPGVNQRQFDEFVGVPQGNSAEVIQSTLLNNSSGEYIDPRTNGMFLPNGQLYNRDSSFQSHLNSFEATSGMAPLLDNEKEEYIEMNDLLIPELGASSTEKSTEFLNHGEFGDVNEYDQLFNDISVFQGTSTDLSCLSNFTNNTSGQRQQLLYEQFQYQTPENQLNNYMHPSTTLNQFTDNMWFKDDQAALYVQPPQSSSGAFTSQSTGVMPESMNPTMSVNPQYKEGQNGGGTRSQFSSALWELLESIPSTPASACEGPLNQTFVRMSSFSRIRFNGTSVTSRKVTVAKKRISNRGFLLLSIMGALCAIFWVFKATVGVMGRPLLS

SEQ ID NO: 369 - DNA, 1155 bp, Arabidopsis thaliana
  G1930
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 370 - protein, 333 aa, Arabidopsis thaliana
  G1930  (conserved domain in AA coordinates: 59-124)
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 371 - DNA, 955 bp, Arabidopsis thaliana
  G1936
tcgacccaccttgaatctgagagagagagagaagtacgtccccacaccttgacatggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttcataaagctcaaacctttaaatggcttttaattagatatatttagcgagaatgtgattgctagtgaaatctcaaacttgatagcttattcatagcttattttacttcgatcagcaagagaacaatggttcctaaagctcaaaccttttttggcgtttgctttagattgtgcatac

SEQ ID NO: 372 - protein, 243 aa, Arabidopsis thaliana
  G1936  (conserved domain in AA coordinates:64-129)
MVMEPKKNQNLPSFLNPSRQNQDNDKKRKQTEVKGFDIVVGEKRKKKENEEEDQEIQILYEKEKKKPNKDRHLKVEGRGRRVRLPPLCAARIYQLTKELGHKSDGETLEWLLQHAEPSILSATVNGIKPTESVVSQPPLTADLMICHSVEEASRTQMEANGLWRNETGQTIGGFDLNYGIGFDFNGVPEIGFGDNQTPGLELRLSQVGVLNPQVFQQMGKEQFRVLHHHSHEDQQQSAEENGS

SEQ ID NO: 373 - DNA, 1445 bp, Arabidopsis thaliana
  G1944
tcgaccttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 374 - protein, 356 aa, Arabidopsis thaliana
  G1944  (conserved domain in AA coordinates:87-100)
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 375 - DNA, 1605 bp, Arabidopsis thaliana
  G1946
tctcacctattgtaaaaatcaccagtttcgtatataaaaccctaattttctcaaaattcccaaatattgacttggaatcaaaaatccgaatggatgtgagcaaagtaaccacaagcgacggcggaggagattcaatggagactaagccatctcctcaacctcagcctgcggcgattctaagttcaaacgcgcctcctccgtttctgagcaagacctatgatatggttgatgatcacaatacagattcgattgtctcttggagtgctaataacaacagttttatcgtttggaaaccaccggagttcgctcgcgatcttcttcctaagaactttaagcataataatttctccagcttcgttagacagcttaatacctatggtttcaggaaggttgacccagatagatgggaatttgcgaatgaaggttttttaagaggtcagaagcacttgctacaatcaataactaggcgaaaacctgcccatggacagggacagggacatcagcgatctcagcactcgaatggacagaactcatctgttagcgcatgtgttgaagttggcaaatttggtctcgaagaagaagttgaaaggcttaaaagagataagaacgtccttatgcaagaactcgtcagattaagacagcagcaacagtccactgataaccaacttcaaacgatggttcagcgtctccagggcatggagaatcggcaacaacaattaatgtcattccttgcaaaggcagtacaaagccctcattttctatctcaattcttacagcagcagaatcagcaaaacgagagtaataggcgcatcagtgataccagtaagaagcggagattcaagcgagacggcattgtccgtaataatgattctgctactcctgatggacagatagtgaagtatcaacctccaatgcacgagcaagccaaagcaatgtttaaacagcttatgaagatggaaccttacaaaaccggcgatgatggtttccttctaggtaatggtacgtctactaccgagggaacagagatggagacttcatcaaaccaagtatcgggtataactcttaaggaaatgcctacagcttctgagatacagtcatcatcaccaattgaaacaactcctgaaaatgtttcggcagcatcagaagcaaccgagaactgtattccttcacctgatgatctaactcttcccgacttcactcatatgctaccggaaaataattcagagaagcctccagagagtttcatggaaccaaacctgggaggttctagtccattactagatccagatctgttgatcgatgattctttgtccttcgacattgacgactttccaatggattctgatatagaccctgttgattacggtttactcgaacgcttactcatgtcaagcccggttccagataatatggattcaacaccagtggacaatgaaacagagcaggaacaaaatggatgggacaaaactaagcatatggataatctgactcaacagatgggtctcctctctcctgaaaccttagatctctcaaggcaaaatccttgattttgggagtttttaaagtcttttgaggtaacacagtccctgagagcagcatattcat

SEQ ID NO: 376 - protein, 485 aa, Arabidopsis thaliana
  G1946  (conserved domain in AA coordinates: 32-130)
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSRQNP

SEQ ID NO: 377 - DNA, 1076 bp, Arabidopsis thaliana
  G1947
acaactattctctcctctctctttttttattaaaaaagctcaaatttatataggttttttgttcacaaaatggattataaccttccaattccattagagggtctcaaagaaacgccaccaacggctttcttgacgaaaacatacaacatagtggaggattcaagcacaaacaacatagtttcatggagcagagacaacaacagcttcattgtttgggaaccagagacttttgccctaatttgcctccctagatgctttaagcacaataatttctccagctttgttagacagctcaatacttatgggtttaagaagattgatacagagagatgggaatttgcaaatgagcattttctgaagggagagaggcatcttcttaagaacatcaagagaagaaagacatcatctcaaacgcaaacgcagtcgctagaaggagagatccatgagctgcgaagagacagaatggctttagaagtagaactggttagactgcgacgaaaacaagaaagcgtgaagacatatctgcatttgatggaagagaaactgaaagtcacagaagtaaagcaagaaatgatgatgaatttcttgctaaagaagattaagaaaccgagttttttacagagcttaaggaaacgtaatctgcaaggaatcaagaatcgagagcaaaagcaagaggtgatctcaagccatggtgttgaggataatggaaagtttgttaaagctgagccagaagagtatggtgatgacatcgatgatcaatgtggaggtgtgtttgattatggtgatgagcttcacatagcttcaatggagcatcaaggacaaggggaggatgaaattgaaatggatagtgaaggaatttggaagggtttcgtgttgagtgaggaggagatgtgtgatttagtggaacattttatataataaactaatgtattatgagaggtttttttttgtttttttgctttttttttccgagtttgtcatcaagcattgtatacaatttgggccaaactaaaagcccaacaaaatatttggccttggcatttgttaacaaattgactaattcggccacaccttcc

SEQ ID NO: 378 - protein, 282 aa, Arabidopsis thaliana
  G1947  (conserved domain in AA coordinates: 37-120)
MDYNLPIPLEGLKETPPTAFLTKTYNIVEDSSTNNIVSWSRDNNSFIVWEPETFALICLPRCFKHNNFSSFVRQLNTYGFKKIDTERWEFANEHFLKGERHLLKNIKRRKTSSQTQTQSLEGEIHELRRDRMALEVELVRLRRKQESVKTYLHLMEEKLKVTEVKQEMMMNFLLKKIKKPSFLQSLRKRNLQGIKNREQKQEVISSHGVEDNGKFVKAEPEEYGDDIDDQCGGVFDYGDELHIASMEHQGQGEDEIEMDSEGIWKGFVLSEEEMCDLVEHFI

SEQ ID NO: 379 - DNA, 1320 bp, Arabidopsis thaliana
  G1948
aaaaggtcttcttggccatggatacttgtgctctagtaatccatcagtctctgtctcgcatcaaactttctcctcccaaatcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaaacggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatgattgattttgatgattacattcttctcaatttgcttctttctcatatgtgttggttcatctgaccggttcggttggtacgtaccggtacattttcattttcttttaagatgtgatcttgatggtttttggccttttggggacactatttgattttatatccatgctttgaattttgcttccctttttggggagattcatgaaa

SEQ ID NO: 380 - protein, 366 aa, Arabidopsis thaliana
  G1948  (conserved domain in AA coordinates: 1-367)
MDTCALVIHQSLSRIKLSPPKSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 381 - DNA, 883 bp, Arabidopsis thaliana
  G1950
ctgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgt

SEQ ID NO: 382 - protein, 240 aa, Arabidopsis thaliana
  G1950  (conserved domain in AA coordinates: 65-228)
MEIATDTAKQMRDEELFKAAEWGDSSLFMSLSEEQLSKSLNFRNEDGRSLLHVAASFGHSQIVKLLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRPALIDAAKAMLEG

SEQ ID NO: 383 - DNA, 1444 bp, Arabidopsis thaliana
  G1958
gtaccgtcgaccgattatccccaagaggagaatcctcataatcattttctccgattcgattcgtcttccttggtcctggattgcttcatgaatttctaggacaacaatggaggctcgtccagttcatagatcaggttcgagagacctcacacgcacttcttcaatcccatctacacaaaaaccttcaccagtagaagatagtttcatgagatcagataacaacagtcagttaatgtctagaccattaggacaaacctaccatttactttcatctagtaacggtggagctgttggacatatatgttcttcttcatcatctggttttgcaaccaatctccattactcaactatggtatctcatgagaaacaacaacactacacaggaagcagcagtaataatgctgtgcagacaccaagcaacaacgatagtgcttggtgtcatgattcattgccaggagggtttcttgacttccatgaaaccaacccggcgattcaaaacaactgtcagattgaggatggtggcattgcggctgcttttgatgacattcaaaaacgaagtgattggcatgaatgggctgaccatttgatcactgatgatgatcctttgatgtctactaactggaatgatctcttgcttgaaacaaattccaattcagattcaaaggaccagaagacactgcaaattccgcaacctcagattgttcagcagcaaccttctccgtctgtggaattgcgacctgttagcacaacatcttcaaacagcaataacggaacgggcaaggcacgaatgcgttggacgccagagcttcacgaggcttttgttgaggctgtcaacagtcttggcggtagtgaaagagctactcctaaaggggtactgaagattatgaaagttgaaggcttgactatatatcatgttaaaagccatttacagaaatataggacagctagatatcggccagaaccatcagaaactggttcgccagaaaggaagttgacaccgcttgaacatataacatctcttgatttgaaaggtgggataggtattacagaggctctacgacttcagatggaagtacagaagcaactccatgagcagctcgagattcaaagaaacctgcaactccgaatagaagaacaaggcaagtacctgcaaatgatgttcgagaagcaaaactctggtcttaccaaagggacagcctcaacatcagattccgcagccaaatctgaacaagaagacaagaagactgctgattcgaaggaggttccagaagaagaaaccaggaaatgtgaggaactagaatctccacagccaaagcgtcccaaaatcgataattgaaagtattggtcttttgctggataatctcggagtttcagagttaacagtgatagagagaacgagctcttatcttgaggttcttcaggacttctctcgcggccgctctag

SEQ ID NO: 384 - protein, 409 aa, Arabidopsis thaliana
  G1958  (conserved domain in AA coordinates: 230-278)
MEARPVHRSGSRDLTRTSSIPSTQKPSPVEDSFMRSDNNSQLMSRPLGQTYHLLSSSNGGAVGHICSSSSSGFATNLHYSTMVSHEKQQHYTGSSSNNAVQTPSNNDSAWCHDSLPGGFLDFHETNPAIQNNCQIEDGGIAAAFDDIQKRSDWHEWADHLITDDDPLMSTNWNDLLLETNSNSDSKDQKTLQIPQPQIVQQQPSPSVELRPVSTTSSNSNNGTGKARMRWTPELHEAFVEAVNSLGGSERATPKGVLKIMKVEGLTIYHVKSHLQKYRTARYRPEPSETGSPERKLTPLEHITSLDLKGGIGITEALRLQMEVQKQLHEQLEIQRNLQLRIEEQGKYLQMMFEKQNSGLTKGTASTSDSAAKSEQEDKKTADSKEVPEEETRKCEELESPQPKRPKIDN

SEQ ID NO: 385 - DNA, 861 bp, Arabidopsis thaliana
  G2007
atgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactag

SEQ ID NO: 386 - protein, 286 aa, Arabidopsis thaliana
  G2007  (conserved domain in AA coordinates: 14-116)
MGRQPCCDKLMVKKGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLKMEIDPSTHQPLNKVFTDTNLVDKSETSSKADNVNDNKIVEIDGTTTNTIDDSIITHQNSSNDDYELLGDIIHNYGDLFNILWTNDEPPLVDDASWSNHNVGIGGTAAVAASDKNNTAAEEDFPERSFEKQNGESWMFLDYCQEFGVEDFGFECYHGFGQSSMKTGHKD

SEQ ID NO: 387 - DNA, 525 bp, Arabidopsis thaliana
  G2010
atggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatag

SEQ ID NO: 388 - protein, 174 aa, Arabidopsis thaliana
  G2010  (conserved domain in AA coordinates: 53-127)
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 389 - DNA, 1029 bp, Arabidopsis thaliana
  G2053
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataa

SEQ ID NO: 390 - protein, 342 aa, Arabidopsis thaliana
  G2053  (conserved domain in AA coordinates:10-149)
MENPVGLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 391 - DNA, 1270 bp, Arabidopsis thaliana
  G2059
ttaagaacaggcttcattctctggacaaacactcaaaaaacaaacaaaaaaaggaacatggaagatcagtttcctaaaatagaaactagcttcatgcacgacaagctcttgtcttctggaatctacgggttcttgagttcttcgacgccgccacaacttctcggtgttccaatatttttggaaggtatgaaatctcctcttcttcctgcttcttcgactccgagctactttgtgtcgcctcatgatcatgagctcacatcttctattcatccatctccggtagcttctgttccttggaactttctagaatcttttcctcagtctcaacatcctgatcatcatccttctaaacctccaaaccttactttgttccttaaagaaccaaagctactagaactttctcaatccgaaagcaacatgagcccttaccataaatacatcccaaactccttttatcaatcagaccaaaacagaaacgaatgggtagagatcaataaaactctaaccaactatccctcgaaaggttttggaaactattggctaagtaccaccaagactcaacccatgaagtcaaaaacaagaaaggttgttcagacgacgaccccaacaaaactgtatagaggagtgagacaaagacactggggcaaatgggtcgcagagattaggcttccaaggaacagaacccgtgtttggctcggcacttttgaaaccgctgagcaagcagcaatggcttacgatacagcagcttatatccttcgtggcgaattcgcacacctcaactttcctgatcttaaacaccagctcaagtccggttctttgcgatgcatgatcgcctcacttttggagtccaagattcaacagatctcatcttcccaagtaagtaactctccttctcctcctcctccaaaagtgggaacaccggagcaaaagaatcatcacatgaagatggagtcaggagaagacgtgatgatgaagaaacagaaaagccataaggaagtgatggaaggagatggtgtacaattgagtaggatgccttctttggatatggatctcatttgggatgctctctcatttcctcattcttcttgacttcaaattaatatttgtcaaacttattttacttacttctacccttttttatatcaaaagtttccaccaaagaaagaaattcatattatgatgccaagattggtttgcatttggggttgaacacattgtaattcttcttacgaccacataatcaagtggttctcctttttttgtctgctaa

SEQ ID NO: 392 - protein, 343 aa, Arabidopsis thaliana
  G2059  (conserved domain in AA coordinates:184-254)
MEDQFPKIETSFMHDKLLSSGIYGFLSSSTPPQLLGVPIFLEGMKSPLLPASSTPSYFVSPHDHELTSSIHPSPVASVPWNFLESFPQSQHPDHHPSKPPNLTLFLKEPKLLELSQSESNMSPYHKYIPNSFYQSDQNRNEWVEINKTLTNYPSKGFGNYWLSTTKTQPMKSKTRKVVQTTTPTKLYRGVRQRHWGKWVAEIRLPRNRTRVWLGTFETAEQAAMAYDTAAYILRGEFAHLNFPDLKHQLKSGSLRCMIASLLESKIQQISSSQVSNSPSPPPPKVGTPEQKNHHMKMESGEDVMMKKQKSHKEVMEGDGVQLSRMPSLDMDLIWDALSFPHSS

SEQ ID NO: 393 - DNA, 1688 bp, Arabidopsis thaliana
  G2085
aagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatcctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctttaaaggaaccaattcagtcgacgttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatctcaggcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctcggg

SEQ ID NO: 394 - protein, 309 aa, Arabidopsis thaliana
  G2085  (conserved domain in aa coordinates: 214-241)
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 395 - DNA, 1536 bp, Arabidopsis thaliana
  G2105
ctctctgacttgaactcttctcttctaccgaatcaaaccaaatggaggatcatcaaaaccatccacagtacggtatagaacaaccatcttctcaattctcctctgatctcttcggcttcaacctcgtttcagcgccggaccagcaccatcgtcttcatttcaccgaccatgagataagtttattgccacgtggaatacaagggcttacggtggctggaaacaacagtaacactattacaacgatccagagtggtggctgtgttggtgggtttagtggctttacggacggcggaggaacagggaggtggccgaggcaagagacgttgatgttgttggaggtcagatctcgtcttgatcacaagttcaaagaagctaatcaaaagggtcctctctgggatgaagtttctaggattatgtcggaggaacatggatacactaggagtggcaagaagtgtagagagaagttcgagaatctctacaagtactataaaaaaacaaaagaaggcaaatccggtcggcgacaagatggtaaaaactatagatttttccggcagcttgaagcgatatacggcgaatccaaagactcggtttcttgctataacaacacgcagttcataatgaccaatgctcttcatagtaatttccgcgcttctaacattcataacatcgtccctcatcatcagaatcccttgatgaccaataccaatactcaaagtcaaagccttagcatttctaacaatttcaactcctcctccgatttggatctaacttcttcctctgaaggaaacgaaactactaaaagagaggggatgcattggaaggaaaagatcaaggaattcattggtgttcatatggagaggttgatagagaagcaagatttttggcttgagaagttgatgaagattgtggaagacaaagaacatcaaaggatgctgagagaagaggaatggagaaggattgaagcggaaaggatcgataaggaacgttcgttttggacaaaagagagggagaggattgaagctcgggatgttgcggtgattaatgccttgcagtacttgacgggaagggcattgataaggccggattcttcgtctcctacagagaggattaatgggaatggaagcgataaaatgatggctgataatgaatttgctgatgaaggaaataagggcaagatggataaaaaacaaatgaataagaaaaggaaggagaaatggtcaagccacggagggaatcatccaagaaccaaagagaatatgatgatatacaacaatcaagaaactaagattaatgatttttgtcgagatgatgaccaatgccatcatgaaggttactcaccttcaaactccaagaacgcaggaactccgagctgcagcaatgccatggcagctagtacaaagtgctttccattgcttgaaggagaaggagatcagaacttgtgggagggttatggtttgaagcaaaggaaagaaaataatcatcagtaagctacatttttcattctcaaaatgaagaataagagaacttagaaacgat

SEQ ID NO: 396 - protein, 481 aa, Arabidopsis thaliana
  G2105  (conserved domain in AA coordinates: 100-153)
MEDHQNHPQYGIEQPSSQFSSDLFGFNLVSAPDQHHRLHFTDHEISLLPRGIQGLTVAGNNSNTITTIQSGGCVGGFSGFTDGGGTGRWPRQETLMLLEVRSRLDHKFKEANQKGPLWDEVSRIMSEEHGYTRSGKKCREKFENLYKYYKKTKEGKSGRRQDGKNYRFFRQLEAIYGESKDSVSCYNNTQFIMTNALHSNFRASNIHNIVPHHQNPLMTNTNTQSQSLSISNNFNSSSDLDLTSSSEGNETTKREGMHWKEKIKEFIGVHMERLIEKQDFWLEKLMKIVEDKEHQRMLREEEWRRIEAERIDKERSFWTKERERIEARDVAVINALQYLTGRALIRPDSSSPTERINGNGSDKMMADNEFADEGNKGKMDKKQMNKKRKEKWSSHGGNHPRTKENMMIYNNQETKINDFCRDDDQCHHEGYSPSNSKNAGTPSCSNAMAASTKCFPLLEGEGDQNLWEGYGLKQRKENNHQ

SEQ ID NO: 397 - DNA, 1828 bp, Arabidopsis thaliana
  G2110
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacgatgaacgacggatgtcaatggaggaaatatggccagaaaatagctaaaggcaatccatgtccccgagcttactatcgttgcaccattgcagcttcttgtccagtaagaaaacaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttatatactcagtacattggtaaatgggtttagactttcactagtttcctagttcatctatatattggttgtttaatcacaagtttattttgttgttggagtttatggaactaatgtgtacatatgaaactttagaacgaataaataaaacttggaattcctttttaaaaaaaaaaaaaaaaa

SEQ ID NO: 398 - protein, 528 aa, Arabidopsis thaliana
  G2110  (conserved domain in AA coordinates:239-298)
MEKDDFLRSGHGREESHDEMRKLDSSHDDSHQEHDHIIRSKLDSTKVEMDEAKEENRRLKSSLSKIKKDFDILQTQYNQLMAKHNEPTKFQSKGHHQDKGEDEDREKVNEREELVSLSLGRRLNSEVPSGSNKEEKNKDVEEAEGDRNYDDNEKSSIQGLSMGIEYKALSNPNEKLEIDHNQETMSLEISNNNKIRSQNSFGFKNDGDDHEDEDEILPQNLVKKTRVSVRSRCETPTMNDGCQWRKYGQKIAKGNPCPRAYYRCTIAASCPVRKQVQRCSEDMSILISTYEGTHNHPLPMSATAMASATSAAASMLLSGASSSSSAAADLHGLNFSLSGNNITPKPKTHFLQSPSSSGHPTVTLDLTTSSSSQQPFLSMLNRFSSPPSNVSRSNSYPSTNLNFSNNTNTLMNWGGGGNPSDQYRAAYGNINTHQQSPYHKIIQTRTAGSSFDPFGRSSSSHSPQINLDHIGIKNIISHQVPSLPAETIKAITTDPSFQSALATALSSIMGGDLKIDHNVTRNEAEKSP

SEQ ID NO: 399 - DNA, 1500 bp, Arabidopsis thaliana
  G2114
ataaaacgaaaccctatacatataaactaagagcgagaaagacagctagagagagagagagagatgaagaaatggttgggattttcattgacacctcctttgagaatctgcaatagtgaagaagaagaacttaggcatgacggttccgatgtttggagatatgatattaactttgatcatcatcatcatgatgaagacgttccaaaggtggaagatctcctctcaaactctcatcaaaccgagtatcctataaaccataaccaaaccaatgtcaactgcaccactgtggttaacaggttaaacccacccggttaccttctccacgaccaaaccgtagttacaccacattacccgaacctagatccgaaccttagcaatgattatggaggttttgagagggtcggttcggtctcggttttcaaatcttggttagagcaaggcactccagcattcccactctcgagtcattacgttactgaagaggctggtacgagcaataatattagtcattttagtaacgaagagactggttataacaccaatggctcaatgctatcattggctttgagccatggggcttgttctgatttgatcaacgaatcgaatgtatccgcacgggtcgaagaaccggttaaggtagatgagaagcggaagagattggttgttaaacctcaggtaaaggaatccgttcctcggaagtcggttgatagttatggacaaagaacttctcagtatcgtggagttacaaggcatagatggacagggagatatgaagctcacttatgggataatagctgtaagaaggagggacagacaaggagaggaagacaagtgtatcttggagggtatgatgaggaggagaaagcagcgagggcatatgatttagcggctctgaagtattggggtcctaccactcacttaaatttccctttgagtaattacgaaaaggagatcgaggaactcaataacatgaatcggcaagaatttgttgccatgttgaggaggaatagcagcgggttttcgaggggagcttccgtgtatagaggagttacaaggcatcatcaacatggaaggtggcaagccagaattggaagagttgctggaaacaaggacttgtaccttggaacatttagcacgcaagaagaagcagcggaggcgtacgatatcgcggcaattaaattcagaggcctaaacgctgtaaccaatttcgatataaatagatatgacgtgaagaggatatgttcaagctcaacgattgttgatagcgaccaggccaaacattctcccaccagctctggcgccggccactaaccgacaccgtaaactcctcgccggagagactattcccacgtacggttggtttgaggaaataagttcgtccagtctgtttaatcatttatggtttaataaacatatattcctaagtaattgaggccggtctacatatatacaacttttttagcaaattaagttatcagaatccactatatattattctct

SEQ ID NO: 400 - protein, 415 aa, Arabidopsis thaliana
  G2114  (conserved domain in AA coordinates:221-297, 323-393)
MKKWLGFSLTPPLRICNSEEEELRHDGSDVWRYDINFDHHHHDEDVPKVEDLLSNSHQTEYPINHNQTNVNCTTVVNRLNPPGYLLHDQTVVTPHYPNLDPNLSNDYGGFERVGSVSVFKSWLEQGTPAFPLSSHYVTEEAGTSNNISHFSNEETGYNTNGSMLSLALSHGACSDLINESNVSARVEEPVKVDEKRKRLVVKPQVKESVPRKSVDSYGQRTSQYRGVTRHRWTGRYEAHLWDNSCKKEGQTRRGRQVYLGGYDEEEKAARAYDLAALKYWGPTTHLNFPLSNYEKEIEELNNMNRQEFVAMLRRNSSGFSRGASVYRGVTRHHQHGRWQARIGRVAGNKDLYLGTFSTQEEAAEAYDIAAIKFRGLNAVTNFDINRYDVKRICSSSTIVDSDQAKHSPTSSGAGH

SEQ ID NO: 401 - DNA, 506 bp, Arabidopsis thaliana
  G2117
atacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaag

SEQ ID NO: 402 - protein, 138 aa, Arabidopsis thaliana
  G2117  (conserved domain in AA coordinates:46-106)
MAGSVYNLPSQNPNPQSLFQIFVDRVPLSNLPATSDDSSRTAEDNERKRRRKVSNRESARRSRMRKQRHMEELWSMLVQLINKNKSLVDELSQARECYEKVIEENMKLREENSKSRKMIGEIGLNRFLSVEADQIWTF

SEQ ID NO: 403 - DNA, 657 bp, Arabidopsis thaliana
  G2123
atgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgaaaggagattattttcgatatatggcagagtttggttctgatgctgaacgtaaagaaaatgcagataattctctagatgcatataaggttgcaatggaaatggcagagaatagtttagcacccaccaatatggttagacttggattggctttaaatttctcgatattcaattatgagatccataaatctattgaaagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttag

SEQ ID NO: 404 - protein, 218 aa, Arabidopsis thaliana
  G2123  (conserved domain in AA coordinates:99-109)
MRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 405 - DNA, 1019 bp, Arabidopsis thaliana
  G2130
cctctcttcattttttaactccctctctctctctctctctatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacgaggaaacagagcatgagattgaagcgatcgagctatctccggagagaaagtcgacggttataaaagaagaagaagaatcgtcggcgggtttggtgttcccggatccgtatctgttaccggatttatctctcgccggcgaatgtttttgggataccgaaattgcccctgaccttttgtttctcgatgaagaaaccaaaatccaatcaacgttgttaccaaacacagaggtttcgaaacaaggagaaaacgaaactgaagatttcgagtttggtttgattgatgatttcgagtcttctccatgggatgtggatcatttcttcgaccatcatcatcactctttcgattaaaaatctcttcttttttggggaaatttttgtg

SEQ ID NO: 406 - protein, 315 aa, Arabidopsis thaliana
  G2130  (conserved domain in AA coordinates: 93-160)
MERRTRRVKFTENRTVTNVAATPSNGSPRLVRITVTDPFATDSSSDDDDNNNVTVVPRVKRYVKEIRFCQGESSSSTAARKGKHKEEESVVVEDDVSTSVKPKKYRGVRQRPWGKFAAEIRDPSSRTRIWLGTFVTAEEAAIAYDRAAIHLKGPKALTNFLTPPTPTPVIDLQTVSACDYGRDSRQSLHSPTSVLRFNVNEETEHEIEAIELSPERKSTVIKEEEESSAGLVFPDPYLLPDLSLAGECFWDTEIAPDLLFLDEETKIQSTLLPNTEVSKQGENETEDFEFGLIDDFESSPWDVDHFFDHHHHSFD

SEQ ID NO: 407 - DNA, 485 bp, Arabidopsis thaliana
  G2133
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 408 - protein, 143 aa, Arabidopsis thaliana
  G2133  (conserved domain in AA coordinates:11-83)
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 409 - DNA, 539 bp, Arabidopsis thaliana
  G2138
ggaaccctaatttccgcaaattcactatgaagcgtattatcagaatctcattcaccgacgcagaagccaccgattcttctagcgacgaagacacggaggagcgtggaggagcatcccagactcggcgccgtgggaaacgcctcgttaaagagatcgtaatcgatccttccgattccgccgataaactcgatgtctgcaaaacacggttcaaaatcaggatcccggcggaatttctcaagacggcgaaaacggagaagaaatatcgtggagtgaggcagaggccgtgggggaagtgggtggcggagatcagatgtggaagaggagcttgtaaaggacgacgtgatcgtctctggctgggtacttttaacactgctgaggaagctgctctagcttatgataacgcttcaattaagctgattggacctcacgcgccgaccaattttggtttgccggcggagaatcaagaggataagacggtgattggagcttctgaggttgctagaggcgcgtgaagtggggttggtaatttagttgttagc

SEQ ID NO: 410 - protein, 161 aa, Arabidopsis thaliana
  G2138  (conserved domain in AA coordinates: 76-148)
MKRIIRISFTDAEATDSSSDEDTEERGGASQTRRRGKRLVKEIVIDPSDSADKLDVCKTRFKIRIPAEFLKTAKTEKKYRGVRQRPWGKWVAEIRCGRGACKGRRDRLWLGTFNTAEEAALAYDNASIKLIGPHAPTNFGLPAENQEDKTVIGASEVARGA

SEQ ID NO: 411 - DNA, 1514 bp, Arabidopsis thaliana
  G2140
actctcttaactttcgtttcttctcctaccttcttttaccaacctttcctttctcttacacacatatatatatacatatatagagagagagaagaggacaaagagttgaaagatgaagactctcatgtcttcatagaaacaagtgatatgtgcgctaagaaagaagaagaagaagaagaagaagaagacagttctgaagccatgaacaacatacaaaattaccaaaatgacctcttctttcaccaactcatctctcatcatcaccatcatcatcatgatccttctcaatctgaaactttgggagcatccggtaacgttggatctggtttcactatcttctctcaagattccgtctctccaatatggtctctacctccacctacctcgatccaaccaccatttgatcagtttcctcctccttcttcttctccagcatctttctacggaagtttcttcaacagaagtcgagctcatcatcagggattacagtttgggtacgagggttttggtggagccacgtcagcagcacatcatcatcatgaacaacttcggatcttgtcggaagctttaggtccggtagtacaagccgggtccggtccttttgggttacaagctgagttagggaagatgacagcacaagagatcatggacgctaaagctttggctgcttcaaagagtcatagtgaagctgagagaagaagaagagagagaatcaataatcatctcgctaagctccgtagcatattacccaacaccaccaaaacggataaagcgtcgttactagctgaagtgatccaacatgtgaaagagttgaagagagagacttcagtgatctcagagacaaatcttgtcccaacggaaagcgatgagttaacggtagctttcacggaggaggaagaaaccggagatggcagatttgtaattaaagcgtcgctttgctgtgaagacaggtcggatctcttgcctgacatgattaaaacattgaaagctatgcgtctcaaaacgctcaaggcggagataaccaccgttgggggacgagtcaagaacgttttgtttgttaccggagaagagagctccggtgaggaagtggaggaagagtactgtatagggacgattgaggaagctttgaaagcggtgatggagaagagcaatgtagaggaatcatcttcttctggaaatgctaagagacagagaatgagtagtcacaacactatcactatcgtcgaacaacaacaacaatataatcagaggtaatcaattttttacttaaatcgcttttttttcttactttcggtgtatctactacgtgtgttgtttgctggttatggaaatgaatgttgtacgtcacgttatactatagatatatgtgtgtttgtgtgtatgtataacggaagtatttgtatccgttgtggtcttggacttttggtttggttctaagatacttatttttaaaaacttgtatcgttgagttggttttctagatatgcttaatgggagtatgtgacgaaaaaaaa

SEQ ID NO: 412 - protein, 368 aa, Arabidopsis thaliana
  G2140  (conserved domain in AA coordinates:167-242)
MCAKKEEEEEEEEDSSEAMNNIQNYQNDLFFHQLISHHHHHHHDPSQSETLGASGNVGSGFTIFSQDSVSPIWSLPPPTSIQPPFDQFPPPSSSPASFYGSFFNRSRAHHQGLQFGYEGFGGATSAAHHHHEQLRILSEALGPVVQAGSGPFGLQAELGKMTAQEIMDAKALAASKSHSEAERRRRERINNHLAKLRSILPNTTKTDKASLLAEVIQHVKELKRETSVISETNLVPTESDELTVAFTEEEETGDGRFVIKASLCCEDRSDLLPDMIKTLKAMRLKTLKAEITTVGGRVKNVLFVTGEESSGEEVEEEYCIGTIEEALKAVMEKSNVEESSSSGNAKRQRMSSHNTITIVEQQQQYNQR

SEQ ID NO: 413 - DNA, 1024 bp, Arabidopsis thaliana
  G2143
tcttcttcttcctccataccttatctcaccagcttctccatatctctcaaagaaaaaacaaaccctataaattccacaaaaaaggaggatggataactccgacattctaatgaacatgatgatgcagcagatggagaagcttcctgaacacttctctaactcaaaccctaaccctaatccccataacattatgatgctttctgaatccaacacccacccgttcttcttcaaccccactcattctcatctcccatttgaccaaaccatgcctcaccaccaacccggtttaaatttccggtacgccccctccccgtcatcatctctcccggagaagagaggaggctgcagcgacaacgccaacatggcggcgatgagagagatgatctttcgaatagccgtgatgcagcctatacatattgatccggaatccgtaaagccaccaaagagaaagaacgtgaggatctctaaggatccacagagcgtggcagctcggcatcgaagggagaggataagcgagcggattcggattcttcagcggcttgttcccggtgggactaagatggatacggcgtcgatgctcgatgaggctatccattacgttaagtttctcaagaagcaagtgcagtcgctggaggaacatgcggtggttaacggcggaggaatgacggcggtggccggaggagcacttgcgggtactgttggtggaggatatggaggaaaagggtgtggcattatgcggtctgatcatcaccagatgcttggaaatgcacagattcttagatgatgatgatgttgatttttaaatatatatcatatgtttattaatatgacgggaaaaaatattatcgagggagttgaatttagtatcatgaaactatgagagcattttttttaaatgtttttatctttccgggtttcgataatgtttgggatggttaattaacaatttaaaagtcagacaacttggttgtaaagactaaagaataagcatagtttatcaatttatcattactaaatgaaatag

SEQ ID NO: 414 - protein, 231 aa, Arabidopsis thaliana
  G2143  (conserved domain in aa coordinates: 128-179)
MDNSDILMNMMMQQMEKLPEHFSNSNPNPNPHNIMMLSESNTHPFFFNPTHSHLPFDQTMPHHQPGLNFRYAPSPSSSLPEKRGGCSDNANMAAMREMIFRIAVMQPIHIDPESVKPPKRKNVRISKDPQSVAARHRRERISERIRILQRLVPGGTKMDTASMLDEAIHYVKFLKKQVQSLEEHAVVNGGGMTAVAGGALAGTVGGGYGGKGCGIMRSDHHQMLGNAQILR

SEQ ID NO: 415 - DNA, 1456 bp, Arabidopsis thaliana
  G2144
attagggttttgttgtcgtgagatttgattacacaaattgctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatata

SEQ ID NO: 416 - protein, 379 aa, Arabidopsis thaliana
  G2144  (conserved domain in AA coordinates:203-283)
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 417 - DNA, 1383 bp, Arabidopsis thaliana
  G2153
ttcttgcttagtatcattctttgtcgtgttcttttaattaaccttttgcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatattatgttctctcttgactatgattattatttgctaaatttcacttagctaaaaaaaaaaaaaaaaaa

SEQ ID NO: 418 - protein, 315 aa, Arabidopsis thaliana
  G2153  (conserved domain in AA coordinates: 75-94, 162-206)
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 419 - DNA, 1050 bp, Arabidopsis thaliana
  G2155
ctcatatataccaaccaaacctctctctgcatctttattaacacaaaattccaaaagattaaatgttgtcgaagctccctacacagcgacacttgcacctctctccctcctctccctccatggaaaccgtcgggcgtccacgtggcagacctcgaggttccaaaaacaaacctaaagctccaatctttgtcaccattgaccctcctatgagtccttacatcctcgaagtgccatccggaaacgatgtcgttgaagccctaaaccgtttctgccgcggtaaagccatcggcttttgcgtcctcagtggctcaggctccgttgctgatgtcactttgcgtcagccttctccggcagctcctggctcaaccattactttccacggaaagttcgatcttctctctgtctccgccactttcctccctcctctacctcctacctccttgtcccctcccgtctccaatttcttcaccgtctctctcgccggacctcaggggaaagtcatcggtggattcgtcgctggtcctctcgttgccgccggaactgtttacttcgtcgccactagtttcaagaacccttcctatcaccggttacctgctacggaggaagagcaaagaaactcggcggaaggggaagaggagggacaatcgccgccggtctctggaggtggtggagagtcgatgtacgtgggtggctctgatgtcatttgggatcccaacgccaaagctccatcgccgtactgaccacaaatccatctcgttcaaactagggtttcttcttctttagatcatcaagaatcaacaaaaagattgcatttttagattctttgtaatatcataattgactcactctttaatctctctatcacttcttctttagctttttctgcagtgtcaaacttcacatatttgtagtttgatttgactatccccaagttttgtattttatcatacaaatttttgcctgtctctaatggttgttttttcgtttgtataatcttatgcattgtttattggagctccagagattgaatgtataatataatggtttaat

SEQ ID NO: 420 - protein, 225 aa, Arabidopsis thaliana
  G2155  (conserved domain in AA coordinates:18-38)
MLSKLPTQRHLHLSPSSPSMETVGRPRGRPRGSKNKPKAPIFVTIDPPMSPYILEVPSGNDVVEALNRFCRGKAIGFCVLSGSGSVADVTLRQPSPAAPGSTITFHGKFDLLSVSATFLPPLPPTSLSPPVSNFFTVSLAGPQGKVIGGFVAGPLVAAGTVYFVATSFKNPSYHRLPATEEEQRNSAEGEEEGQSPPVSGGGGESMYVGGSDVIWDPNAKAPSPY

SEQ ID NO: 421 - DNA, 3004 bp, Arabidopsis thaliana
  G2192
cggaaagagatcaaccaacgatagaggagaagaagaacttgcatacgcaaaaaaactttcccgggaaaattccagaaactgctttggaaaaatgtgcgagcccgatgataattccgctagaaacggcgtcactactcaaccttcgaggtcaagggagcttctaatggatgttgacgacttagatcttgacggttcatggccactagatcaaatcccttacttatcctcatcgaatcgcatgatttctccgatttttgtctcctcttcctctgagcagccttgctcgcctctctgggctttctccgacggtggaggaaatggttttcaccacgcaacctccggtggcgatgatgagaagatcagctctgtctccggtgttccttctttccgtctcgccgagtatcctctcttcctcccttactcttctccatcagcagctgagaacacaacagagaagcataacagtttccagtttccgtctccattgatgagcctagtcccaccagagaacacagacaactactgtgtgatcaaagagaggatgactcaggcgcttcgatacttcaaagaatcaaccgaacaacacgttttggctcaggtctgggctcctgtgagaaagaatggtcgtgatttgctgacgactttgggtcaaccttttgttcttaatcctaatggtaatgggcttaatcaatacaggatgatctctctcacatatatgttttctgtggatagtgaaagtgacgtagagctcggactcccgggtcgagttttccgtcagaaattgcctgaatggactccaaatgttcagtactattccagcaaagaattctcgcggcttgatcacgccttgcactacaacgtgcgtggtacactggccttgcctgtctttaatccctctggtcagtcctgcataggtgttgtggaacttataatgacctcagagaagattcactatgcacccgaagtggacaaagtttgcaaagcccttgaggcggtaaatctgaaaagctcggaaatacttgatcaccaaacaacacagatatgcaatgagagtcgccaaaacgcgcttgctgagattctcgaagtgctgacagttgtatgtgagacccataacttgcctctcgctcagacttgggttccatgtcagcatgggagcgttcttgccaatggtggcggtctaaagaaaaactgcaccagctttgacggtagctgcatgggtcaaatctgcatgtctacaaccgacatggcctgctatgtcgtggatgctcatgtctggggctttagagatgcctgtcttgaacaccatctccagaaaggccagggagtcgctggacgagcttttctcaatggtggctcatgtttctgcagagacatcaccaagttctgcaaaacgcagtacccactagtccattatgcgctcatgttcaagttgaccacttgttttgcaatatctctccagagctcttacacgggcgacgacagttacattcttgaattttttcttccttcgagtataacagacgaccaagagcaagatttgctgttgggttctattttggtgacaatgaaagaacattttcagagtctgagggttgcatctggggttgactttggtgaagatgacgacaaattgtctttcgagatcatccaagcattaccggacaagaaggttcattcaaaaatagaatccattcgagttcccttttctggttttaagtcaaatgcaacagagacgatgttgattcctcagcctgtggttcagtcttctgatccagtaaatgagaaaatcaacgtggccactgttaacggtgtggttaaggagaagaagaaaacagagaaaaagcgtgggaagactgagaaaacaatcagtctagatgtacttcagcagtatttcactggaagtctcaaagacgctgcaaagagcctaggagtttgcccgacgacaatgaagcgaatttgcaggcaacacggaatctcgcggtggccatcgaggaagatcaagaaagtgaatcgttcaatcacaaagctgaaacgagtcatcgaatctgttcaaggtactgatggaggcctcgacctgacttccatggccgttagttccatcccttggacacacggtcaaacatcagcacagccactaaactcacccaatggttccaaaccacctgagctaccaaacaccaataattcacctaaccattggtcaagtgatcacagtccgaacgagccaaatggttcgcctgagttaccaccaagcaatggtcacaagcgatcacgaacggtggatgagagcgctgggactccaacctctcatggctcatgtgacggtaaccaattagatgaaccgaaagtcccaaatcaagatccgctcttcacggttggtggatcacccgggctcctttttccaccttattctagagatcatgatgtatctgcagcttccttcgcaatgccgaacaggcttcttggttctatagaccatttccgaggaatgctcattgaagacgctggaagttcaaaagatctgagaaatctctgccccactgcagcatttgacgataagtttcaagacacaaactggatgaacaatgataataatagcaacaacaacttatacgctcccccaaaggaagaggccattgcaaatgttgcatgcgaaccatcaggctcagaaatgagaacggtaacaatcaaagcaagttacaaagacgacataatacggttcagaatatcctcgggttcaggtataatggaattgaaggatgaagtggctaagaggctgaaagttgatgcaggaacgttcgatatcaagtatcttgacgatgataacgaatgggttttaatagcttgtgatgctgatcttcaagaatgtctcgagatccctagatcctcccgcacgaaaatcgtaaggctcttagttcatgatgtaacgacaaatctagggagctcctgcgagagcactggagaattgtgacctgataattcattcgaactcttttgtaaatag

SEQ ID NO: 422 - protein, 959 aa, Arabidopsis thaliana
  G2192  (conserved domain in AA coordinates:600-700)
MCEPDDNSARNGVTTQPSRSRELLMDVDDLDLDGSWPLDQIPYLSSSNRMISPIFVSSSSEQPCSPLWAFSDGGGNGFHHATSGGDDEKISSVSGVPSFRLAEYPLFLPYSSPSAAENTTEKHNSFQFPSPLMSLVPPENTDNYCVIKERMTQALRYFKESTEQHVLAQVWAPVRKNGRDLLTTLGQPFVLNPNGNGLNQYRMISLTYMFSVDSESDVELGLPGRVFRQKLPEWTPNVQYYSSKEFSRLDHALHYNVRGTLALPVFNPSGQSCIGVVELIMTSEKIHYAPEVDKVCKALEAVNLKSSEILDHQTTQICNESRQNALAEILEVLTVVCETHNLPLAQTWVPCQHGSVLANGGGLKKNCTSFDGSCMGQICMSTTDMACYVVDAHVWGFRDACLEHHLQKGQGVAGRAFLNGGSCFCRDITKFCKTQYPLVHYALMFKLTTCFAISLQSSYTGDDSYILEFFLPSSITDDQEQDLLLGSILVTMKEHFQSLRVASGVDFGEDDDKLSFEIIQALPDKKVHSKIESIRVPFSGFKSNATETMLIPQPVVQSSDPVNEKINVATVNGVVKEKKKTEKKRGKTEKTISLDVLQQYFTGSLKDAAKSLGVCPTTMKRICRQHGISRWPSRKIKKVNRSITKLKRVIESVQGTDGGLDLTSMAVSSIPWTHGQTSAQPLNSPNGSKPPELPNTNNSPNHWSSDHSPNEPNGSPELPPSNGHKRSRTVDESAGTPTSHGSCDGNQLDEPKVPNQDPLFTVGGSPGLLFPPYSRDHDVSAASFAMPNRLLGSIDHFRGMLIEDAGSSKDLRNLCPTAAFDDKFQDTNWMNNDNNSNNNLYAPPKEEAIANVACEPSGSEMRTVTIKASYKDDIIRFRISSGSGIMELKDEVAKRLKVDAGTFDIKYLDDDNEWVLIACDADLQECLEIPRSSRTKIVRLLVHDVTTNLGSSCESTGEL

SEQ ID NO: 423 - DNA, 962 bp, Arabidopsis thaliana
  G2295
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttagggttttatagttttg

SEQ ID NO: 424 - protein, 294 aa, Arabidopsis thaliana
  G2295  (conserved domain in aa coordinates: 1-57)
MVPKVVDLQRIANDKTRITTYKKRKASLYKKAQEFSTLCGVETCLIVYGPTKATDVVISEPEIWPKDETKVRAIIRKYKDTVSTSCRKETNVETFVNDVGKGNEVVTKKRVKRENKYSSWEEKLDKCSREQLHGIFCAVDSKLNEAVTRQERSMFRVNHQAMDTPFPQNLMDQQFMPQYFHEQPQFQGFPNNFNNMGFSLISPHDGQIQMDPNLMEKWTDLALTQSLMMSKGNDGTQFMQRQEQPYYNREQVVSRSAGFNVNPFMGYQVPFNIPNWRLSGNQVENWELSGKKTI

SEQ ID NO: 425 - DNA, 1406 bp, Arabidopsis thaliana
  G2340
atacaaaactccctcttctctatcttcttcatcttaaagaaaaaataagagatattcgtaaagagagaacacaaaatttcagtttacgaaaagctagcaaagtcgagtatcgaggaataacagaataagacgtatctatccttgccttaatgttcttaccaaaagatctagtcctttctttgtatgatcgatccatcacaagcccacaacaacaacaactacatctctttctctatctctagcttctatttttaatacattcaagaatcaagaatggtacggacgccgtgttgtagagcagaagggttgaagaaaggagcatggactcaagaagaagaccaaaagcttatcgcctatgttcaacgacatggtgaaggcggttggcgaacccttccggacaaagctggactcaaaagatgtggcaaaagctgcagattgagatgggcgaattacttaagacctgacattaaacgtggagagtttagccaagacgaggaagattccatcatcaacctccacgccattcatggcaacaaatggtcggccatagctcgtaaaataccaagaagaacagacaatgagatcaagaaccattggaacactcacatcaagaaatgtctggtcaagaaaggtattgatccgttgacccacaaatcccttctcgatggagccggtaaatcatctgaccattccgcgcatcccgagaaaagcagcgttcatgacgacaaagatgatcagaattcaaataacaaaaagttgtcaggatcatcatcagctcggtttttgaacagagtagcaaacagattcggtcatagaatcaaccacaatgttctgtctgatattattggaagtaatggcctacttactagtcacactactccaactacaagtgtttcagaaggtgagaggtcaacgagttcttcctccacacatacctcttcgaatctccccatcaaccgtagcataaccgttgatgcaacatctctatcctcatccacgttctctgactcccccgacccgtgtttatacgaggaaatagtcggtgacattgaagatatgacgagattttcatcaagatgtttgagtcatgttttatctcatgaagatttattgatgtccgttgagtcttgtttggagaatacttcattcatgagggaaattacaatgatctttcaagaggataaaatcgagacgacgtcgtttaatgatagctacgtgacgccgatcaatgaagttgatgactcctgtgaagggattgacaattattttggatgagttatattgatgatgatgaaaatttgcatttggcatgtaaatcaattagagtttgatttgctatggtgtttttagtttgtgtgtgtagtgtgtttcgaccgtcaaaaaaaaaaaaaaaaaaaaaaaaaaaa

SEQ ID NO: 426 - protein, 333 aa, Arabidopsis thaliana
  G2340  (conserved domain in AA coordinates:14-120)
MVRTPCCRAEGLKKGAWTQEEDQKLIAYVQRHGEGGWRTLPDKAGLKRCGKSCRLRWANYLRPDIKRGEFSQDEEDSIINLHAIHGNKWSAIARKIPRRTDNEIKNHWNTHIKKCLVKKGIDPLTHKSLLDGAGKSSDHSAHPEKSSVHDDKDDQNSNNKKLSGSSSARFLNRVANRFGHRINHNVLSDIIGSNGLLTSHTTPTTSVSEGERSTSSSSTHTSSNLPINRSITVDATSLSSSTFSDSPDPCLYEEIVGDIEDMTRFSSRCLSHVLSHEDLLMSVESCLENTSFMREITMIFQEDKIETTSFNDSYVTPINEVDDSCEGIDNYFG

SEQ ID NO: 427 - DNA, 1113 bp, Arabidopsis thaliana
  G2343
atgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaa

SEQ ID NO: 428 - protein, 370 aa, Arabidopsis thaliana
  G2343  (conserved domain in AA coordinates: 14-116)
MGHHSCCNQQKVKRGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKIRKPHHHYSRHQPSVTTVTLNADTTSIATTIEASTTTTSTIDNLHFDGFTDSPNQLNFTNDQETNIKIQETFFSHKPPLFMVDTTLPILEGMFSENIITNNNKNNDHDDTQRGGRENVCEQAFLTTNTEEWDMNLRQQEPFQVPTLASHVFNNSSNSNIDTVISYNLPALIEGNVDNIVHNENSNVQDGEMASTFECLKRQELSYDQWDDSQQCSNFFFWDNLNINVEGSSLVGNQDPSMNLGSSALSSSFPSSF

SEQ ID NO: 429 - DNA, 1011 bp, Arabidopsis thaliana
  G2346
atggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcagtgtgtcgccctattctcctccgtccttactatctcttgtgtgctacttgcggccgctatag

SEQ ID NO: 430 - protein, 336 aa, Arabidopsis thaliana
  G2346  (conserved domain in AA coordinates: 59-135)
MELLMCSGQAESGGSSSTESSSLSGGLRFGQKIYFEDGSGSRSKNRVNTVRKSSTTARCQVEGCRMDLSNVKAYYSRHKVCCIHSKSSKVIVSGLHQRFCQQCSRFHQLSEFDLEKRSCRRRLACHNERRRKPQPTTALFTSHYSRIAPSLYGNPNAAMIKSVLGDPTAWSTARSVMQRPGPWQINPVRETHPHMNVLSHGSSSFTTCPEMINNNSTDSSCALSLLSNSYPIHQQQLQTPTNTWRPSSGFDSMISFSDKVTMAQPPPISTHQPPISTHQQYLSQTWEVIAGEKSNSHYMSPVSQISEPADFQISNGSVSPYSPPSLLSLVCYLRPL

SEQ ID NO: 431 - DNA, 850 bp, Arabidopsis thaliana
  G2347
agcccatccttcaacattgcttcctaaccagaaatccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatatctatccggaaatgtattcgcatagtcttgcgtctaataatgtttattgattttgta

SEQ ID NO: 432 - protein, 181 aa, Arabidopsis thaliana
  G2347  (conserved domain in AA coordinates: 60-136)
MEGQRTQRRGYLKDKATVSNLVEEEMENGMDGEEEDGGDEDKRKKVMERVRGPSTDRVPSRLCQVDRCTVNLTEAKQYYRRHRVCEVHAKASAATVAGVRQRFCQQCSRFHELPEFDEAKRSCRRRLAGHNERRRKISGDSFGEGSGRRGFSGQLIQTQERNRVDRKLPMTNSSFKRPQIR

SEQ ID NO: 433 - DNA, 799 bp, Arabidopsis thaliana
  G2379
cgccgtcactctcctcccggtgccgcacattagcaacactactcccgacgaatggagacgacgacgccgcagtcaaaatcaagtgtgtcccaccgaccgccgttgggaagagaagactggtggagtgaggaagcgacggcgacgctggtagaagcctggggcaatcgttacgtcaagctgaaccacggaaatctccggcagaatgactggaaagacgtcgccgacgccgttaactctagacacggtgataacagccgtaagaagaccgacttacagtgtaagaaccgggtcgatactttgaagaagaagtacaaaacagagaaagctaaactctcgccgtcgacttggcgtttctataaccgcctcgatgttctaatcggtcccgttgtgaagaaatcggctggcggagttgtcaaatcagcgccttttaagaatcatctgaatccaactggatcgaactctactggaagctctcttgaagatgatgatgaggatgatgatgaggttggtgattgggaattcgttgctaggaagcatcctcgtgtggaagaggtagatctgagtgaaggatcaacgtgtagggaactagctacggcgattctcaagtttggagaagtttacgagagaattgaagggaagaagcaacagatgatgattgagttggagaagcagagaatggaagtgacaaaggaggtagagttaaaacgaatgaacatgttgatggagatgcagttagagattgagaaatcaaagcaccggaaacgcgcaagtgcttcaggtaagaagaactcacattagg

SEQ ID NO: 434 - protein, 248 aa, Arabidopsis thaliana
  G2379  (conserved domain in AA coordinates:19-110, 173-232)
METTTPQSKSSVSHRPPLGREDWWSEEATATLVEAWGNRYVKLNHGNLRQNDWKDVADAVNSRHGDNSRKKTDLQCKNRVDTLKKKYKTEKAKLSPSTWRFYNRLDVLIGPVVKKSAGGVVKSAPFKNHLNPTGSNSTGSSLEDDDEDDDEVGDWEFVARKHPRVEEVDLSEGSTCRELATAILKFGEVYERIEGKKQQMMIELEKQRMEVTKEVELKRMNMLMEMQLEIEKSKHRKRASASGKKNSH

SEQ ID NO: 435 - DNA, 1997 bp, Arabidopsis thaliana
  G2430
aacttcaacatacacataatctctcacttaaaaatatctctctctctctctctacaaaatcaattccaatgttggtgggaaagataagtggatatgaagataatactcgctctttggagcgagaaacatctgaaatcacttctcttctcagccaatttccggggaatactaatgtccttgttgttgacaccaatttcaccactctactcaacatgaaacaaatcatgaaacaatacgcttatcaagtgtctattgagacagatgcagaaaaagctcttgcgtttttgacaagctgcaaacatgaaatcaatattgtgatttgggattttcatatgcctggaattgatggacttcaagctctcaagagcattacttcaaagttggatttacctgtagtgattatgtctgatgataatcaaacggaatctgtgatgaaagcaacattttacggtgcttgtgactatgttgtgaaaccggttaaagaagaggtaatggccaatatatggcaacacattgtacggaagaggctgatctttaaaccggatgttgctccaccggttcaatcagatccggctcgctctgaccgtttagaccaagtcaaagctgatttcaagatcgtagaagatgaaccaataatcaatgagacaccgctgatcacatggaccgaagaaattcaaccggttcagtcagatctggttcaagccaacaagttcgaccaagtgaatggctattccccaatcatgaaccaagataacatgttcaacaaagcaccacctaaaccgcgaatgacgtggacagaagttattcaaccggttcaatcaaatctggttcaaacaaaagagttcggccaactcaatgactattcccaaatcatgaaccaagatagcatgtacaacaaagcagcaaccaaaccacaattgacgtggaccgaagaaattcaaccggttcaatcaggtctggttcaagccaacgagttcagcaaagtgaatggatattcccaaagcatgaaccaagatagcatgttcaacaaatcagcaaccaacccgcgattgacatggaacgaattacttcaaccggttcaatcagatctggttcaatccaatgagtttagccaattcagtgactattctcaaatcatgaacgaagataacatgttcaacaaagcagcaaagaaaccgcggatgacatggagtgaagtatttcaaccggttcaatcacatctggttccgactgacggtttagaccgagaccactttgattccataaccataaacggaggtaacggcatacaaaacatggaaaagaaacaaggaaaaaaaccacggaagccgcggatgacgtggaccgaagagcttcaccaaaaatttctggaagccatcgaaataattggtggtatcgaaaaagctaacccaaaggtacttgtcgaatgcttgcaagaaatgaggatagaaggaattactagaagcaatgtggcaagtcatcttcagaaacaccgtatcaatcttgaagaaaaccaaattcctcaacaaacacaagggaatggttgggccactgcgtatggtacactagctccctctctccaaggttcagacaatgtcaacacaacaataccatcgtaccttatgaatggtccagccactttgaaccaaatccagcagaatcaatatcaaaatggtttcttgacaatgaacaacaaccagatcataaccaatcctccgcctcctttgccctatttggaccatcatcaccaacagcaacatcagtcttctcctcaatttaattacctgatgaacaatgaagaacttcttcaagcctctggcctctctgcgacagatcttgaactcacttatccaagtttaccatatgatccacaagagtatctaatcaatggctacaattataattagtcatatagcccttctctttacttaaggcagtctatgtatgacaaataatatgcgacttcccttgtgagtcacaatattgtttcattattc

SEQ ID NO: 436 - protein, 612 aa, Arabidopsis thaliana
  G2430  (conserved domain in AA coordinates:425-478)
MLVGKISGYEDNTRSLERETSEITSLLSQFPGNTNVLVVDTNFTTLLNMKQIMKQYAYQVSIETDAEKALAFLTSCKHEINIVIWDFHMPGIDGLQALKSITSKLDLPVVIMSDDNQTESVMKATFYGACDYVVKPVKEEVMANIWQHIVRKRLIFKPDVAPPVQSDPARSDRLDQVKADFKIVEDEPIINETPLITWTEEIQPVQSDLVQANKFDQVNGYSPIMNQDNMFNKAPPKPRMTWTEVIQPVQSNLVQTKEFGQLNDYSQIMNQDSMYNKAATKPQLTWTEEIQPVQSGLVQANEFSKVNGYSQSMNQDSMFNKSATNPRLTWNELLQPVQSDLVQSNEFSQFSDYSQIMNEDNMFNKAAKKPRMTWSEVFQPVQSHLVPTDGLDRDHFDSITINGGNGIQNMEKKQGKKPRKPRMTWTEELHQKFLEAIEIIGGIEKANPKVLVECLQEMRIEGITRSNVASHLQKHRINLEENQIPQQTQGNGWATAYGTLAPSLQGSDNVNTTIPSYLMNGPATLNQIQQNQYQNGFLTMNNNQIITNPPPPLPYLDHHHQQQHQSSPQFNYLMNNEELLQASGLSATDLELTYPSLPYDPQEYLINGYNYN

SEQ ID NO: 437 - DNA, 1026 bp, Arabidopsis thaliana
  G2505
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatag

SEQ ID NO: 438 - protein, 341 aa, Arabidopsis thaliana
  G2505  (conserved domain in AA coordinates: 9-137)
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 439 - DNA, 1000 bp, Arabidopsis thaliana
  G2509
atatattccctctttcattctccttcttcgtcttttctttgtttctcatattcaagacatcctcaattccaaatcttaaaccctaaatttacagacacaatcgagatcacctgaaaaaagaggtttaaagattttagcaaagatggcgaattcaggaaattatggaaagaggccctttcgaggcgatgaatcggatgaaaagaaagaagccgatgatgatgagaacatattccctttcttctctgcccgatcccaatatgacatgcgtgccatggtctcagccttgactcaagtcattggaaaccaaagcagctctcatgataataaccaacatcaacctgttgtgtataatcaacaagatcctaacccaccggctcctccaactcaagatcaagggctattgaggaagaggcactatagaggggtaagacaacgaccatggggaaagtgggcagctgaaattcgggatccgcaaaaggcagcacgggtgtggctcgggacatttgagactgctgaagctgcggctttagcttatgataacgcagctcttaagttcaaaggaagcaaagccaaactcaatttccctgagagagctcaactagcaagtaacactagtacaactaccggtccaccaaactattattcttctaataatcaaatttactactcaaatccgcagactaatccgcaaaccataccttattttaaccaatactactataaccaatatcttcatcaaggggggaatagtaacgatgcattaagttatagcttggccggtggagaaaccggaggctcaatgtataatcatcagacgttatctactacaaattcttcatcttctggtggatcttcaaggcaacaagatgatgaacaagattacgccagatatttgcgttttggggattcttcacctcctaattctggtttttgagatcttcaataaactgataataaaggatttgggtcacttgttatgaggggatcatatgttttctaa

SEQ ID NO: 440 - protein, 263 aa, Arabidopsis thaliana
  G2509  (conserved domain in aa coordinates: 89-156)
MANSGNYGKRPFRGDESDEKKEADDDENIFPFFSARSQYDMRAMVSALTQVIGNQSSSHDNNQHQPVVYNQQDPNPPAPPTQDQGLLRKRHYRGVRQRPWGKWAAEIRDPQKAARVWLGTFETAEAAALAYDNAALKFKGSKAKLNFPERAQLASNTSTTTGPPNYYSSNNQIYYSNPQTNPQTIPYFNQYYYNQYLHQGGNSNDALSYSLAGGETGGSMYNHQTLSTTNSSSSGGSSRQQDDEQDYARYLRFGDSSPPNSGF

SEQ ID NO: 441 - DNA, 931 bp, Arabidopsis thaliana
  G2517
tcctcactctctctctttttctctaaccataaaatctctttgatctctttctctgtgttttgataatggaaaatgttggtgttgggatgccgttttacgatttagggcaaacaagggtttacccactcttgtctgatttccacgatttatcggcggagaggtatccggtagggttcatggatttactgggtgttcatcgtcatacacccacccatacgccgttgatgcattttccgaccacacctaactcgtcctcgagcgaagctgtgaatggagatgacgaagaagaagaagatggagaagaacagcagcataagacaaagaagcggtttaaattcactaaaatgagtagaaagcagacgaagaagaaggtgccaaaagtgtcattcatcacgaggagtgaggttcttcatctagatgatggttataagtggagaaaatacggtcaaaaacctgtcaaagacagcccttttccaagaaattattaccgttgcacaacaacttggtgtgacgtgaagaagagagtagagagatcattcagtgatccaagcagtgtaatcaccacttacgaaggtcaacatactcatcctcgtccactactcatcatgcccaaagaaggcagctctccatccaatggctcagcttctagggcccacattggcctccctacactccctcctcagcttttagattacaacaaccaacaacaacaagcgccgtcttcttttggaaccgagtacattaacaggcaagaaaaaggaattaatcatgatgatgatgacgatcatgttgtgaagaagagtcgaactcgggatctgctggatggagctggtttagtcaaagatcatggccttcttcaggatgttgttccctctcatatcattaaggaagagtattagttaatcgcataattatgtagctagctagctag

SEQ ID NO: 442 - protein, 277 aa, Arabidopsis thaliana
  G2517  (conserved domain in aa coordinates: 118-174)
MENVGVGMPFYDLGQTRVYPLLSDFHDLSAERYPVGFMDLLGVHRHTPTHTPLMHFPTTPNSSSSEAVNGDDEEEEDGEEQQHKTKKRFKFTKMSRKQTKKKVPKVSFITRSEVLHLDDGYKWRKYGQKPVKDSPFPRNYYRCTTTWCDVKKRVERSFSDPSSVITTYEGQHTHPRPLLIMPKEGSSPSNGSASRAHIGLPTLPPQLLDYNNQQQQAPSSFGTEYINRQEKGINHDDDDDHVVKKSRTRDLLDGAGLVKDHGLLQDVVPSHIIKEEY

SEQ ID NO: 443 - DNA, 1197 bp, Arabidopsis thaliana
  G2520
aaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttga

SEQ ID NO: 444 - protein, 354 aa, Arabidopsis thaliana
  G2520  (conserved domain in AA coordinates: 135-206)
MDPSGMMNEGGPFNLAEIWQFPLNGVSTAGDSSRRSFVGPNQFGDADLTTAANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEVMILMIINSIFSIFFTKQYMFLSRYSRGRSLDVYAVRSFKHCNKRSDLCFCSCSPKTELKTTIFSQNMTCFCRYSRVGVAISSSKHCNEPFGQQAFENPEIQFGSQSTREYSRGASPEWLHMQIGSGGFERTS

SEQ ID NO: 445 - DNA, 1167 bp, Arabidopsis thaliana
  G2555
ctgtttttgtatccgtgtaaattaatcacacggtagtttttgatgaaaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcaaaaaaaaaaa

SEQ ID NO: 446 - protein, 259 aa, Arabidopsis thaliana
  G2555  (conserved domain in AA coordinates: 175-245)
MQSTHISGGSSGGGGGGGGEVSRSGLSRIRSAPATWIETLLEEDEEEGLKPNLCLTELLTGNNNSGGVITSRDDSFEFLSSVEQGLYNHHQGGGFHRQNSSPADFLSGSGSGTDGYFSNFGIPANYDYLSTNVDISPTKRSRDMETQFSSQLKEEQMSGGISGMMDMNMDKIFEDSVPCRVRAKRGCATHPRSIAERVRRTRISDRIRRLQELVPNMDKQTNTADMLEEAVEYVKALQSQIQELTEQQKRCKCKPKEEQ

SEQ ID NO: 447 - DNA, 1502 bp, Arabidopsis thaliana
  G2557
tcgacttcctgtgaactcatctgtttgttctcttcttccggtttcactttttcatgtcctgccgttattacaacgaggattgtgtttgatccgatggaaggattggaatctgtgtacgctcaagctatgtatggaatgacacgagagagcaaaatcatggagcatcaaggatcagatttgatttggggaggaaatgagctaatggctcgagaactctgttcttcttcttcttatcaccaccaactcattaatccgaatcttagcagctgtttcatgtctgatcttggagtcttaggtgagattcaacagcagcaacatgttggcaacagagctagctcgatagatccatcatcactcgattgtttgttatctgcgacgtcgaatagcaacaacacctcgacggaggacgatgaaggaatatctgtgcttttctcagattgtcagactctttggagctttggtggagtctcatctgcagagtctgagaacagagagatcactactgagacgacaacaacgataaagcctaagcctttgaagagaaacagaggaggagatggaggaactactgagactacaacaacaacaacaaaacctaagtctttgaagagaaacagaggagacgagacaggaagtcactttagtcttgttcatcctcaagatgattcggagaaaggaggtttcaagcttatatacgatgagaatcaatcgaaatcaaagaaaccaagaacagagaaagaacgaggcggttcttcgaacattagtttccaacattcaacttgtttgtctgacaatgtcgagcccgatgctgaggcgattgcacaaatgaaggagatgatatacagagcggctgcatttagaccggtgaatttcgggttagagattgtggagaagcctaagaggaagaacgtcaagatatcgacggatcctcaaacggttgcagcgagacagagaagggagaggataagtgagaagattagggttttacaaacattggttccaggtgggacgaagatggatactgcatcaatgcttgatgaagctgctaattatctcaagttccttagagcacaagtaaaagctttagaaaacttgagacccaagcttgaccaaaccaatctctctttctcttctgctcctacatcgtttccattattccacccatcttttcttccattgcaaaatcctaatcaaatccatcatccagagtgttgacagattataaacttttgagtttcatcatcatcaacagaatcatggcgtcttgattgttttagcagttctcaagaaaggcaacttctgtgacaagggtggtgtcgggcagtgttgtttacactttccagtctttgttttgcatttctttttatataaagtttgtattttatatagaatctgtggaattcgagggttgaaatattgtgaaaaacagagccgcaagaggttaattacagtctctgcaatattttcaaccttttattactttattagagtaaagatagcgt

SEQ ID NO: 448 - protein, 373 aa, Arabidopsis thaliana
  G2557  (conserved domain in aa coordinates: 278-328)
MEGLESVYAQAMYGMTRESKIMEHQGSDLIWGGNELMARELCSSSSYHHQLINPNLSSCFMSDLGVLGEIQQQQHVGNRASSIDPSSLDCLLSATSNSNNTSTEDDEGISVLFSDCQTLWSFGGVSSAESENREITTETTTTIKPKPLKRNRGGDGGTTETTTTTTKPKSLKRNRGDETGSHFSLVHPQDDSEKGGFKLIYDENQSKSKKPRTEKERGGSSNISFQHSTCLSDNVEPDAEAIAQMKEMIYRAAAFRPVNFGLEIVEKPKRKNVKISTDPQTVAARQRRERISEKIRVLQTLVPGGTKMDTASMLDEAANYLKFLRAQVKALENLRPKLDQTNLSFSSAPTSFPLFHPSFLPLQNPNQIHHPEC

SEQ ID NO: 449 - DNA, 653 bp, Arabidopsis thaliana
  G2583
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 450 - protein, 189 aa, Arabidopsis thaliana
  G2583  (conserved domain in AA coordinates:4-71)
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 451 - DNA, 866 bp, Arabidopsis thaliana
  G2701
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcggc

SEQ ID NO: 452 - protein, 263 aa, Arabidopsis thaliana
  G2701  (conserved domain in AA coordinates: 33-81, 129-183)
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 453 - DNA, 1200 bp, Arabidopsis thaliana
  G2719
atggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctga

SEQ ID NO: 454 - protein, 399 aa, Arabidopsis thaliana
  G2719  (conserved domain in AA coordinates: 56-154)
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPRIKFTGMMPRQDFFCARS

SEQ ID NO: 455 - DNA, 1040 bp, Arabidopsis thaliana
  G2789
ctttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaacgcggcc

SEQ ID NO: 456 - protein, 265 aa, Arabidopsis thaliana
  G2789  (conserved domain in AA coordinates: 53-73, 121-165)
MDEVSRSHTPQFLSSDHQHYHHQNAGRQKRGREEEGVEPNNIGEDLATFPSGEENIKKRRPRGRPAGSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEEEEETEREIDGNAARAIGTQTQKQLMQDATSFIGSPSNLINSVSLPGEAYWGTQRPSF

SEQ ID NO: 457 - DNA, 1111 bp, Arabidopsis thaliana
  G2830
gccaggatttgaaattaactaaataacaaatatattgactttgaattcatgaatttcaatatattaccttttttgcacttcaaaaatatataaaaggatacatagggaaataatttagatacacttagagctacaaaatgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatgatccgtcgcgatgggacgatccgcggccgccggtggtgaggcagatttcagcgtgctggggcgatcgcggcc

SEQ ID NO: 458 - protein, 300 aa, Arabidopsis thaliana
  G2830  (conserved domain in AA coordinates:245-266)
MSSIPNRFNIYGGDTTNHRESLPIEMNHNSRMVRSMFITSDRMNHRDLFSSPPSFSSYQNSHISSSSVGFNNSHMTYHMLKRNYDSVSRADYFSTKDHSHFTQVSFTQTITNKYTTIVPSNIFDTVHYDIGRVKRAIDFRNIWNPKSHLPKKFNRQCEILNPTPLNIVFPHQDSADRQHLDIIFSSSKHNHVFQDGRSLKKISEPTNLFEKSNSYDSQEDEKIDAYQYDGRTHSLPYTKYGPYTCPRCNGVFDTSQKFAAHMLSHYNNETDKERDQRFRARNKKRYRKFMDSLKISKQKI

SEQ ID NO: 459 - DNA, 1915 bp, Glycine max
  Predicted polypeptide sequence is orthologous to G8
ggtacttgtttgtgccttattccctctgattctggaacaagttcccgttctttcttatctttctccactgttttattttctccctgatcttcctctaccttaatttcagtcctatttgttcttctgacagatactcttttaccttcaccagctcattcttcttctatcttcttctgctatatatgctcaacctttaaagggtatttctctctctctctctcaactagtttgagtttcattgtactttgatatcactgcagaagtacatgagactcttaaaagagggtatgctttaaagaccagaatcagaagctgattaaaggagagaacctttccaagacatggctatgtttgatctcaatgttgacatcaaccactgtgatgctgatgctgactcaagctgtgatcaaaagggattggtgctgcaaagtttcccacctgaaatctcagattccaggacctccagctcctctgtgtggaaccctgtagaggaagattcctcaaacaattcctctcccttgatttttgacatactcaagaaagagagggatgagtcagagtttgatgcagccactgaaagggtcaataaggagcaaaacatggcaccacaagaggcagagatagtggcaaggacacttttccctgtgactgctgctgctgataaaggagttagagtgcctgatttcaaattggggctgtgggggaagactgaatgcttgaacttgtccttacctgcggctcgaggacaaaatggactcagaaccttacagcagaaggtacctcctgtgaggaaaaataggagaggaccaaggtctcgcagctcgcagtaccggggtgtcaccttctaccgcaggactggtagatgggagtcacatatttgggattgtgggaagcaggtttatttgggtggatttgacactgctcaagctgctgcaagagcatatgatagggctgctataaagtttcgtggagtagatgctgatataaactttagtttgagtgattatgaggaggatttgaagcagatgagaaatttgagtaaggaagagtttgtgctcttacttcgtcgacaaataaatggaatctctaggagaagttcaacatacagaggtgcattagcccttcgcaaagatgctcaaggagaaccacgaatgggaccatttgttggcatgacatgttatcctaagccatccatcaattgtgatgatggaaaagcggaggcaagttttaagccctgttcctataagggagaaataattgtgaattccaacatgacaggcacttgccataatcttgatttgagcctaggaatttctccgtcttctaaaagattgaagaataatgactatagtggagggtattcctttggatgtatgacttgtaagatacccgaggaaagaggaccaatggagaaggtcatggtggacagaataaaaaatgttcctttgcaaaaaatttccaacttggcttggcaactttgcagcaatggcagcattgtcccaaggccattccaaccaaatgcagcatcatcaggattcgtctcttcttctagctgtctcatcacccgcacttccaatcagcacacatattaattatgccaacaatttggcattaattggctcaaccacagtactactactagttgaaaccaccagaaacaaagcatatttaccctgcttttttgaagattagatgagcaagagtacttcataaccacatgtacctatagtataagattctattgatttcatcaagcatgatggtatttaataatattgctaagcattgcttacaatggctacccgatattttctgtattcattatcgtgatgtagaacacaatattgccttgtgtaaaagacccttgttgaagtatgtatatatttgttggttcttgttaaaaaaaaaaaaaaag

SEQ ID NO: 460 - DNA, 1682 bp, Glycine max
  Predicted polypeptide sequence is orthologous to G8
attcggctcgagattatttggtgtagggattgcgggaaacaagtctatttgggtatggatttttaatttatgaatttatgaatttcagtgtttattttagggtacatagtttttgtactatctgaaatcgtattctatggtttactattttaagcatcttttgacaaaattggtatttgagcttgtaggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaattccttggcaaaaagtgaggacatatttttatatatcaacttacgtagtgatctactgtggttatgaaatattatgaatttaagcacctattgggctgcaaagtgaaattggtttcagcttaattctcaatgcatctttatgcttttttccatgtttggagaaacatgtctaagatagtaatatagagatgcgttttggttatagagattgcaatgctttcatgcaggtatatatatcttggactattcgacagcgaagtagaagctgcaaggtcctagtgatacatgaattacattctacccgcactgaatttatttacatgaattatcaaagctcattaggctccatccaacacgtatctcccttttgattttctggaaatcagggcttatgacaaggcagctatcaaatgcaacggacgcgtgggcggacgcgtggggcagtgaccaactttgagccaagtacttatgaaggagagatgaaacccgcagccattaatgaaggtggcagtcagaatcttgatctcaatttgggcatagcaaccccaggacctcccaaagaaaattgggggcaacttcagttcccctccatcccttacaacacacatggtggaagaagttcaatgatggaaaccaatgttaattctggaattggtaatccatctttgaaaaggatggttgtaactgaagatcgtccttcattatggaatggcatgtctcctaatttctttcccaatggggaaagagcagagagaatcggcattgatccttcaaaaggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcgccccatgtttggatacatctttgaagcaaatgctatttttagtgcactagcacagcgatgtttctgttttcc

SEQ ID NO: 461 - DNA, 2155 bp, Glycine max
  Predicted polypeptide sequence is orthologous to G8
  misc_feature (2149)..(2149): n is a, c, g, or t
aattcgcctggttcttctcttctctctctctctctctctcttccatggaatccaatagtcggcgacgctttcactctctccggcgacgatgaactcatcgccgacgaaatgagtttgcgccggtttcttctctctcctcgttccgtgagttccttcctctcactccttctccgttctccggtcgccggaaaatttatccggtgttagcgatacggaaaactcatcgcgattccgttttcttcttcgcttcgttttctacttctctttatctttcacttacattacctctctcattcggttgtttccgatcggatccatttcgccgtcgccggcgaagttagttggaacaggctttagctaagttgtaaacctcagaaattataaaaatagataatcggaatttagtagttagttcggtttttagttacttaaccgcttaacgatataaataaataaataaaaagaagcgcgacgatgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggaggatctaaaacagatgaagaatctttccaaggaggagttcgtgcacatactgcgccgccacagtaccggtttctcaaggggcagctcgaaataccggggagtgacacttcacaaatgtggccgttgggaagctcgaatgggacaattccttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaatgctatttttagggcactngcacag

SEQ ID NO: 462 - DNA, 1096 bp, Glycine max
  Predicted polypeptide sequence is orthologous to G8
gcagaaggacgggaagatgggaatcgcatatctgggtattgcggagaaacaagtctatttgggtgagatttgacacggctcatgctgctgccagagcctatgatcgagccgctattaagttcaggggagttgatgctgatatcaatctcaatctgagtgattatgaggatgacctcggcccgaggcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaaggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatgggcaggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggat

SEQ ID NO: 463 - DNA, 605 bp, Oryza sativa
  Predicted polypeptide sequence is orthologous to G8
gggcgggagcctcaggcattcactccagcccctgacaccaacacagcgcccacaacacccaagacaatcaagaatcctcagccacacgcagcacatcacccacaggcagccaccagcacagcacagcacagcacagcaagcacagcaagcacttcaggcaggcacaaagaaaagccagcacgcagggccacagcagcatcttcgcaagcatcgcaaataccagcaggcagtcaacacattctaccagcacagcaccaggccgctgggaatcccacatctgggattgcggcaagcaagtctacctaggtggattcgacactgctcacagcagctgcaagggcgtacagacagggcggcagatcaagttcaggggagtagaggctgacatcaacttcaacctgagcgactacgaggaggacatgaggcagatgaagagcttgtccaaggaggagttcgtgcacagttctccggcgacagagcaccggcttctcccgcggcagctcaaagtacaggggtgtcaccctccacaagtgcgccgctctagaggatccaagcttacgacgcgtgcatgcgacgtcatagctcttctatagtgtcacctaatc

SEQ ID NO: 464 - DNA, 2313 bp, Zea mays
  Predicted polypeptide sequence is orthologous to G8
aattcggcacgaggtccttctcctattctatctatatatcacccgcctcttttcccgacttcgccacgacgcaccttccctcttcttcctcagctccgtcgcccaccgccggagctccgaaaggccccgcgctcgccgcctttcctgtaaaaaacccaacctttagctagctaaccgctcctcttctccccctacgtactccccttgcccaaatcagagaagatatttaacggaggaggggaaggagaggatatttagctgattgttgattggtggtccggggtacggtgttcttgagtcgtgaagcgaccgtacggtggctagggccgtctccgggttgcgtgcaggatggtcgtcagagatcgggagtgaggaggcagctcgtggtcgtggaggctaaatgtaccgcaagaacgactcggcactctcctgtttctacctcttcctcctctggttcttcttcttgaaatagaccagcgccagccaccaggtagctacctactagctagcagcccagttgcgactggggacgggctgctgcttgcaagttggaatcttggagcaggagcagaggagcgggagatggagctggatctgaacgtggccgaggtggcgccggagaagccagcggcggcgctggaggcgagcgactcggggtcctcgggctcgtcggtgctgaacgcggaggcggcgtcggcgggcggcggggggcccgcgccgggggaggaggggtccagctcgacgccggccgtgctcgagttcagcatcctcaggagcgacagcgacgcggccggcgcggacgccgacgacggcgacgccacgccgtcgcctcctcgccaccaccaccagcagctcgtcacccgggagctcttcccggcgccgcagcattgggccgagctcggcttcttccgcgccggcccgcagcagcagccggacatcagggtcctgccgcacccgcacccgcacccgcccccgccgccgcccgcgcagccgcagccggccaagaagagccgccgcggcccgcgctcccgcagctcgcagtaccgcggcgtcaccttctaccgccgcaccggccgctgggagtcccacatctgggattgcgggaagcaggtgtacttaggtggattcgacactgctcatgccgctgcaagggcgtacgaccgagcggcgatcaagttccgcggcgtcgacgccgacataaacttcaacctcagcgactacgacgacgatatgaagcagatgaagagcctgtccaaggaggagttcgttcacgccctgcggcggcagagcaccggcttctcccgcggcagctccaagtacaggggcgtcaccctgcacaagtgcggccgctgggaggcgcgcatggggcagttcctcggcaagaagtacatatatcttgggctattcgacagcgaagtagaggctgcaagggcgtacgacaaggccgcgatcaaatgcaacggtagagaggccgtgacgaacttcgagcccagcacgtacgacggggagctgctgctgactgctgaagctagcgcagaagttgctgacgacgttgatctgaacttgagcatctcgcaaccggcatcgtcccagagccccaaaagagacaagaactgccttggtccgcagctccaccaccaccatgggcggccgtttgacggctccgccgttctgaagaaaaccaagatcgatgctccgtctgagctgtcgtcggcgggccgccctcaccggtcgttcctccctcatctcgtggctgccgagcatctaccgcctcggtctcaccccttcttcatcacacaccatgagagtgatgcatcaagaagagatcccagctgggcagcagcagcagcatggaaggtgaccgcagctgcacctcctcctcctaccaccaccctgttgccgttgccgctgccgtcgacgtcgtccgctgcagcatcatcaggattctccaataccgccacgacagctgccgccgccccatcggccgcctcctcccgccggttcgacccgccgccaccgtcgtcgtcctcctcctcgagccatcaccaccaccaccaccgccgctgagaatcgaagaagccacactgtaaatctgccgggaagcggctggtggcatccggcccgctcctccctccggggcgccgcaacttttttcgatcggttttgcgccgcccgggacgggttgtagttgatcgattggattcttcataactgtatttgcgtactgcttacactacacccaagtgaaatcgaaaatggcgccttctctcgttgaataaaaaaaaaaaaaaagcgcccccaaaaaactcgagg

SEQ ID NO: 465 - DNA, 823 bp, Zea mays
  Predicted polypeptide sequence is orthologous to G8
gcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccccgcgcgggcccgccgctgggattgcggcaagcaggtgtacctaggtggattcgacaccgctcacgccgctgcaaggcacgcactggactggacgcccagaattcttcgtcatgtgagtctctgaccgaattgattgattaacgagtctctggctcctggaactcgcagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaagtaagaaccaaccaacgcttcttttctttttcttttttttatagcatgcagtgatgattcaaccttagttgtgcctttcctcctaatcctatatatgtaggatttagtactggttgacatataagtatatatgtattgttcagtaaaagttacataggttagctgcatgtttatgtatgtagcttggttgtttcaatcagaagataaaaaaagggaaagtagtggctagggaattcctccaatc

SEQ ID NO: 466 - DNA, 589 bp, Zea mays
  Predicted polypeptide sequence is orthologous to G8
gtgcagggggacgcctctgtacctggagctgcctctcgagaagccggtgctctgacggcgcaggacgtgcacgaactcctccttggacaggctccccatctgcttcatgtcgtcctcgtagtcgctgaggttgaagttgatgtcggcgtcgacgccgcggaacttgatcgccgcccggtcgtacgcccttgcagcggcgtgagcggtgtcgaatccacctaggtacacctgcttgccgcaatcccagatgtgggactcccagcggcctgtgcggcggtagaaggtgacgccgcggtactgcgagctgcgggagcgcgggccgcggcggctcttcttggccggcggcggcgcggcgtgtgggtgcggcacgatcctggggcccggcgcctgttgctgctgcaggtcggcgcggaagaagccgagctcggcccggacgcgtgggcggacgcgtgggtccaagtgcaactacacaccactgccaaacttcgaatgataaagagtgcagactaacaagtagtacaactcatgacatcgtactctccagtcctgaattctggtctggagtagtgatagcagcaagcaactttac

SEQ ID NO: 467 - protein, 509 aa, Oryza sativa
  Orthologous to G8
MELDLNNVAEGVVEKHETAARSDSGTSESSVLNGEASGAAIAPAEEGSSSTPPSPPPPPAAVLEFSILRSSASASGENDADDDEEEEATPSPPPHHQHQQLLVTRELFPSAAPSPQHWAELGFLRPDPPRPHPDIRILAHAPPPAPPPPPPQPQPQAAKKSRRGPRSRSSQYRGVTFYRRTGRWESHIWDCGKQVYLGNFIEHIIFLLSIQRDIAMNNLTNTFIFSQTITGGFDTAHAAARAYDRAAIKFRGVEADINFNLSDYEEDMRQMKSLSKEEFVHVLRRQSTGFSRGSSKYRGVTLHKCGRWEARMGQFLGKKAYDKAAIKCNGREAVTNFEPSTYDGELPTDAAAQGADVDLNLRISQPAASQQSPKRDSGSLGLQIHHGSFEAPSELASRPHRFPLLTEHPPIWTAQPHPLFPNNEDASRSSDQKRKPSEGVAVPSWAWKQFGASYQVASRANTRDGNCARLPVYPRVKTLLGLGLFSILYPWVSYWFKSYARWVNGHGYG

SEQ ID NO: 468 - DNA, 659 bp, Glycine max
  Predicted polypeptide sequence is orthologous to G19
acaaaaacccattctttatgctcactcgtctgcttagcgtagattaatcattatgtgtggcggtgccatcatcgctgacttcataccccgccgtggaggccgccgcctcgcggcctccgagctctggccaaactccttcgccataggcgatgcctttgacttggattactcccacgtcgctacccaacaaccctccactctcaaaaggtcgccaacctcccaaaggttagtcttgttcactaactcactcgctcattttcaccctgaaggttttgtaaacatgttaagatttttttctttttcgactgtgagtttgttcgaacagtcagcgagcaggttgagaataagccggtcaagaggcagagcaagaatctcttcagaggcattcggcagcgtccgtggggcaaatgggcagcggagattcgcgatcctagagaaggggttagtgtctggttgggcacctttaacaccgcagaagaatgccgcgagcagcctacgatcgtgaagctcgaaaacatctgagggccaaaaaggctaaggtgaatttccccaacgaggccgacgaatattccattcaagctcgtaatccaattccaccccttcctttcgctccgcagcaccctcccctgtaccagcaacagtaccgttgcgatctcaac

SEQ ID NO: 469 - DNA, 1285 bp, Glycine max
  Predicted polypeptide sequence is orthologous to G19
tcgcgattataagtttggtcttgtggatagaaatgaagggcaaagcacttcaaaataaggctgtttggattgatgtaaaaaggaacaatactatgttctattgtttgaattgtttacaatagaattttacctcgtaaaaaaaaaaaaaaaaaaaaaaaaaaaaaaacctatgaagaaccccaaagactgacgccccccccccccggcctctcacgagcccgcattaatgtgtgtttgtcacgagacccatagtgctgccaaattatagtaactctctttctctatctgaagaagaagaagttctgaagaagcatgtgtggaggtgctatcatctcagacttcattggtgtgaagcgtggccgcaacctcgccgcgcaggaactgtggtccgagcttgaccctttctctgacctccttggcttcgataccaccaccaccaccaccaaccaaccaccccttccagacaaaaaagtggtgtcatcatgtgagaagaagaagaagaaaagtgtgagtgcagaaaagaagagtggtgggcgagctcggaagaacgtgtacagaggaatcaggcaaaggccgtggggcaagtgggccgcggaaataagggacccacataagggcgtccgcgtctggctcggcaccttccccaccgccgaggaagccgcccgagcctacgacgacgccgccaagcgcatccgcggcgacaaggccaagctcaacttcccggccaccgctccgccaccctccaaaaaacaacgctgcctcagccctgacaccaccaccgaacaaagcagcagctcacaatccaccactggatccaccggatcgccgccttccgccgccttccacggcggaggagatgaactcgacctgaaacaacttgaacggtttctagggttggacaacatgggtgctgagtgggacaacatggatgacctgtggatgctggacgacgtcgttgtgcccaaccgtcacttaatttactagaagggagataattaattaattaataaatggcgttttcttaagttatagttttataaaactatgttggtgtatgtgttcttagttttctgttttgtcttgtcctctcgctttggtaatttctgttttgtacggtcgaatgatttcaaaattatgtgcaacgtatcatgagagggatgattatatgttatgattatgattataaataaaggccaattagggtgtgttagcgtttgggtcgtgcatgtttatatgtagtttatgcgttgtatataatatatttggcatgacattatttggttct

SEQ ID NO: 470 - DNA, 1129 bp, Glycine max
  Predicted polypeptide sequence is orthologous to G19
tccccgagccgaatcggctcgtggtttgtttgtctgtcacgagactcatacattgtgctgccaattatagtaactctctatttctctttccatctctcaagttctgaagaagaaacatgtgtggaggtgctatcatctcagacttcattggtgtgaagcgtggccgcaacctcgccgcgcaggaactatggtctgagcttgaccctttctctgacttccttggcttcgataccaccaattccaaaaaccaaccacccctgcagaaaattccagacaaaaaagtggtgtcatcatgtgagaagaagaagaaaagcgtggtgggtgcagaaaagaagaagagtgatagtgggcgagctcgtaaaaacgtgtacagaggaatcaggcaaaggccatggggcaagtgggccgcggagataagggacccacacaagggtgttcgtgtctggctcggcaccttccccaccgccgaagaagccgcccaagcctacgacgacgccgccatacgcatccgcggcgacaaggccaagctcaacttcccggccaccaccatttccgccgccgccgctccgccaccttccaaaaagcaacgctgcctcagccctgacatcatcactgaagaaagcagcagcagcagctcacattccaccactggatccaccggcgaaagcggcggaggaaacgacgaactcgacctgaaacaaattgaatggtttctaggtttggagaatgagctgcctgttagcaacaacattggtgctgagtgggacaacatggatgacctgtggatgctggacgacgtcgttgtgcccaaccgtcacttaatttactagaaggctaataattaataaatggcgttttcttaagttttagttttactttataaattgtagtataaaactatgttggtatttgtgttcttagttttcttctgctgttttgtctcttctctggctttggtaatttctgttttggacggttgaatgatttcaaaattaggtacttaattacaccctatcatgattgggatgatgattatatattatgattatgatgattatatataaataaagggtgattaagttacggcgcgtgagtgtttgcgactttgcgccgtgcatgtttttataaa

SEQ ID NO: 471 - DNA, 570 bp, Glycine max
  Predicted polypeptide sequence is orthologous to G19
cccacgcgtccgcaaaaacactcatcactctatctctctcaaaagtgaaaatgtgtgggggtgctataatttctgatttcatagacgtgaatttgaacagtggtcggaaattgaccacccacaacacccatcatcagcttcacactttctctgatttccacgccacctcttcttccaaacatcaaccatcctaccaggatccaaacctccctaggcctcctccgcttccaaacaaccaaggagtgaagttgaaggctttgactttgaacactggtcgagtacggaagaacgtgtacagaggaataaggcaaaggccatgggggaagtgggctgcagaaataagggacccacgtaagggtgtgcgtgtgtggctgggtactttcaacactgctgaagaagctgctcgtgcttacgacaatgccgccaagcgcatccgcggagacaaggccaagctcaactttcccgacagcaagaacccatgtcttaatccctttcaactcaaacacctcttttccaacctcgaatccttccttggttgggcctcgctctaatcactcccattcttgtctg

SEQ ID NO: 472 - DNA, 750 bp, Oryza sativa
  Predicted polypeptide sequence is orthologous to G19
cccacgcgtccgcccacgcgtccgcccacgcgtccggagccagcgactgtgccaatgtactactcctaccccctctcctactcctgttaacaagttgtgctgctatatagaggagcagccgagcaagtgtgttgccccgggtcgacccgcgtcggtgggtaattgatagtagcaagacaatgtgtgggggagcgatcatcgccgacttcgtcccgcccgccggcgcccgccgcgccgctgcctccgacatctccgacaacgccgtcctctccgctgccggtgccggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgccgcgccaccgccgcccaagaagcgacgcaaagccgccgccgcggcgaaccaccaccaccaccaccaccagcaggagagctcaggctcctcgtcggcgtcgtcgctgcctcccaccccgccgccggccgccgagcaccagctccgcgagtgcatgtccgggctggaggcgttcttgggcctcgaggaggaggaggacgacggcggcgccggtgagccatggg

SEQ ID NO: 473 - DNA, 395 bp, Oryza sativa
  Predicted polypeptide sequence is orthologous to G19
  misc_feature (316)..(316): n is a, c, g, or t
cccacgcgtccggtccatttctttgcagtcctcgcatgcgcaacgtgtccactgtttagatggatgcacacggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgncgcgccacccggcgccaagaagcgacgcaaagccgccgccgcggcgaaccaccaccaccaccaccaccagcaggagagc

SEQ ID NO: 474 - DNA, 467 bp, Oryza sativa
  Predicted polypeptide sequence is orthologous to G19
gtttccttcgcgtgagcggcagcaagtgttcagggcgggcttcttctcgatttagctttcttggtttcttgatctgtagcttattagcggccatgtgcggcggagcaatcatctccgggttcatcccgccgtcggccgctgcggcggcgaggaggaggaggacgacgacgacgtggtcgtggtggtccccccgccggcggcggcgaggttcgtcgtccgtgccgcggccaaggcggcgcccccaactgcagatgggatgttgactacaaagcttgtccaacatgatggacctactgctagatcagcaaagcacaagaggaagaatcagtacagggggatccgccagcgtccctggggcaaatgggcagctgaaatccgagaccccacaagggtggccgtgtttggcttggaacatataacactgctgaggaggcagctagggcatatgacgctgaagcccgcaagat

SEQ ID NO: 475 - DNA, 1536 bp, Zea mays
  Predicted polypeptide sequence is orthologous to G19
gaggctggccgggatctcccaactccgcctccaagtcccacccccactccctcgctcaccagaggaactggcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccgggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcggcagttgatggcgtgatgactcctcctccaaaggatgtccaaggagatagagcagtaaaaaagcgcggcccggaagaaccagtacaggggaatcaggcagcggccttggggcaaatgggcagctgagatcagggaccctaacaagggcgtccgcgtctggctcggaacctacaacaccgcccgaggaggcagctagggcatacgacgccgaagctcgcaagatccgcggcaagaaagcgaaggtgaattttcccgatgacgcgacaggcactcgtcacaggccaacgaccgatgagatctttaacaacctgaagaacgacgacaacaacaacaacgatgatctgtttgcgatgtttgcgttcggtgacaataagaagaaggttcctgcagcgaagccagccgccgccgagggtggcagtggcagtggcagcttcctcgtccctgcgccctgcggtggcggtggtgcccggtaataagaggaggtcgtccgcgaccaacactatgctctccgtctccgacgaccagcgcagcaactcctacggctccggctcctccgccgacttggtggggtcgtgggtcgtgggacgacgacgacgccgccgccgccgccgccgccgccgccatgacctcggactacacctcctcggtcttagctccggcgtcttactcttacatgcaaggcggagcgccgaagagaatgaggcacagctacagcggcgcaccgcaccaacctcgcacatgacgcggccatgcctggttttggccttgataaagtgagctaccactaccagccgttgccgttgcctccttattacgtcgggagcagcagcggctcgtcagacgacgcgtcggtgggcagccttggtcttctgcaggctgatggtgctccacaggatggggcgagcgccggggatatctggagcctcgacgagctgctcatgctggcaacagctggtgcttattgagaacgcaaaaaaaacaaaaaaaaagggccctaaggcc

SEQ ID NO: 476 - DNA, 990 bp, Zea mays
  Predicted polypeptide sequence is orthologous to G19
aattcggcacgaggcggcaccaaaaccacgcgctacttcaccagcctagctagccctttcgccgtcgctgcggctcctgcccactgactcgtaggtttcgttgtttcgacaatgtgcggcggagccatcatcgccgacttcgtccccgccggcgcccggcgcccggcaacagacgacaccatgtccgcctccatcctctccggtagcgaggaccatccggagctgccgctgccgctgccggcgccggcgccggggcgcaagacggcgtaccgcgggatccggcgccgcccgtggggccggtgggcggcggagatccgcgacccgcggaagggcgcccgcgtgtggctcggcacctacgccaccccggaggacgcggcgcgcgcctacgacgtggcggcgcgcgagatccgcgggcccaaggccaagctcaacttcccgcccgccgtgggcggcggcggcggcgcgcgcgcgccggcgccggctgcggccaagaggcgccgcaagtccccggcggccgaggagagctcggcctcgtctcctccggcggccgtcgtcgtggcgggcggcggggaggaggcgctgcgcgactgcatgtccgggctcgaggcgttcctggggctgcaggacaccgatgagggtggcggcgtcgaggcgtgggacgccgtggacctcatgttggcgtaggccggagtacgccgtagcagggctgcaggggggcccagccccagccccagcgcgcgcgtgccgtcgctgtgaacggccgccgcagctgttttggatcgagtaataatattattagtagtataatgtttctccaagcagctaagctaattgcatgcccttgctgggtgggtggtattactagcactgctatctaggagtatgtactagcaggatgggtttatctagcttgttgctaaacagataattaatctaagaaaacagagatatggtctgttaaaaaccgcctctaaataatgcccggcgatt

SEQ ID NO: 477 - DNA, 1049 bp, Glycine max
  Predicted polypeptide sequence is orthologous to G22
cctttttttttttttttttttttttttttttttttttttttttccatcaatttgttatatattcttcattattttcattgtcatgagatacaactattcatattacaaagaaaaaggaaaaaaaaaatactatgacaaactatcctcacacttctgcaatgccataagaatggcaagatagtagtaatacatttcatatatatatatatatatatatatatatatatatatatatatatatatatatattcccttttattattgccacctcgtgtctattgaaaactgccacatatttgaatcatatatccagctccaaatctgtcaaggagctatctttactccgctttatggctaccgtggatgacaaaggacactataaagaaacatccgacaaatgtttcaatgtttctttagcgtaaccttaattggctcatgatccgagccaattaaatgaggaaaattcagcttagcttttgagccccgcatcttaaatgcagctcgatcataagctaaagctgcatcctcagcggtttcgtaggttccaagccacactctcacaccattcctcttagtgtccctaatctccgccgcatacttcccccacggcctcctccgcacgcctcggtagctcaaccccttctttggaggcgtgcgagtgccacgcgcggctgtagttttactattttgaccctcattttccattttcacagctacactaacattactcacctcatttccattggcggggaaccatccggtggcagcagcatcacgcaaagcaccgtagatgaccatgtcattggtgtcgttctccttcaacggcagctccgcccaattctctgtcaagaaaatgttccggaagctagaactccggcagaacgctgctatggacggcaccgatgcagaaacgtcctgaaacggcgtcgttacgggtatctcaaagtgatcaagagcattcacattggtgtttaaagcatgagagctcattgctccgtacaagtttgatgtttcgttgctttcgtaggttgtgtggcgcgcccgcgtgg

SEQ ID NO: 478 - DNA, 515 bp, Glycine max
  Predicted polypeptide sequence is orthologous to G22
agccgatgagtatgataaatcagactctagcaaattttgcttcaaagtctttgtcaatactcttatcggcttcagaggcgcgtgagaaccaatgaggtgaggaaaatttaacttagctttgctgccacgcatctcaaaagcagctctatcataagctaaacccgcttcttcttcagtttcgtaagtcccaagccatatcctagcaccattcttcttcggatctgttatttccgccgcgaacttgccccaaggtctacgcctcacaccccggtaacgcttccatgctggtggcgcgtgaacttcacgctccaccttagggtgttctcttttgcatgctaacgacccttctgcatcatggacaccttccaagcggaacgtagtagagcttgggaatgaattgtacgttggagaatagcaaatttcgtgattggaagcgttcatgagtgtgttggaatcgtgctcaagctcaagacgacagtggtgaatagattccactgaagagaaatcacaagata

SEQ ID NO: 479 - DNA, 475 bp, Glycine max
  Predicted polypeptide sequence is orthologous to G24
gacgaaccaaagttaactactttagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtctgtgctagagtcgatgctcttcaggcaacccttcaccaccactacgtgcccccgcggcaacttctctctggcggtggtggtgggtcc

SEQ ID NO: 480 - DNA, 1471 bp, Glycine max
  Predicted polypeptide sequence is orthologous to G24
ccacgcgtccgaatacaacagcaacatgatggtttcagtttcttgagggtactaatatgaacagaatctcctctcaacacctttgccttgctgcagttcgcaactgcaactgcactcaaatataaatatatatacatatatatatatatatatatatatgtattacttcatggtcacacatagttaagtttattaattactaggtagctggttttgaatagggtagttggtagttatagttgttgtcccagatatggaagaagcaggtttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattagtaatttccttcaaccttcaagattaatattgatccaccaatcatgggttctgatgtgacttatatatagggcttcaacttgccctcttcacctatgctaatttgaaaagaaaaaaattttatatttgtcatatgatttatctgagtaaatatttttttccagtttatttaattaatattagaaagtgtaggaagaaatagacacacctgatgagaattgagatgaggctaattaacttgttaatgaggtgagtaactcctttaactatatataaattaaggggtatatatattattagttgctcacctcatgttgttgctcatctcacgaagaaactcattttagattacttttttcctttcattatgtgtatgctggagcggtggactggtagctacatagattctcgctatgatggggcatatgatcatgaggtcttttctcaggtcggttgtgtgttgtaatttgtaacgagatatccgtaacacaataggatcaaattaaccgtgttttgttgtttcagattatcttttctacgttcccgttcattgctccaatctgatatcctacataatctccactactttatatataaggccggccgttttttaagacccaagttaccttcccttgccttcaaagcaaatacttttctattgtgtcccctaaaatcaatttcattggccgtctttttccaaacctctgcttggaaaaaccttggctttccccaactta

SEQ ID NO: 481 - DNA, 1419 bp, Glycine max
  Predicted polypeptide sequence is orthologous to G24
  misc_feature (832)..(832): n is a, c, g, or t
  misc_feature (868)..(868): n is a, c, g, or t
  misc_feature (870)..(870): n is a, c, g, or t
cccacgcgtccgtaccaatatgaacagaatctcctctcgacacctttgctttgctgcagctcgcaactgcaacttcccacaaatataaatatatattacttcatggtcacacatagttaattttattaattactactaggtagctggtttttaataggtagtaggtaggtgtaatcgttgtcttcctgcagatatggaagaagcgggtttaggagattgttgttcctctaatacgactattacgaggaaaagcgagaagcgaaagcagcagcaccaacaacaagagaagccatacagaggaataaggatgaggaagtggggcaagtgggtggcggagattagagaacccaacaagaggtcgaggatctggttgggttcttacgccacccccgtcgccgccgcacgcgcctacgacaccgccgtcttccacctccgaggcccttccgctcgccttaacttccccgaattgctgtcccaggacgacgacgtttcgacccaacaacagggcaagatgtccgccgattcaattcgcaaaaaagcgacccaagtcggcgccagagtcgacgcgctccaaaccgcgcttcagcaatcctcgtcgacacactccattagttccagccacgtcagctatgagaaaccagacttgaacgagtatcccaaacctgaagatttagtaatttccttcaaaccttcaagattaatattgatccaccaatcatgggttctgatgtgacttatatatagggcttcaacttgccctcttcaccctaggctaattggaagaagaagaaaaaaccctttttatatttgtcatatgattatatatatatcntagtagatatttttcttccagtctatttattttaanantagaacgtgtaggaagaaatatacagacacacctgagaattgagatgaggctaattaacttgtttatgaggcgagtaactcctttaaatatatataaattaaggggtatatatactattacttgctcatcaccacatgaagaacaacgtttgacctttaaccaaatgagatcgtgtaattcatgctgttgacctgattttgctgttgttgctcatctcacgaagaaactcattatagtttttttttttctttcaatatgtgtatgttagctggagtcgtggactggtagctacgtaggttctcgctatgatggggggcatatcatgtggtcttttctcaggtcggtggtgtgttgtaatttgtaacgagatatccgttacacaatcggatcaaattaaccgtgttttgttgttttagattaataaaaatacatatgttctgatgaattcgataatttcacatacatgtggtgaaaatgatttcatatataagttgtatgcatagttcatgtgtgtgaactatattaattcgaccgatcctgtttatgtt

SEQ ID NO: 482 - DNA, 973 bp, Glycine max
  Predicted polypeptide sequence is orthologous to G24
gcttagtgcgcgagtcgcatgaccctctctcccttataacccttccgtgtcttttacgagttagatttctcattcgtcattgaacagattcactctctctctctttagagatttgattgacaaacacaactaattccaaagctaacaactttatagagagagagagagagagagagagagatggagggtgaaggaagaagaagagaaggaggagagagagaaacagcaacagcagcagcaacgaggaaggtggtggagggtgctgatcagagaagatacaaaggaataaggatgaggaagtggggcaagtgggtcgctgaaattagagaacccaataagcgttcaaggatttggctcggttcctattctacccctgtcgcagccgcacgtgcctacgacaccgccgtcttttaccttcgaggaccctccgcgcgtcttaacttcccggagcttctcatcggagaaggcgccgccgccctcaccggcggctgtgacatgtcagcagcttctattaggaagaaggcctccgaggtcggtgctagagtcgatgctcttcaggcaacccttcaccaccatcaccaccatgttgtgccaccacggcagcttctctctgccagctgtggcggtgggtccggtgattttgcagtgcgggttgttgacctgaataagatgcccgaacccgagagctccgactgtgagtggaacgtgaattgaaggaaaaagaaaaaaggtgcatgttttcatattcaggtgatggtggttgttaacgtgcgccggctgaggcaaaatgatgttgttgatgaggcctgtggtggtggtggtggtggtgcggagtactgtactgtatctttttttccttcaaccttctctcttgggtagtttttttttaaaatttttagatattacaaaagaatttttggcttgtaaaaatatgttaaatgtaaattaactagtccggtagcagtttcttttt

SEQ ID NO: 483 - DNA, 1021 bp, Glycine max
  Predicted polypeptide sequence is orthologous to G24
cccacgcgtccgtacggctgcgagaagacgacagaaggggataccaaggtggaggcttacccagatgacaagcttagtgcgcgagtctctctcccttataacccttcttccacttccgtgtcttttacgagttagatttctcattcgtcatggaacaacacattcactctctctctctttagtgattttttcgatttgattgacaaacacaacgaaccaaagttaactactttagagagagagagagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcaggcaacccttcaccaccactacgtgcccccgcggcaacttctctctggcggtgatggtgggtccggggatttcccggtgcgggttgttgacctgaataagatgcctgaacccgagagttcggactgtgagtgggatgtgaattgaaggaaaaaaaagtacatgttttcttattcggttgctaagcgcgggttgaggcaaagtgatgttgttgatgaggcctatggtggtgtggagtactgtactgtatcttattccttcaattttctctcttgggtcttggctagttttttttttttagatattacaaaagaaattttggcgttgtaaaaatatattaaatgtaaattaactagtccagtagccaaaaaaaaaaaaacccccaaaaac

SEQ ID NO: 484 - DNA, 1285 bp, Glycine max
  Predicted polypeptide sequence is orthologous to G24
ccttttttttttttttttttcagaaccaaactgttattaaattacttatactttaacctacatcttttaaataaaataagaaataatatctacagcggatcacaaaacaaatataaaacacaacctttgggggagatgtttgtaatagttaattgtggaacaacgatcgaggtttgaggagctacaattttggtttcacattgaagacacatctctttctttcttacattttcggttgcttttctttcatattttctggttttctattttccaatttgttggatacaatgtcgtttgagatttgactccaactagacaaaaatctgagacgcagaaccgattaaccgaccccatgcatcacccatcgttatcatcgaaacagagtagtgaccacaacagcgtcttccctccccaatggtcccttctcttcacatatacaactcataaaaacacctaacatccatctttttttactcttcagtagaatagtagctattataatattataattacttgagtggttaacatggctcactccctctttttcaacccaactccctggcatcataggccattgctgtgccctctaaccccttttccccaataaaaaaaaaattaattaaaacaaggttataattttatatttgtttttgaaaaactccaaattaacaactaaacaacactcctaatccctgtcccagtagtcacaatccgaattctcgggttcgggcatcttattaaggtcaacccggtcggcgaattctccagcaggcagcgcgtgggggtgctggcggtggagagcgtcgactctggcgccgacctcggtggccttcttcctgatggaggctgcggacatgtcggcggcggggccctccgcggcaacaagctcggggaagttgaggcgcgcagaggggccccggaggtggaaaacggcggtgtcgtaagcacgcgccgccgcgacgggcgtggagtaagaaccgagccaaatccttgaacgcttgttgggttctcgaatctcagcgacccacttgccccactttctcattctgattcctttgtagcgcgtcgtctcagtttcaccctctttccctctcttctttgttgcaattcctccttcttctccttccataactactctctccctctctctctctctgaaaattcccttaatttttcatgaagagtataaataaatgaaataaaagaatgaagtgcgaggaagggaagggttataggggttttgcagtgcagagagacactgagccgaggttgtcgcgcgcgctgg

SEQ ID NO: 485 - DNA, 400 bp, Glycine max
  Predicted polypeptide sequence is orthologous to G24
  misc_feature (319)..(319): n is a, c, g, or t
gttttgaatagggtagttggtagttatagttgttgtcccagatatggaagaagcggggttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtctttcacctccgaggcccttacgctcgccttattccaattgtgcanacacactttgaccacacagcacattcgcgttcatcgaaaagcaccagtcggccgatcaccctcaacgccttacatctgtct

SEQ ID NO: 486 - DNA, 457 bp, Oryza sativa
  Predicted polypeptide sequence is orthologous to G24
  misc_feature (3)..(4): n is a, c, g, or t
  misc_feature (7)..(8): n is a, c, g, or t
  misc_feature (11)..(11): n is a, c, g, or t
  misc_feature (16)..(17): n is a, c, g, or t
  misc_feature (19)..(19): n is a, c, g, or t
  misc_feature (21)..(22): n is a, c, g, or t
  misc_feature (38)..(38): n is a, c, g, or t
  misc_feature (45)..(45): n is a, c, g, or t
  misc_feature (47)..(48): n is a, c, g, or t
  misc_feature (50)..(50): n is a, c, g, or t
  misc_feature (62)..(62): n is a, c, g, or t
  misc_feature (67)..(67): n is a, c, g, or t
tannatnnttngttanncnannaaaatctccttcgtgnaagtttnanncnccgtctgaccgntcctnggaggtagaacaccgccgtgtcgtaggcgcgcgccgccgccacgggcgtcgcgtacgaccccagccagatgcgcgtccgcttgtgcggctcccggatctccgccacccacttgccccacttccgcatccgcacgccacggtactgccgcctcggctgctgctgctgcagaagcagccgagtcctcgctggaggagcggtggtactcgccctgcatgagcgaagcgcagccgccgccgcagccgccctcttctctctctctctctctctctctctctgccctctcctgtgcaagcagcagtagcttttggcgttggttgggcggcttcttcttctcttctcttttctttctcgctatgtttgatgggtggtatttgtattgggcctcgtgc

SEQ ID NO: 487 - DNA, 1149 bp, Zea mays
  Predicted polypeptide sequence is orthologous to G24
ggcggtgaagatggaggcggagcaagcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcccccgcctccggtcctacgccacggccgtggcggcggcgcgcgcctacgacacggccgtgttctacctgcccggcccgtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccccgagagctccgacgccgagtgacaagcgagcgagagcgcagcagcagccaccgcaaggcgaggttcaacgacgacgtccgttatcggttattcccaatcccacgacgcagcatgccgttgtcgtctccgtccgaccgtccccacgtacgtacgtacgtacgtacacgacgatccagctgaccctgccgcctgcctatcctatccgtcctcgacgacgaccggatggtcggcgggcgggagggagggcggtgcggcgagggttttgggtacgttgtggataagcacgagggcagcagcagcaggggcggcgtgcgcgggcaggcaggcgaagacggagggaggcggccacaagcggcggtctttccaaacgtcaaaaaggacagctgtaacagcgataagaaaaaacaagtcatcatcaccctcgtctcactactagttctactactgttcccgagagtagtagtaacgattagcactccactagcagtatgattattcgaatcggccttgcttgacagcgattaaaaaaaaaaaaaaaaaaaaaaaaaaaaaaaaaag

SEQ ID NO: 488 - protein, 233 aa, Oryza sativa
  Orthologous to G24
MQGEYHRSSSEDSAASAAAAAAAAAAAMAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 489 - protein, 184 aa, Oryza sativa
  Orthologous to G24
MDRREATVFLPPPPPPQPTQPQQQPAAAAVRAPVGGRGGGGGRQYRGVRMRKWGKWVAEIREPNKRSRIWLGSYSTAVAAARAYDTAVFYLRGRSARLNFPDQLDGAGGGGAGAGGAEDHRELTAAVIRKKAAEVGARVDAQHSVVGAAAPVPLQPPQPPPPQRRRTKNPDLNREPTPDTSDDE

SEQ ID NO: 490 - protein, 206 aa, Oryza sativa
  Orthologous to G24
MAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 491 - DNA, 1186 bp, Glycine max
  Predicted polypeptide sequence is orthologous to G28
cattcctataaataccccctaattcataaccctctgagttccagtccgtaatatctccaccttttggggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctgagagagattctaaaattggtattgtgtttattaaatacaaaaaatacaatactcttttgtaattatgtgaggtgcgtgtgtagtcctatacccatcatccaactcaatcttgcaacagagaaaaaaaaaaggtgaaagatgagacaggtgattttagtatatcaaatttcaaatggtgagtggtgaacccaccacgggaagaaaaaaattaaaagatgatgatgagtgatgacagaggtgaggatatgtaatttagctttgtgaatactaccaaatttgtttgttcaacattatgaattatgaatgggttaaatgtgacaaatgagttgagcccttaagaatccttct

SEQ ID NO: 492 - DNA, 727 bp, Glycine max
  Predicted polypeptide sequence is orthologous to G28
gcgtgcgcgcgctcgtaatccggctcgagtgatgtgttcggattgcggcggaggagaagaaggttgttccggcgaaggggaagcactaccgcggcgtgcggcagcggccgtgggggaagttcgcggcggagatccgcgacccggcgaagaacggagcaagggtttggctggggacgtttgagacggcggaggacgcggcgttggcgtacgaccgcgccgcctaccggctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaaaaaaaaaaaagagggggagaaaaaaattcaaagaagttatggaatttggaagatgatgaggaatgacgggggtgaggaactgaggatatgtaatttggctttgtgaatactaccaaatttgttatttgtttgttcaacattatgaactataaaaaaaaaaaagaatgggttaattgttaattgcttg

SEQ ID NO: 493 - DNA, 1181 bp, Glycine max
  Predicted polypeptide sequence is orthologous to G28
  misc_feature (1169)..(1170): n is a, c, g, or t
ggccggagtttaagtttatcttccaagttcacgtaccatcgcttttataaataccctcatccagtttcccttccaagttcgaatattcaattcaacaccttccctcattctcttctccaaacacgacacaaacattaagaagaagaaacataccacgaaatgtacggacaaagtagctatgagtccgatttggcccttttggactccattcgccgccacttacttggcgactccgaggagcacaaattcggagccccgaatgttagttcgggtaacactccagcgtactctcggagctcctgtttcagcaggttgtacccttgcttgagtaacgattggggagaacttcctcttaaggaagacgattcagaagacatgcttctttacggtgttcttcgcgatgcaataaacgcagggtgggtcccatctctcgatgcatcctcaccggagagtttctcgtcgggtttcatcccggcggtgaccgtgaaatccgaaccggatctatttccggcgccagagcctgtctatattcctccggcggctcagaaggctgagccggcggtggttccggcgaaggggaagcactaccgcggcgtgcggcagcggccgtgggggaaattcgcggcggagatccgcgacccggctaaaaatggggctcgggtttggcttgggacttttgagacggctgaggacgccgcgctggcttacgatcgagccgcgtatcgaatgcgcggctcgcgggctttgttgaattttccgctccggattaattcgggcgagccccgaccggttcgggtcacggcgaagcgggcttcagcagaaccgtgttcttcgtcggagagtggatcttgggtgaagaagcggaagaaggtggtgggttgagaacggggcacgtggagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccaccctgtgctgaactaagtgatnncaataaaatat

SEQ ID NO: 494 - DNA, 767 bp, Glycine max
  Predicted polypeptide sequence is orthologous to G28
agcccacgcgtccgcccacgcgtccgcccacgcgtacgcctcctcttccaaaatatccacgtttcttttcccacacactatcttaaatcttaaaaacattttttttttcaaagcaattagaatttagaccacaaaaggaacaccgaagagatgtacggacagagtagtagtagcagtagttcttacgaatcggatttggcgctgttggattcgattcggcaccacttgctgggcgagtccgaatccatattcggcgccccgaatttcgggtcgggtcggagctccagtttcagcagcttggactcgtgtttgagcgacaattggggcgagcttccgtttaaggaggacgatacagaagacatggtgttgtacggcgttctccgtgacgccgttaacgtcgggtgggtcccatctctcgatgccgggtcgcccgagagcgtgtcgtcgggttttccggcggtgaagctggagccggacttgatgccggcgctgataagtctcgtgtccgcctccggcggctgcggcggaggagaagaaggttgttccggcgaaggggaagcactaccccggcgtgcggcagcggccgtgggggaagttcgcggcggagatccgcgacccggcgaagaacggagcaagggtttggctggggacgtttgacacggcggaggacgcggcgttggcgtacgaccgcgccgcctaccgggtggggacggtgcaagagcaagtggggagtcaagtggcagagtgtacacgtggcgagcagttat

SEQ ID NO: 495 - DNA, 561 bp, Glycine max
  Predicted polypeptide sequence is orthologous to G28
  misc_feature (12)..(12): n is a, c, g, or t
  misc_feature (84)..(84): n is a, c, g, or t
gggggaagttcncggcggagatccgcgacccggcgaagaacggagcaagggtttggctggggacgttttagacggcggaggacncggcgttggcgtacgaccgcgccgcctaccggatgagggggtcgagggcgttgctgaattttccgttgagggttaactccggcgagcccgatccggtgagggtgaagtcgaagcggtcgtcgtcgccagagagtgcggcggcgctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaagaaaaaaaaaaagagggggag

SEQ ID NO: 496 - DNA, 784 bp, Glycine max
  Predicted polypeptide sequence is orthologous to G28
tacggctgcgagaagacgacagaagggggaagtaacatagaaacaaacatgggaagcaacaaaacctacgaggaagaagaaagcacggttctattttcccattcccaaacacaaacagagttgttacccttcaacgagaacgacccgcaggacatggtcatataccaagtcctcaacgaagccaatgctctcaccaacacatttctccctcagaggcttcaccaacctcagttgtgcctcgagcccaccagaaacataacaaagaagcactacagaggagttcggcgccgcccctggggaaaatacgccgctgagattcgcgactctgcccgccacggcgccagaatatggctcggcaccttccaaaccgctgaagaggctgccatggcttatgaccgagccgcgttcaagatgaggggctccaaggctttgctcaatttcccagctgaaattgttgctgcaacggagttatctttcaataatactaatagtaacaatcacgatgctgtttctgattccagtgctggtagctcttgcacgaacaattccgttcagctaaataggaatcagtcagaaagctgcacaagtagcacaggttagctaaatggggttcaacaattaattgtagaaatctttttttttttttttcgcaattgggttggtttgttataattattataattatttgtatctgtctgtcttacaggacaccgaaaattaattcatttaatgtgataccatgttcatgaatgggttaaaaaaaaaaaaaaaaaaaaaaaaaaag

SEQ ID NO: 497 - DNA, 819 bp, Glycine max
  Predicted polypeptide sequence is orthologous to G28
ggctcgagccaaaaccacttgacacaccgggccgacttgcccttccttcaaaaaccaaagccagaccgaccctaagaagaaaccaacaaacatgggaagcaagaaaacctacgaggaagaagaaagcacggctctattttcccattcccaaacacaaacagacttgctgttacccttcaacgagaacgacccacaggacatggtcatataccaagtcctccacgaagccaatgctctcaccaacacattcctccctcagcccaccagaaacataacaaagaagcactacagaggagtccgccgccgtccttggggaaaatacgccgctgagattcgcgactcggcgcgccacggcgccaggatatggctcggcaccttccaaaccgctgaagaggctgccatggcttatgaccgagccgcgttcaagatgaggggctccaaggctttgctcaatttcccagctgaaattgttgctgctgctactgcaacagagttatctttcaaaagtagtagtaataataataataataataataataacaatcccgatgctgtttctgattccagtgctggtagctcttgcacgaacaattccacttgggtaaataggaatcagtcagaaatcacaagtggcacaggttagctaaatggtgttgaagttgaacaattaattgtagaaatctttttttgtttctttttctcaatcgttttggtttgttataactattataattatttgtatctgtctgtccaactggacaacaaaaattaattaattgaatgtgataccatgatcatgcatgggttaaaattataaaa

SEQ ID NO: 498 - DNA, 736 bp, Glycine max
  Predicted polypeptide sequence is orthologous to G28
  misc_feature (11)..(12): n is a, c, g, or t
  misc_feature (14)..(15): n is a, c, g, or t
attctatgaanncnngattacattacaatcgttgaagtctcatattaatgattgatcaaattgtacaacatgcatattcctctagccacttcaacattccaccttgacttggcttctattcttggctaatttattcagtagttcagccaggctcttcctcctctttgtcccttgtgattctgagctatcatctgaacacgaggacgacggtgatgaaatttctaacaaacttcgcttggaagttgtcatcattactggctccgacaattcatcggaattgtcggaatcaataagatgaggaaaattcagcttggccttttggcctcgcattttgaaagcggctttgtcatatgccaaagcggccttctcttcggtatcatacgtgccaagccaaaccctagctccgttcttctttggatccctaatctcggccgcaaactttccccacggtctacgcctcacccctctgtaatgcttccatgttggtggcgcatgatcacgcgctaccacagccgttgcatcctcacttcggaaagcaatgttccctgaatcaccatcacatttattagggtctgaaaatggatcatgagatgcagcttggtgggtttcagacatgagattgatggaatcatgtccaagtaggtattgttgaacagattccaagaatgcaaaatcggaatccacggtggcggaaaccatgttttaattttcagctaactttgctcaccgcgtttgg

SEQ ID NO: 499 - DNA, 1079 bp, Oryza sativa
  Predicted polypeptide sequence is orthologous to G28
gcaggaattcggcacgaggcaaaatcaaattcaaattcacgggataattcaaagatgctgcttaatccggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcccgcgcgctcctcaacttcccgctccgcatcggctccgagatcgccgccgcggccgccgccgccgccgcggggagggagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgacaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaat

SEQ ID NO: 500 - DNA, 1429 bp, Zea mays
  Predicted polypeptide sequence is orthologous to G28
gcgcgcgggcggacgcgtgggcttccattccaatttccacacacacacgtctcagctcactccctcctccagtttcgtcagctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagccgccgctgacgcccggcaccaccacgcccgggagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgcggcgctcgcctacgaccgcgccgcctaccgcaggcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccgccccagccgtggttccctgccgcgccggtcgagcaggcggcgatggctccgcgcgtggagcagctcgtcgtctagccatgcgtgcaacgatggatgcgccggcgaaagcgggggacggacagggcaaggccctgcgctgcacttgcgtgacagctccaccggatggaatgcgaatatgcgataaagctcgtgatgccgctgttgctccgtgcaactggcgcaagtggaagaagctgtctctgtgtgtaatcaagtgtcttgtctgcggacgaattttcggtatgtgcgtcgttgtcactgctcgggattgtgctgctgctgataagttcggaaaactgtacacccacgtagggagagagacgatccgtgatcaagaacagcccgctttgttctttctctgataaaaaaaatatccagcggccaaacaggcgcgcaagtcaacagaacagcgacctgagctcgtgacacgagatcgagatcgaaatcgcccccactgaaaccagaactgcagagccgagcggtaatccaacgctgacgacgtaac

SEQ ID NO: 501 - protein, 259 aa, Oryza sativa
  Orthologous to G28
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGGKHYRGVRQRPWGKFAAEIRDPAKNGARVWLGTFDSAEEAAVASDRAAYRMRGSRALLNFPLRIGSEIAAAAAAAAAGNKRPYPDPASSGSSSPSSSSSSSSSSSSGSPKRRKRGEAAAASMAMALVPPPPPPAQAPVQLALPAQPWFAAGPIQQLVS

SEQ ID NO: 502 - protein, 237 aa, Oryza sativa
  Orthologous to G28
MSLSLGFSAGAGVGADRLAAAPALQAAGALPPRVDVSLSLARAANGQPSSYLPLNENDSLDMVLFDVLREASAVAALSSSSSSSPELGARTTAPVVAGHPAGRKGGGGGGGGRGAAARGGAAGGRHYRGVRRRPWGKYAAEIRDPTRHGARLWLGTFGTAEEAAAAYDRAAFRMRGAKALLNFPPAVAGDGARRGAAAAAKQVGMSDVVPRACHVVCYSVLSAHIFYDIFRGVIPIP

SEQ ID NO: 503 - protein, 282 aa, Mesembryanthemum crystallinum
  Orthologous to G28
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 504 - DNA, 1082 bp, Glycine max
  Predicted polypeptide sequence is orthologous to G47, G2133
ccacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttatctttttttttttttttttgagttatgatcgatgcgcatagttagtagttacagataattactgctagtgttgggtgtttaaacggtcagagatgatgatatataaatttgatgtgcgctagctgcctttttgaagaaactaaaaaaaggtaaaacaagaaagattgtacccccaaaatgaacttggtcaatttcacactttcacgccatttgcattttgtgcacgttgttagttttcaaattgttaattcccttgctaaacccactcaaacttgagtgcgttcaccttttattaccacgtagtaactgagagttaacgaaaatatttctttataaaaattatttaccatttagtgtctttcgtttacttgtaattattcaacttgtcaataagatgaaagttctaattttagatataataaaattcagctagtatttgtgaattactcactt

SEQ ID NO: 505 - protein, 165 aa, Oryza sativa
  Orthologous to G47, G2133
MSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLLSARDAAPAPAPATANARPDHCTGCDDRAVRLAGTPRGCTVLTSHAIVF

SEQ ID NO: 506 - DNA, 889 bp, Glycine max
  Predicted polypeptide sequence is orthologous to G157, G859, G1842, G1843
ggtatataatatgtcactaatttaattaggcacagactagtagctgaagcaaacttccccacggcaacattatgtttaagagcttctctagatggtccatgtttcaaccagaatagaaataacagaaggcaagtagctaaaccatggcatagttccctatgcatgtattaagcacacaattggaaaattcgtgcaagttatatccatagtggtggctttcagctgcatttacaaaccagggagcagattatgcgtcacccgatctgtttgatcatagtcaataaaccgtgtcaccacgttattgccgcccccaccccttttctggccctccatccgcttcccccaaacctcaccctcatttctcaagatatgttcctttttcttaagattctctccagattccatcatcaatcgcatctttgctgatctgattcgcgaaagagcagaatgaaccagtttctctagttccataaggtcagtcacactcagatgctcaagttcagaaacaccaaagtggctttggaccaattgagaaaacgcttcatcagaccagatatctgcaatttcaaagcggagtccctttgtgtcagtaccgctcgctcctaagttatcccaatatcgctgcacgacctcggccaaactgtcaccgttgcaaagctcgtagagcttgccggtgctggagaagatgagcagcgccaacttcgcatcgcagagaatggataactcgcgggctttcttcatcaatcctttgcgcctcttggagaatgttatctgccgattgcttttgttctcgattcgctttatctccagcttcttcttccccattcttcttcgcgccaaaaccctagctagctaccttcttttctattcggttttctcggacgcgtgg

SEQ ID NO: 507 - DNA, 1995 bp, Glycine max
  Predicted polypeptide sequence is orthologous to G175, G877
gggaaaaatgtaaagataatggctttgatgatatctacatatcatcctttgctttcaagcgtgcaacagattcaggctctttttatcatggtgctggaagaaaaatgataaatcctactacacttcctcaacagtcccttcctggtattgaggtttcggctcagtctgaaaattcttttcaatctcaaagtgttgatgctgtcaaagctcaaactgagaacaaaagtggttttcgtcttcaggccgactttgctgaatcacctcctcaaaaagataatggaattaagatgttctcagctgatcaaagggcttttgatgttgttggcggtggcaatgaacattctacaccaattgaagagcaagtagatgaaggagatcaaagaggcaatggagactcaatggctagtggtgttggtggtgcaccatctgaagatggatataactggagaaaatatggccaaaagcaagtgaagggcagcgagtaccctccggagttactacaagtgtactcatccgaactgtcaggttaagaagaaagtagaacgatctcatgagggccacataactgagatcatctacaagggaacgcacgaccatgcaaaacctcctccaaatcgccggtcaagtataggttcggttaaccttcatactgacatgcaagtggaccaccctgaacacgttgaaccacacaatggtggtgatggtgacttgggctgggctaatgtacaaaagggaaatatagctggagctgctaattggaagcatgaaaacattgaagccacatcatcagcatctgttggccctgaatactgcaaccagtcccccaatttgcaggctcaaaatggtactcacttagattcaggagaggcggtggatgcctcatctactttttctaatgaagaagacgatcaagtcactcatggtagtgtatcattaggttatgatggggaaggagatgaatctgagtctaagagaaggaaactggaatcatatgcagagttgagtggagctactagagccattcgcgagcctagagttgttgtacagactaccagcgaagtagatatcctcgatgatggttatcggtggcggaaatatgggcaaaaagttgtcaaaggaaatcccaacccaaggagttactacaagtgcacgaatgcagggtgcacggtcaggaagcatgtggagagagcatcacatgaccttaaatctgtaatcacaacatacgagggaaaacataaccatgatgttcctgctgctcgtgccagcagtcacgtcaacgctaatgcttccaatgccgttcctggccaagcttctcttcagactcatgttcatagacccgaaccatctcaagttcacaatggcattggaaggcttgagaggccttctcttggctcattcaacctacccgggaggcagcaactaggaccatcccatggcttctcctttggtatgaaccaatccatgctatcaaatctggtgatgtcagggttaggccacgcgcaagcaaagcttcctgtcatgcctgttcatccgttcttggcagcgcaacaacaacatcaacagcgacaacaacatcaacagcagcagcaacatcaacagcagcagcaacaacatcaacagcaacagcaacatcaacaacaacaatgcgctgcaaatgatttgggtttcatgttgccaaagggagagccaaatgtggaggctattcctgaacatggtggccttaacctgtcaaatggctcatcagtgtaccaagaaatgatgagtcgcatgcctcttggacctcatatgtaaaattttattccctgattctttaaagaaaaaactaatgtttacatctgataacatacatatatagatttatacatatatgtaatgccaaggcatacataggcggacttttcattattagactcattgtaatgtttgacattcttcatcacatgtcaaaggtatatgttattttgctcatttattgcattggtcctggccggccgc

SEQ ID NO: 508 - DNA, 845 bp, Oryza sativa
  Predicted polypeptide sequence is orthologous to G175, G877
gaactagtggatccccgggctgcaggtttggtccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcaggttggctatggctcagctggtcacagaccagcaaagcagtttggtgcagcagcagctggtttctcctttggaatgcttgctcgtagcatttgcaacttcggggccgtcttcggcgatcgccgttgccgcg

SEQ ID NO: 509 - DNA, 984 bp, Zea mays
  Predicted polypeptide sequence is orthologous to G175, G877
  misc_feature (651)..(651): n is a, c, g, or t
cgcgcagctacttcaagtgcacgcatcccaactgcctggtgaagaagaaggttgagcgctcgcacgaggggcacgtcacggagatcatctacaagggcacgcacaaccacccgaagcccacgcagagccgccggccaggcgcaggcgcgcacccgttgggcggcggtgcgcaggcggacgcagccgacaacctgcaggggtcacaggcaaacgcggcggaagccaaccagccgtggcgtgcgggtgtccaggatggcgtggacgcgacgtcgcccccgtcggttcccggtgagctctgtgactcggcggcgtcgatgcaggtcgactgcgcggcccggtttgggtcccccgagggcgcggacgtgacgtctgccgtgtctgccgaggtggacggggacgacagggggactctgactcatggcggtgccaacgcggcggagggcgacgaactggaatctaaacgaaggaagctggaggcatacgccattgacatgagcactgcgtcgagagctgttcgcgagcctcgagtggtgatccatacgacgagcgaggtggacatgctggatgacggctaccgctggcgcaagtacgggcagaaggtcgtcaagggcaacccgaatccaaggagcttctacaagtgcacgcaacctntctgtatggtgcggcctcttttttccgcgcgctttttacgctcttatgctcttctttccttttttccgtccctcggcctcctttttttttttttttccttggcttcttccccttttttttttttctcctctttccctcttttcccccccccgctttttcccttctttcccccctttttccgtcccttttccctcccctttccccttttcttcccttttcctccctccccgtttcgccttttctctcgtttccctcccttttccttcctttcctcccctttctctcccgttttccttccccttttcctccccgttcctttccgtttctttcttt

SEQ ID NO: 510 - DNA, 1367 bp, Zea mays
  Predicted polypeptide sequence is orthologous to G175, G877
ccacgcgtccgtgccaccccttccttcccctaatcccctcctcggtcaaaccgcctcactctcctactcttctctccctagtccctacccggctctctccctcccccctctctctaaaaaaagtagcgcccgcagaaccgagaggctggagaaataaaggcggaaagagggaggcaaatctcactttgttggggattctttcctccgtttccgactcctttgttctcttaagtgttcttggttagtggaatggaagctcagcagccccatttatgcccccgagagcctcgtcgttcccctcgtgtgtaggtgtagcctttcactcggttggtggaagggcagaggcacagtagaacatcgataaagggggggtcgtctattttttagctcttcgtgttcttgtaggaggaattcccgttcacatgatccgtgcctgcatcctcaagagctgtccgggagcctagggttgttgttcagaccacaagtgaggtagacattcttgacgacggttatcggtggcgcaagtatgggcagaaggttgttaagggcaatccaaatccaaggagctactacaaatgtacaaacccgggctgttcagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcactttggtacggcttctttcagctcgttcggtctcccaccgagtggtcagttgggaccaacaactggcaatttcggcttcgggatggttcccccaggcatgacgatcccagtgccctctctaggatcgcttgcccctgtaaagatggttggaaattcatcagctatgcaggggtacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtaatcacgtaaaggatacctttcgtctttttgagactcgaaattggaaaacgatcaatcaaaatttctggttgcgaatgcaaaaaaaaaaaaaaaaaaaaaag

SEQ ID NO: 511 - DNA, 3267 bp, Zea mays
  Predicted polypeptide sequence is orthologous to G175, G877
gagctcacttttccgggggccgcccttttttttttttttttttttttttttttttttttttttcaccaaacctcaatgaagaggggcagtaaataaataaatagttgctgagctaaaaatgaagtggaagggtgaaaaaaaaacagaaagcaacgggtgtttgttcccacgttataacaattatcacgaactcatcctaatacgactggtaagaaactaataacttgagaatcactaatcctctccacatttatttatgtatctacatctgctggcgcaaccgcagcccgctgcacatcatctgctggtacaccgacggggcagcgccgccggcaacgttgccctcgacctttacgtcgtccttgggcgccacgaggccagcggcctgcatcgcctgccggtgcctcagcagcgggtgctgctgcagggacgacggcgccagcatcgggagcttcagcccatcgacggcgctgagggtccccgccggcaccggcaggctcggcagtgacgtggggccggcgccgccaaggggaatggaggaggcatacgtcgggtaattgcccatcggcgccagcggatccctaggcggcggcaggccgaacggcacgccgcagccgcccaagtgccccatcaggccgtcgcgcagcgacgggtgctccagcctgcgcgggccacccgcgcctgtcgccgccgcggtgcccgggtggccgctgttcctggcggcggggacctcgtggttgtgcctgccctcgtacgtggtgatcacggacttgaggtcgtgcgacgcgcgctccacgtgcttccgcaccacgcagcccgggtacgtgcacttgtagtagctccttggattcgggttgcccttgacgaccttctggccgtacttgcgccagcggtagccgtcatctaggatgtccacctcgctcgtcgtctggatcaccacgcgaggctcgcgaacagctctcgacgcggtgctcatatcgatggcgtacgactccagcttccttcgtttacattccagctcgtcaccctccgcgtcggcaccgccctgagacatactgccacgagtcaccctgtcgtccccgcccacctcgtcggacacagacgtcacatccgcgccctcgggggatccaaaccgggctgccgagtcgacctgcatcgaggccggcgagtcacagcgctcaatgggaactgagggcgacgacgtcgcgtccatgccatcctgaacacccgcacgcctcggctggttggcgtccactgcgtttgcctgtgaccccaggttgtcggctgcgtccgcctgcgcactgtcgccaaacgggtgcacgggctggacgcctggacggcggctctgcgtgggcttcgggtggttgtgcgcgcccttgtagatgatctccgtgacgtgcccctcgtgcgagcgctcaaccttcttcttcaccaggcagttgggatgcgtgcacttgaagtagctgcgcgggtactcgctgtgcttcacctgcttctgcccgtacttcctccagctgtacccgtcctccgctggcgctgtaacggccattgccgccgggtagtcttccctcgcatcagcttcctcggctctctggccgtaatccgggggtgatgcgtgttcattgcctgcaccggtgccagacgcaagacggctgagcttggagtcacgagcaccgtcactatccatgttggtctgcccatcgtgattctgctggttcagttggcccagcaaactagcctcttgtactgtcagaatcttggtttcagtcttgacagaagacttcgtattttgttcctgacggagcaattatgaactaactcgtaaggaaatggtatcaaaaggtattggatcatgaatagaaaaaaaaatgttcattgacattttgaaatgtacaattagaacgatgttcttatatgtttagttggaactcaaggaagactaacctgttgtttagttgccagtgagaattatttttattgaacttctaaactatctaacactagctggtctctggtctttctccaattagtatgaacaatatgcagcaaaacagccactttgtgtcactaacactcagagaatagacaaatgtgcttcaagcctcaaccattccaaaaagacaaactagtctgttacaggtagtgcaacagataaaagacttacagagcaaaaccatttggatttaaccgatttctcatctagactcggggcaaaatttcagaaacaaacatcactgcaaactgcacgtttatacgaatactttctaagttaagagatccttttaccattagcgcacaagcaaatgttatcatgaataacctatgaagtattcaaatgttaccttcaatcattaccacgcaagcgtcgcaggaataacctatgaactattcaaatgttgctaaccttcattgcttcagcagtgtagtgtgaggatttcagatctaagggcttgaaaggaaaagcattagggccatctccaactgaaggaggaccacctccaaatctaataggatcattgtcatttgtgctaccaaacatgaatagcgtccccgtggttggcgaggcctggccctgaagaattgcaaggaaacaaaaaacattgctgtcaggtacgaaatagcttcagtatcggagtttattaaaataattgtcctagttgatacctccttagttaatttacatatgaaataacatgatgattcaaaatacagatatgaatatgaagagagcaaacacatgaaattcctatgcagctttgacaacattaacagctattatattggagttccaagtagtacataagggggaagtttggacctgaagtgtgggggcatacattgccacataactatggaaagaacagagatttgatcatcatattcctgctttcaagaaaactttgaaatatttgaatggtacgatactatttttctgcttttgagaaaacaaacagaagcctgtttggaaagaagagactggatgctacaaaacaaggcagaactgatcatcatggaactgaagtagagctttcacgaactccctggagaggtcaaaagcttattaaagcaagcattcttgaactgccagtttagcatccatagacgaaagcaatactgattctggtaacgcgtccacaccctatcataacctagagaagagcacataccatggaattagaaacgaagactggtgactccagcagcgttgctgggctcaggccaggcgggatcgtgaggtagggcgatggaacttcgctcgagccgaat

SEQ ID NO: 512 - protein, 996 aa, Oryza sativa
  Orthologous to G175, G877
MTTATLDPPPPPLLIAGSLLDDDRDAGSAASSSPRWLPRARGSTVGSPPRRGGEERGGEAATRRKGNSSCPDDDDDCRNDEDDCRNDDDYRDDDVGATTDGGGDAAALLPMAMMTATTMAPMPVEAAVDGGGELSSAGEGGQRRVNLLPTKILSAYENHLFSQALACREDEWIIEKLAVIAARRSSFVSEESLCSVPAAALVSLAIAHLAFSPMLVYGVLDRLCSVCHLGEMEGDIAMEEWKDSNHRGADYLMTMPMQNFLADAFPPPELLEGEGGFEKHGLSVAVGSPPPTPPPPEDGCSPLPLTPQFGQKFGSGGGGGGSLADRRARGGFSNVARISVPYNQPAADVSSAGAPSPYVTIPPGLSPTTLLESPVFSNAMGQASPTTGKLHMLGGANDSNPIRFESPRIEEGSGAFSFKPLNLASSHYAAEEKTKSLPNNQHQSLPISVKTEATSIQTAQDEAAANQLMQPQFNGGKRSRAAPDNGGDGEGQPAEGDAKADSSSGAAAVAVVAAAAAAVAEDGYSWRKYGQKQVKHSEYPRSYYKCTHASCAVKKKVERSHEGHVTEIIYKGTHNHPKPAASRRPPVHPPPPSPATTTTTPLPPGDAQADHAPDGGGGSTPVGAGQAGAEWHNGGVVGGEGLVDATSSPSVPGELCESTASMQVHEGAAAAQLGESPEGVDVTSAVSDEVDRDDKATHVLPLAAAAADGESDELERKRRKLDSCATMDMSTASRAVREPRVVIQTTSEVDILDDGYRWRKYGQKVVKGNPNPRSYYKCTHPGCLVRKHVERASHDLKSVITTYEGKHNHEVPAARNSGHPAGSASPGGGAGSSSQPHGVGVGGRRPEVPSVQESLMRLGGGCGAAPFPPHFGLHLPPPPPRDPLAPMSNFPYSLGHAPSPALRGLPPPPPPPPSASALAVAGLGGVVEGLKYPMLAPPSVHSLLRHRQGGGMEAVVVPKAEVKQEAMRPAAAVAGAGRGAAVYQQAMSRVSLGNQL

SEQ ID NO: 513 - protein, 631 aa, Oryza sativa
  Orthologous to G175, G877
MSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQPISTASNDFTSPTIVKPKTSDSMLDNDDHPSPANDQEENASHKNEEYSSDLIITPAEDGYNWRKYGQMRVRTVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 514 - protein, 650 aa, Oryza sativa
  Orthologous to G175, G877
MSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQSSSTAAKDFTSATIVKPKTSDSMLDNDDHPSPANDQEENATNKNEEYSSDLIITPAEDGYNWRKYGQKQVKNSEHPRSYYKCTFTNCAVKKVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 515 - protein, 490 aa, nicotiana tabacum
  Orthologous to G175, G877
MQTQSEKGLHQSSDFPRFSAEKGVRSSNVTPESRNFQSVGSNMEHSPPLDEPQDEEIDQRVGGDPNVVGAPAEDGYNWRKYGQKQVKGSEYPRSYYKCTHPNCPVKKKVERSHEGHITEIIYKGAHNHPKPPPNRRSALGSTNSLGELQLDGAEQGVSGSNGDLGRANIQKAPDAGGLDWRNNNLDVTSSAHLGSAYCNGSASFPVQNNTQLESGGAVDVSSTFSNDEDEDDRGTHGSVSQGYDGEGDESESKRRKLETYSTDMSGATRAIREPRVVVQTTSEVDILDDGYRWRKYGQKVVKGNPNPRSYYKCTSAGCNVRKHVERASHDLKSVITTYEGKHNHDVPAARNSSHVNSGASNTLPAPVTAPPAQSHLHRPEPAQLQNAMARFDRQPSLGSFGPTPGYSYGINQQGLASLAMAGFHPNQSKSQQQIPVHSYLGQPRPMHDEGFMFPKEEPKAEPMSDPGLDLSNGSSIYQQFMSRSPLGPQM

SEQ ID NO: 516 - DNA, 964 bp, Glycine max
  Predicted polypeptide sequence is orthologous to G180
tgtcgagccgattcggctcgagaagaccaaagaaaaaaccaaaatcatcgtgtggtttttcaaggaccaaattcaaatcagtcataaaaagggggggtatggaaggaggagagagaggtgttaatcccaatatttatgagtctccaagtttcagtcgcaaacacccctcaagccatccaggaaatgggttttgttcaatttgaagaaaaccaggttcttagcttcttggcaccctctgctcaatcccaatcttctcagctctctcaatctctaaacgcctgcaacggtggcagcaatactgctgttgctgccgctaccacaaccgccaccgccaccacctccggatccggagcaacaattggtttcagccataatgaccttgtatccagaacttgttggtataataatgaacaggtgcgaacactggatcccaaagctgtcaatgatgaaaattgcaccggatatactagtgatggtggcaacaactcatggtggagaagtgctggctcagagaagaacacgatgaaagtgaggaggaagctgagggagccacggttttgtttccgaattcggcttgaggtagatgtgcttgatgatggttataaatggaggaagtatggtcagaaagttgtcaagaatagccttcacccaagaagctactaccgctgtacccataacaactgtagggtgaagaaaagagttgaacgactctctgaagattgtcgtatggtaataactacctatgaaggcagacacaaccactctccttgtgatgactcaaattcatcggaacatgaatgtttcacctctttttgaacaatgtcgtttcaataattattatgtattattaataattaattagctgtacgtgacattttcatgaaggatattgcattgtacttatattgttactatttgttattgagctcagtcactctttcatggaataaaaaaaaccaaaccc

SEQ ID NO: 517 - DNA, 609 bp, Glycine max
  Predicted polypeptide sequence is orthologous to G180
actgcaaagatcaagatatcttatacacgatattaaagtccatgacatccctacacatggtcatcttatctagctaaaaaataataatctatatattgacaacaaaaaaagcttccaaatatatggacaagataaaatatttttttgtggggtaatgtggttccctccaaataggaaaaatatggagaaagaaatctagggaaatgttttaacaagcatatcgatactgagagttctgaataatgacatgactgagttcatctttgaagcacactgaactctgtggcaaagtacatggcaatctatcaataatatcatagtgccttaattgagttcataattaaatacatgctgatcatcattataagcaaatgacattgaccttactagaaagaggtaaagcattcattctcggatgaatttgagtcgtcgcaaggggagtgattgtgtctaccttcataggtggttatcaccatacgacaatcctctgagagtcgttcaaccctcttcttcaccctacagttgttgtgggtgcaccggtaataacttcttggatgaaggctattatgacaactttctggccatatttcctccatttgtaaccatcac

SEQ ID NO: 518 - DNA, 589 bp, Oryza sativa
  Predicted polypeptide sequence is orthologous to G180
  misc_feature (544)..(544): n is a, c, g, or t
aagcttcctactacattttcattcataattagactgaatatcatgcaacgtgttgatcgatcggctagctgattgaccaggaaattaaatagcatccataagagttctaaaagctttcctagaacatttttattttacatcgatccctgctttttcgatttcccaattgcccccatcagatcagaaaacaataatccatcaccgatccatgtacataagcatgcgttcgtcaaaaggaggggaaggcccacctggcggggtggtccccggcggcgcccgggggggcgtcctcccttcaggggggggggggggggcggccctcgtagggggggatcaccatgcgggaattctccgacaggcggtccacccgcttttttacgcggcagttgttgggggtgcacctgtagtaactccttggggggaggctgttcttgacaaccttctggccatacttcctccacttggagccgggggccagacatccacattgttcctggtgtggaagcagaacctcggctccctcatcttcctcctcaccttcatnttccccttctccggccccttccaccatgaattaggcccatggcaa

SEQ ID NO: 519 - DNA, 509 bp, Zea mays
  Predicted polypeptide sequence is orthologous to G180
ccccttttcgagttttttttttttttttttttttttttttaagggaacaaatggcagtgtagctttatttgatacaacactacacatgaccgcctacaccgatggacgatggaccctctatcacatcggattacatgatgagtacactacgcatgcatgactagctagggttcatcgaccacacgctctgtcattcattcggcaagattgaagaccgtgatcaccaacaacatctatcgtggtcgtgggacgacagaacagatacggttcatcaaaaggagctgaagcaatcggtgtggtcgccggaggaagcgtcgtcgctgcagggagagtgcgtgtggcggccctcgtacgtggtcatcaccatgcggcagtccgtcgacagccgctccacccgtttcttcacgcggcagttgctgtgggtgcaccggaaatagctccttggatggaggctgttcttgacaaccttctgcccgtacttcctccacttgtagccatcatccagtaca

SEQ ID NO: 520 - DNA, 612 bp, Solanum tuberosum
  Predicted polypeptide sequence is orthologous to G180
gctgtgaacaacaacgaacaggtggaaacactagatcccaagggtataaatgacgaaaattgcagcggtaatgccagtgagggtaacaattcatggtggaagagttcatcttcagacaaaggaaaagtgaagataagaagaaagctaagagaaccaagattttgtttccaaacaaggagtgacattgatgttcttgatgatggatataaatggagaaaatatggccagaaagttgtcaagaatagccttcatcccaggagttactatcgatgtacgcatagtaattgtagagtgaagaagagagttgaaagattatcagaagattgtcgtatggtaataactacgtatgaaggtagacataaccattctccttgtgatgattctaactcttctgatcatgattgtttcacctctttctagaattaatattattattattattattattacatccaccaatattctgtatatagcacgtacctagctacccatatatattattgataattattatattatatagttttataaggaacaacaataacaatgtcacaacgaatcatatatatattgtgagctagctgcatgttgctatggtggattttatattcg

SEQ ID NO: 521 - protein, 344 aa, Oryza sativa
  Orthologous to G180
MVNFLKLSDIQSTDAESVDVGFISSVHKTTRKKGFTTCLLGRNSILFGKTTVVIGEKVEHCCRWSQEEEITGIAGVDSCYGEPGGVLSGRLGVNGEKGSTQFQISYGVSSAFGFRCDFGTGFITHGMGDHHGMPLPPPLQLPCHPKLLQMPFDQEDQPGIHGVMLSSDHCGLYPLPALPLSNSAAAAAATVALGKHSAAAGSMPNIGGAEEVATTVTKAGNESTTCNGSTTWWRGSTMAAAGEKGKMKIRRKMREPRFCFQTRSEVDVLDDGYKWRKYGQKVVKNSLHPRSYFRCTHSNCRVKKRVERLSTDCRMVITTYEGRHTHSPCDDNSSGEHTNCFSSF

SEQ ID NO: 522 - protein, 513 aa, Capsella rubella
  Orthologous to G183
MSDFDGNFNESTSCWAPPFSPSPRAILAMIDQAEDDGLDLISEMFPHTNLPRDHSAQSSEQRSGLGQRLAARVGFSPPPLDTENISPSAASLRSSTTVPPPVSAIPPGFIPSTLLQSPNMVTDSSQMIPAPSSDTNYGPQGMVETSGEGNAPTLIFNNDHPYQPVNADLPLLDVFDDVPTEESVYLPTYETDHVEPIGDSLVPNSFEHEFVGDANVNFISNEGTESVKDSESDDELDFDFEFEDEDEAEAEAEDNDEDKAEDEDEDNDEDGNEDEDEDDEEDENDEEEADHDDEADFDDAEPSSPKRRKFEASSNMIGATRTNKAQRVILQMESDEDNPEDGFRWRKYGQKVVKGNPNPRSYFKCTNNDCNVKKHVERGADNFKILVTSYDGIHNHPPPPARCRINSGPRNRSGTTTTTQNQSYRTDRLGRFPAPSSVITPMEMMPLSSFTPPLDMSKVYMTGLNKLPNFSVFQNPGYMYRNDEPMMNVVPNGSGIYGGIRHRLFAEFGVNLM

SEQ ID NO: 523 - DNA, 375 bp, Glycine max
  Predicted polypeptide sequence is orthologous to G188
ggaattccgcacgaggcaaaaaccaattaagggttctccatatccaaggaattactataggtgcagcagttccaaaggttgtatggctcgaaaacaagtcgaacggagtaacactgaacccgacatgttcgtcgttacgtacaccggagaccactcgcatccccggccaactcaccggaactcgctcgccggaagtacccggagtaagactctggtaaccaatccgccaccgtcacctgggtcactctcctgcttccaagccacccctttttcttcttcttcttcatcgccaccacactctccaacgtcgccggaggaagatccacggaaaccgccgatttagaacccgacccggatatggaaaccgacgggaac

SEQ ID NO: 524 - DNA, 723 bp, Zea mays
  Predicted polypeptide sequence is orthologous to G188
cattgggtacctcgaggccggccggtatctcctccgccactttcctccatttcccacacccccgccactccacgtcgtcgtcgtttgctgccgctgcgcaatggaggaggagcgctgcttcaacaactgggatctggacgccgtcgtccgcctgggctgccgccgccgcctctccccgccacggcagcccgacccgtttgcttcgcttctccctccgaccctgccgtcgccgtcgccgtcgccgccgcagaaggagaagcccgtggtgccagcgctggctaaaggaccagagccagagccatacgccgggtggcgctttcctaacctcggtgctggcggcgggcaagacggcgacgagctcatgagggccatgttagcagtccagccttccctgcctcagcctctgccaacgacaacgccaacgccaacgccaacgcttcccccggcagcaggagagcatcgacagtcgactgttacagccgtggacgtgccgctaccccaggtgcgccccgctccggccgccagagcgcagccgagcgggcggcaggtgcccggttccgtgccaagatccaagagaaggaagaaccaggtgaagaaggtggtctgccacgttccggcggacggctcgtcgtcggacatgtgggcgtggcgcaagtacggccagaagcccatcaagggctccccctacccaaggggatactaccggtgcagcagctcccaggg

SEQ ID NO: 525 - protein, 361 aa, Oryza sativa
  Orthologous to G188
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSAASAASAQPQPPPPSVVVVGAGGGGAEAAGLSPTTPLRTPSMEEDEEEEEEEELLVEDMEMAGEDELLFLNGGDDNAALDGTPMSSLFDIADEPFLPSPWTEPTAAGS

SEQ ID NO: 526 - protein, 386 aa, Oryza sativa
  Orthologous to G188
MDGDAWWYPGGGGGGGSNNWDLGAVVRFGCGGGRVSPAAALLGEAWEYDDDPFSSFLAPPMTAQQAALPAVWEEGDDGDAAWMAPLPGLQTGGGWGDQAPMVVDELCGALVVAPPPPPKQQEVLQVQQQPPPADNTQPTTYQQGSGGDGESTRAGGSRSARRKYAASAIYIVSVCFSDSCIMWIRSLADDRGVRHACRKKQTRKEVVRVAASGPAPDLWAWRKYGQKPIKGSPYPRGYYRCSSNKNCAARKQVERCRFDPSFLLLTYTGAHSGHDVPLHRNSLAGTTRHKPPPPPPLPSAADKSPATAAEAATASQSPGLSPTTPLRASSMELHGEDDAEAELQVEEDDMAIDDEDDDDVADETISTVPWGTPISDAIIAASYEWR

SEQ ID NO: 527 - DNA, 1683 bp, Glycine max
  Predicted polypeptide sequence is orthologous to G189
aaagtaaaaaaataaaattatattcggacataagggaggaacttactgataaaaaaattaaaaaagtattcttgaataaaattggttggcagtaatagaaaagagcgtattttccgtatgatgagagtgtgtgagcattcacatttgacggaaacagggtagcgtgagagtcgagtcacctgccgaaatcctatagcaccattttgaccaaggcgatatagctaacagctattcgcccccccatactttctttaattttctccttctcccatggtgtaattgctccaactatggccgtggacctcatgacgaccggttacacccgaaacgacaacatcagtagtttcacaaccaaagccgaggaaaatgccgtccaagaagccgcttctggtctagagagcgtcgagaagctcatcagactcctctcccaaacccaagcccaagcccaagcccaccatcaattcaacaacaacaatagctctagtaatgaaatcgccatcgccatggactgcaaagccgtcgctgacgtggcagtctccaagttccagaaggtcatttccctcctcggccgaacccgtaccggccacgccaggttccgacgcgcccctctccccaaccaacaccaacacacccaacctccctccgaaccgcccgttctccacgctaccccgctgcaccagatcccacctccctcccttcaccaaatccccaaaaccgagaaacacctcaacgattcatcgtctaagacgcttcatttctcatacccctccgccgttacttccttcgtctcctccctcaccggcgacgccgccgacaacaaacaaccatccccggcggccacgaccacgacctcccactttcagatcacgagcctctctcacgtgtcgtccgcggggaagcctccgctttcgtcttcctctttcaagagaaagtgcagctctgagaatttaggttctggaaagtgcggtagctcctctagccgctgtcattgttccaaaaagaggaaaatgaggttgaagagggtagtgagggtaccagctataagcttgaagatggctgatattccaccagatgattattcttggaggaaatatggacagaaaccaattaaaggatcgcctcatccaaggggttactacaagtgcagtagtgtgagagggtgtccagcgcgaaaacatgtggaaagagctttggatgatccagctatgctggtggtaacatacgagggagagcacaatcacactgtctctgctgccgatgctactaatctcattctagaatcgtcttgaaattcgtagccaaaatcatcttttttccgtgacaaggtttagaaacgcaagccatcatttaatcaacgttacaagttttcaacggggtgcaattatggcgtgttgaattgaattgcaactttactactctagtcagtcaggggggcattaaaatctccaaagaaattagtagtgggtgttgttccctttccctgtacactattggattcttttttatctttattttttttttctcgttctcttcaaggctaaatggaacattgtgaatccgttgcatcattaaaaaaaatattgtcaaggatgattgtgatggtggatttggtaagggatttgaatctcgatttttttttattttttttttataaaaaaagcaagtgggtgttggttttaaaaa

SEQ ID NO: 528 - protein, 350 aa, nicotiana tabacum
  Orthologous to G189
MAVELMTSGYSRRDSFSTKMEENAVQEAATAGLQSVEKLIRLLSQSHQNQQQQQQKLDQNPSVSADYTAVADVAVNKFKKFISLLDKNRTGHARFRKGPISTPLPPPPKPQQQRLNQNSIKNQNLQIEETEKPQINTPKIYCPTPIQRLPPLPHNHLQLVKNGSIERKESSTTINFASASPANSFMSSLTGETESLQQSLSSGFQITNLSTVSSAGRPPLSTSSFKRKCSSMDDTALKCNSAGGSSGRCHCPKKRKSRVKRVVRVPAISMKMADIPPDDYSWRKYGQKPIKGSPHPRGYYKCSSVRGCPARKHVERALDDPTMLIVTYEGEHNHSHSITESPAAHVLESS

SEQ ID NO: 529 - DNA, 1581 bp, Glycine max
  Predicted polypeptide sequence is orthologous to G192
gtcgacccacgcgtccgcccacgcgtccgtacggctgcgagaagacgacagaaggggatacctctctgtagcgaaaagtcagcgccttcttttgtctctctctctcaaaaaaaaaattccacacactgcagagtttgtctctctatggcggaagattgggatctacatgcggtggttagaggctgctccaccgttacatcatcctcagtgtcttcttcttcatctccttcttcctctggttttgcctcttcttacttccaccctgaagctgcagtttcttcttcttcttcttcctattctggcttcaacatcttcaagggtgaacaaggaataagccaagttttgtcgctctctgcgtacccctttgaggcaaggagctccattgaggaattgcatgagctttgcaaacctttcttctccaaatctcagcctctaacgttgcaagcctcttcacctttgtcctcactctcttcctattcctctgcgccacccaaatctgtttcaacgcaagagaaacaacaacagaggagcaagcaggcacatgctgtcaccaccccacgatctaaaagaagaaagaaccagcttaagaaagtttgtcaagtgccagttgagaatctctcctcagacatatgggcatggaggaaatatggccagaaacccataaaggggtctccatatccaagggggtactatagatgtagcagctcaaaggggtgtttggcaaggaaacaggttgaaagaaacagatcagacccaacaatgtttatagtgacttacactgctgagcacaaccaccctgctcctactcacagaaactctcttgctggctccacacgtcagaagccattggtacctcaaacagccaccaccactgaagaagactctgacaagagcaagagcctcacaaaacccacttcccctgccacctcaggggcagaagaagaggctccaacaccatcacaaggggaaaagtctgagagcagagaagagaaagaggatgtgatggatgatgaggaagaagatgaatttggcttgtctgatatggtgctttcagatgacttctttgaaagtttggatgaactgagccaacttacggctccttctgttgtcactggagactgtttcagtgaccccttttcagcaattgcaatcccttcttgggtggctagtggtgctgctactgctagtgggtgtagatgattctttcgggcaaatcatcacaatgcttttcattgatgacaatagggaccttttctttttggtttttgtttgtagaggaaatggaacattttggaggaatctttactaacaatggtttgtggatgggaggaaaagttttccttagtagagtagtagtgactagtaaggtagatcaagcattaatcttgttaaaaatcaatgattattattaggcattcatagttttattatttatgtcatcatacctatgtgttaatgtaaaaacaatttattttagtaagctttttgtatgctccttgagttgtggttgagttcattgtatttgacattggttttgtgatataaattggcaaaagcacttttgggttgacttgtggccgc

SEQ ID NO: 530 - protein, 336 aa, Oryza sativa
  Orthologous to G192
MEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 531 - DNA, 1258 bp, Glycine max
  Predicted polypeptide sequence is orthologous to G196
gctttgctattatctcttcccttgtccttcttcctactatactatattttctctctctaatcaatcatagttctgatcttcatacacttaccccggaaacctccatttctcagatcaagcttgcacgaagacattaaaaaatagaaatacatacatagctatggacaataatacttgtgcctcctcccaacttgagtcagaagaagcatcttttgagcacaaatcagaaactcaaacatcaaagaaaaggaaaatggttgagaaaacagttgtggcagtgaggacaggagagaatgttggcaagctgaagaatgaagggctaccttcggatttttggtcttggaggaaatatggacaaaaaccgatcaaagggtctccatatccaaggggctattacaagtgcagcacatccaaaggttgttccgccaaaaagcaagtagagagatgccgaactgatgcttcaatgctcataatcacatatacctctacacataaccatccatgccccactgccatcaccacaaattcaccccaacaaccaaaagaattatccgaatccgaaaccacccaagacctctcagctaccacaaaggaggaagaccaagaacatatagaactagaagaagagcaaagggataataataagcccagtgatgaagttacaaatgaagaaaattttcattacttgcaatctcctatacgttgctccggccaagacatcattatagaacaagaagatcctttcaaactaaacacggagaaaagccatgatcgaatggatctcctcttagaggaagagcctctttgttttgcacagctcaagaacttgtctgcttccaaaaacgaagaacttgactttttcgatgagcttgaggagttacccatgtcttcatctttgttgcactttacgaggaacattttttccgatgaaaggattcccgttggcccttcttgattctagtgttgttttctcggtgcttgctatgctagtgacagtgtatgtattgttttcatccatgttatatatccattaatttcagctagtttttcaattcggaacttttctttttcttttgtaccctttatttatatgattatatcctatacttttaattaattattggttcacaactaagcatagttcatcactttggcgtgagcagggttagtgtgtagacaaaatcatcagctcttgcaattaaaattaaagaatgatggtttggctcacaatcaatggtatattgttcattctgtattc

SEQ ID NO: 532 - DNA, 1119 bp, Zea mays
  Predicted polypeptide sequence is orthologous to G196
actgctcatatatccgcctcccctcgccctccctctctctctctctctcactcacaaacaaacaaacaaacaagcctggatcgagcgaattcagccgagcttcagaaacccttgcaagctcgtagcaacttctctcaaccttattcggctttcttctagctatataacgaccctaaattagtctgcttcattcggttcttgcgaattgccaagaccgaaagaacagcttattactcttctgttagaaagactcgaagaggccggccgagatagactatcagctagctagagggagctaactacctacctagctagccatgtgtgactacttcctgcaaaggatggatcagggcgaccaccaccaccaccaccaggccggagacctcacggacgtcgtccgagccggcggcggcgcgatgcatcaggcagctgtcgcggagctctcctccgcggacacggggtggcagctcccggccgagccagcagctggagcaagcctcttcccgccaccccagccctcgtcgtcggactgcgacggcttcgcggacgcgttcgccggcctcccggacccgtttgccagcgactttcgcacctcctcctcctccctccggcgtgggccttggccctgccgacttcttcgacttcgaggcgcctgctgctgctgctgctgccggtggcggcgctcgaagaggcggaggcgtactggcgggcgcgcagatgcccgcgctgtcgccgagagagatacggccgtacccggtgacgatgggcggcgacaccgtgaagatcggcgcgccgacgatgatgcccgggctggccgttgggccgccctgctgtgcgttcgacgctgtcgccgggatgcagatgccgagcgcgcacgcgcacggtgaggggatgaagcgcaagaaaaaccaggcaaggaaggtggtctgcatcccagctcctgcaccatgatcgggaggaggaaggaccactggggagggtgttcgttctgatctctgggcttggaggaagtatggacagaagcctattaaaggagcacgctacccaagagggggctacagatgcagcagctctaaaggatggccggcgcggaagcaagtggagcgcaagcgaaccgac

SEQ ID NO: 533 - DNA, 780 bp, Zea mays
  Predicted polypeptide sequence is orthologous to G196
ttgggtacctcgaggccggccggggccttgctcagcctcagccctcaggcctcagccagcgtgcgcgcccacaacccctcacgtcgtccccgccaatcacaccgcacgaaccgaggacgacgggacaccaccgtcaccgcgacgtagtagtagtactacatgcatagcatagcctcgtggagtcgtggtagtagtagtttagttttgctcgcttccacaccgcaccgccgttcccttttttatatcccgcggatgcgcctgcctctgcctcggggtcgggggggcagctggtgacatcggattcggatcaggccgagaagatcgaactgctccgatccggcgcttaatttctctctctctctctcgggctagctgcccgggcaaatggacgccgagtggagcggcgacgagagcaaggctggcgctgcgggcggagtttcgtcggctgattgcccaggttcgccaccgccggtgtcgccggcgccaccgtcgacgtcgccagctgctaccggtgccgggaggaggcggtcggcgaacaagcgggtggtcaccgtgccgctggcggacgtcagtggcccacggcccaagggcgtcggcgagggcaacacgccgacggacgcgtgggcgtggcgcaagtacggccagaagcccatcaagggctcgccttttccgagggcttactacaggtgcagcagctccaaggggtgcccggccaggaagcaggtggagcggagccgggcggagccggacaaggtgatcgtcacgtactcgttcgagcac

SEQ ID NO: 534 - protein, 514 aa, Oryza sativa
  Orthologous to G196
MPPCVWGSHTPLSLLSPPAAWAGERMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELESDPMSLIFSKEYMEAKPSGGDHAQEKAMAKELDPFDMLDWSTTTNSSAGSSFEQGKRG

SEQ ID NO: 535 - protein, 299 aa, Oryza sativa
  Orthologous to G196
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERNRADPTMLVVTYTFDHNHQWPTHGNAFAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 536 - protein, 299 aa, Oryza sativa
  Orthologous to G196
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 537 - protein, 299 aa, Oryza sativa; identical to SEQ ID NO: 536
  Orthologous to G196

SEQ ID NO: 538 - DNA, 1061 bp, Glycine max
  Predicted polypeptide sequence is orthologous to G211
tttttttttttgtagttaaattaataatatttaaaatttaaaaaatattctaaataaatgatactaatctgaggaataaataatacaatatgttcacgtgctagcaggagcaaacttaatttgttttatttgttccaaccatatattttcaccattatttgtacgtttacaccaataaagattgagcaaaagaatctaattcatctggtttctcctcaacattcaagagctgcaagtactcttcatagagcttttctagcgtatcatgatcatcagtgtgaacatcagaatagcattcctcgtaagaggcagtattgttgactaggtcatggtcttcaccaaagaatatttcaatcccaccattgtctccaatattgtcacttaccccccaaaccatgttcacctcttttgtttctgcttctgggctttgaactttctcttggcttgttgatgcagtcgtagctgaattcgaatcaagggttaaggtgctatccgttctgggtatacatgacgataaagccttaaccctgattggttttggtagataaactaaggtcttctctgaccctttgttattctcagtactcttttgcttattcttctttttacccttcttcttctctggtgcctcagttaacttgtcgtgtgtctttggatcggttccttgatttctcagcttcttgctgagatgggtattccagtagttcttaatctcattatctgttcgtcctggtaatctccccgcgatgagggaccatctatttcctaaaagcgaatgcattctaactataagatcatcttcttctggggttatgtttcctctctttatatcgggtctcagatagttcatccatctcagtcggcaactttttccgcatctaagaagcccggctctttttggtagtgatctccactggccttctccatgagtttgaatatacttagtgagcaatgcatcttctcgaggagtccatggacctctatgcaaccctactttagagcaacaaggagctcttcccatcttcagaagcttctctagcgaactctgaaaggaagcagag

SEQ ID NO: 539 - DNA, 1014 bp, Oryza sativa
  Predicted polypeptide sequence is orthologous to G211
tctgcgaggaggccaagctagtcgcgcgcaaattaatcgccgatcgatcctacgatgaagcggaagcggccggcggcgctgcgcggcggggaggaggcggcggcggcggcgctgaagcgtgggccgtggacgcccgaggaggacgaggtgctggcgcggttcgtggcgcgggaggggtgcgaccggtggcgcacgctgccgcggcgcgcgggcctgctgcgctgcggcaagagctgccgcctccggtggatgaactacctccgccccgacatcaagcgctgccccatcgccgacgacgaggaggacctcatcctccgcctccaccgcctcctcggcaaccggtggtcgctgatcgccgggaggttgccggggcgcacggacaacgagatcaagaactactggaactcgcatctcagcaagaagctcatcgcgcagggcatcgacccgcggacgcacaagccgctgacggccgccgccgatcactccaacgccgccgctgccgtcgccgccacttcttacaagaaggcggtgccggccaagccgccgaggacggcatcctcgccggccgctggcattgagtgcagcgacgatcgtgcccgaccggccgacggtggcggtgacttcgcagcgatggtgagcgccgccgatgccgagggattcgaaggaggatttggcgatcagttctgtgccgaggatgcagttcatggtggcttcgacatgggttccgcttccgccatggtgggtgacgacgacttctcctcgtttcttgattctctgatcaacgacgagcagttaggcgatctcttcgtcgtcgagggcaacgatcacgagcatggcaatggtgagattggtcatggagacgtcatggaatccaaacagtaatctttcgggagattgatcagggaataagttgaccatgagaaaacatgtaagaacagcttgtctgctgagtcatgaccggtgatgtgtatgtgatggaagaaaacgtatgtacgacttaatgcttgcacctat

SEQ ID NO: 540 - protein, 275 aa, Oryza sativa
  Orthologous to G211
MKRKRPAALRGGEEAAAAALKRGPWTPEEDEVLARFVAREGCDRWRTLPRRAGLLRCGKSCRLRWMNYLRPDIKRCPIADDEEDLILRLHRLLGNRWSLIAGRLPGRTDNEIKNYWNSHLSKKLIAQGIDPRTHKPLTAAADHSNAAAAVAATSYKKAVPAKPPRTASSPAAGIECSDDRARPADGGGDFAAMVSAADAEGFEGGFGDQFCAEDAVHGGFDMGSASAMVGDDDFSSFLDSLINDEQLGDLFVVEGNDHEHGNGEIGHGDVMESKQ

SEQ ID NO: 541 - DNA, 3245 bp, Glycine max
  Predicted polypeptide sequence is orthologous to G214, G680
acactttcgggcgtagtgtgtgtgtagcagtttctggttctgtttttggtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggtgctgtcagtgctcacagcgcgacgctgttgagttgaaatttcgctggttttgagttgctttgtgactaattttttttctcggcaaccaaacaggaggattcaaaatttgcactgattaattagtaaagttttggcgctctcgagttcgttttggtgaggattctgattaaggaaaattttcttttattcattcggaggagaagcgtctcaaactctctctctttctccctcgtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcagccactttccacgttttacatatgaactattttttctttt

SEQ ID NO: 542 - DNA, 614 bp, Glycine max
  Predicted polypeptide sequence is orthologous to G214, G680
gcaaaacctctcttcttctgattgattcacttctcgatttttctgttttcgttttcattttcggtttccgatctaatatcgatgcgattcgccattgccggaaaatgagtcctccggcgagtgtccggtgatgatcgctctcgagagaggctgttgttgttgttcttcttcgacgtcatggttttgttctgagattctgctcactttcaccaaaacggctttactatttaccgcgtttcgctttcgtgtcaccaaaaataatgaaaggaggtgttccctgtatccactccttgtcagggaagatctgaagcagcgctagctgctcacgtcctgtaatggacgcatactcctccggcgaagaagtggttgttaagacgagaaaaccatatacaatcactaagcaaagggaacgatggacagaggaggagcataataggtttcttgaagctttgaaactacacgggcgagcatggcagcgcatagaagagcatataggaacaaagactgccgtgcatatcaggagtcacgcacaaaagttctttacaaagctggagaaagaggccctttgtaagggtgttccaattggaaaggctcttgatttagacattccccct

SEQ ID NO: 543 - DNA, 3130 bp, Glycine max
  Predicted polypeptide sequence is orthologous to G214, G680
gctcgaggcttctgctggctttgttgtagttgaagtcgctcccctcattcttctttcgttgctacttctactgtttcttcctccgatccctcattgccgcaaatgactcctcctgctagtgttaggtgaattccctcgcttcacatgcatgatcgcaccttcaactctcttcttcttcttcttctccatggctttttttcaaggttttggcgccgtggagttcgttttgtagcatcaccgtatcatcagcttcagcttgctttcaccaaaacggctttactatttggtgtgttccatgtcacaaaaaacgaaaggagatattccttttacccactcctcgtcagggaagatctgaagcagcgctagcagcacacgtcctctaatggacgccgactcctctggagaagaagtggttattaaaacaagaaaaccatatactatcacaaagcaaagagaacgatggacagaggaggaacataacagatttctagaagccttgaagctatacgggcgagcatggcagcgcatagaagagcatataggaacaaagactgctgtacaaatcaggagtcatgctcagaaattctttacaaagttggagaaagaggcctttgtaaaaggtgttccaataggacaagctcttgatatagacatcccccctccacggccaaaaagaaaaccaagcaatccttatccccggaagaccaatgttggtgccccaacattacatagcgaagcaaggcatggaaagcctctcatttcaattgtatcttcacttggtaaacaagcactgggcttggagaaagaaccccttccagagaagcatgatgtcgacctaaggccatcgactgtaaaagaaaataaggaccgaagctgctcaaacgtatttaccattatccaagaggcaccctgttcatctgtatcttccgccaacaagaattcaacatcaatattagtgccgctgagaaattcatgtgccctaagggagtttataccttcggtgaaagaggtgataactcgagatgaaaccaacgaatcttttgttactgatgagcttgaaaatcagaagttggagatagatgatggcaagcacactcaaaagtctaatggcacttgtaaagtctctaagtcggagaattctggtgcttcagaattggttcaaactgagaaaacagatggtcgtaattgtgcattaacaattgatggggtgccaggcaatcagaattacccaagacatgtccctgtgcacgttgttgatgggaaccttggaactagtactcaaaatctatccccagatatggtgtttcaagactccatatttcagccgaaaggaggggttaatgggcaacctaaccttgtcaccatttctgctacatcacacataagtgaaagtcaaaacaacaccgcacggtcctctattcatcaatcatttcctccttgtcctcctttcgcacaggatgattatcattcatttcttcacatgtcctccacattttcaagtcttattgtctctaccttgctgcaaaaccctgcagcccatgctgcagcgagttttgctgctacattttggccatatgcaaatgcagaaacttctgcagattctcccgtgtgcactccagattttccatcaagacaaattggctcgcctccaagtgtgacagctattgcagctgctacagtagctgctgcaactgcatggtgggctgcccatggactgcttcctttatgtggtccactccatacagcttttgcctgtcctcctgcatcagcaactacagttccatcaatgattattgatgaatcaccacaaaaaacagaacgaggagagattaaaccacaaaatcctcctctgcaagatcagataccggatccagaacactcggaagctcaacattcagctcctaagtcaccagctgtttcttcatccaaatctgaggataggggagatgccaatttagatacttcaccaaaggctactaatcatgagatgaaccaagcaatttctgagaaccccgattccaacaaaatgaagggcagaaaacctgtagaccgttcctcatgtggttccaacacaacctctagcagtgaagagactgagttactagagaaggatgagaaagaaaaggaagagcccaaaacacctgatgcgaacgttttagataccgagcttagtaatcgtcgaagtagaagcattagcaaccttactgattcttggaaggaggtctctgaagaggggcgtgcttgcctttcaggctctattctccagagaggtgttgccacaaagcttttcacctactcatcatttgataaatgaggataatcagatagacagcatcaaggataacgagctaaacacagactacaaagatgaagaccttgaaagcaagaaatgcagttctatttgtgatggggtgcagaaaaatctgctatttgtcaaagataacaatgaggaggagggactgctaaccataggtcttggaccaggaaagctaaagactcgtcgaacagggtttaaaccttacaaaagatgttcggtagaggccaatgaaaacaggatcggaacagcctgcatccaaggtgaagaaaaaggtcctaagagaatacgcttgaatggggaggcttcaacttgatgcttgatatatccatgcaaccacacaaagaaaatctctagttttgcatatattatttcttagtttccttgttcattgtctgtattgcttattttctaattctgcagctcacgaaacttgtcgtgtaggtgtgtgtaccatattaaattactacattacactctttttactttcttggcctgatgttactgcagttaaaaactccgctaaaatagacttagacaagaaacattaagtaccgtttgagcatttgatcatttaagtaatttatgatgcttcattcagtcaaaaaaaaaaaggaaaaaagggactaattctctctgctggtgccacattctgcactacgtggtatgcagatcaccctcacgactattactgttaacactattgtgctgaacgtggacacgctcgacactatggacgatatgatggagaaaatgcaagacatcgaaggagtccaaccgaagctgcttatgcttgtcttacctgtcgaagatcta

SEQ ID NO: 544 - DNA, 3062 bp, Glycine max
  Predicted polypeptide sequence is orthologous to G214, G680
gtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggttttggcgctctcgagttcgttttgtactgttttacgtgtgacatgtgaattggaatgcttattccagcttatacaaaacagagacggatctctttcctattgtttctcgctttgtttcttttgtttgcaagtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgctaagactagaaaaccatatacaatcactaagcaaagggaacgatggacagaggaggagcataataggtttctagaagctttgaaactacacgggcgaccatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccatgcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcaaaaaaa

SEQ ID NO: 545 - DNA, 1430 bp, Oryza sativa
  Predicted polypeptide sequence is orthologous to G214, G680
cgtcgaattttggatccacaggaagtgttggatggatgcattgattcatagttccgctggctcctcccatttgatcacttgtttgatcaggatggcttccttcagttccagtggcttgaaagccagtaaccccatttctgtccatttggtagtgtgaagcttttgcagcagaccaatccacatatgttgtctccacagagtttgattttggcttaaattgttggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagccccctggatgcaccatgatttgaagagcttttgttaactgaagaaaatgatgccgatgggacttctcgaaagagattaagaacttcggagcaacttcctttttcagatatctcctttctttgaagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgccaggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctatatcacgccaacactcccagtatttcaaatttgtgcggccaaccacaaaagagcagccaaattagtgttacaaacccaaggtagaacctaaagaattcacaattctacttgtgaattggacttgggtcaaaatcttcaagaggatcaattccactcacctacttgaattgatccaattgcagtcaatctactaaatcctcagctgcagttggtctgtgcacacaaaaaccaagtcagcagagttcacccttgctcctttcgttatcttcaactctagaatcagattaaaactcgcagttctcac

SEQ ID NO: 546 - DNA, 1078 bp, Oryza sativa
  Predicted polypeptide sequence is orthologous to G214, G680
ggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagcccgctggatgcaccatgatttgaagagcttttgttaactgaagaaaatgatgccgatgggacttctcgaaagagattaagaacttcggagcaacttcctttttcagatatctcctttctttgaagtttctgaatgtaagtgagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgcccggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctacttgaattgatccaattgcagtcaatctgaacagtggggccacatcattttaaattcataagcatctccaaatggtcaaactactaaatcctcagctgcagttggtctgtgcacacaaaaaccaagtcagcagagttcacccttgctcctttcgtc

SEQ ID NO: 547 - DNA, 618 bp, Zea mays
  Predicted polypeptide sequence is orthologous to G214, G680
gttgcataatttgaaaacttgcgagttttaatatgattctagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagttgctccatagagcatgttgggacaaagacagccgtgcagatcagaagtcacgctcaaaagttcttcactaagttggaaaaggaagctatgaacaatggtacttctccggggcaagcgcatgacattgacatacctccacc

SEQ ID NO: 548 - DNA, 2815 bp, Zea mays
  Predicted polypeptide sequence is orthologous to G214, G680
tctttgggtctgggggcacaaatttgaagtgtgggggagtgctggtgtgatatagaggtctaggaggagatatgaggtactacttgcgtcaggtccagcgtttggttggagatatggaaggaggagctctcttgtttatagacgacctcaactccaagtgacaaagcgaacagctgttgaacgtttgccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcattccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccaccttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttttggtcaaaatgtattttccttatgttttatatttttggaaaggaaaataattgaaatattatttattttgaaggctcacgcaaaagtttatttgatcaaggtgtaggggaataggctgagcgagagggtgaacattatgactaatatagggcagaaaatatttgaccattgtcatgtttgctgttgctagaagattgtgtagagaaagtactcacataaatgtttcacttctatttt

SEQ ID NO: 549 - DNA, 1038 bp, Zea mays
  Predicted polypeptide sequence is orthologous to G214, G680
  misc_feature (13)..(13): n is a, c, g, or t
  misc_feature (33)..(33): n is a, c, g, or t
  misc_feature (1022)..(1022): n is a, c, g, or t
tcgccgactcggnagtcgcggcgaggagccganaaccttctcattcatcttcctcttccatccatcctgcctgcctgcttgcctccgtattccagctagatctccgggcagccgattggccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagagtaaggacaattggatcaatttaagtaggtctgggcacacaaatttgaactattaacgcattgggagtgcttgtccgtagtaattggatcaattcaagtagaggtctaggaggagctatgaggtactacttccgtcaggtccagcgtttggttggagatatggaaggaggagctctcttgtttatagacgacctcaactccaagtgacaaagcgaacagctgttgaacgtttcccgtctatttctgtttctttttgccggatttggagatggaggtgaattcctctggcgaggaaacggtggtaaaggtaaggaagccgtacacaataaccaagcagcgggagcggtggacagaggctgaacacaaacatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaagnaaggagttgtctgaaa

SEQ ID NO: 550 - DNA, 821 bp, Glycine max
  Predicted polypeptide sequence is orthologous to G226, G682
  misc_feature (804)..(804): n is a, c, g, or t
  misc_feature (806)..(812): n is a, c, g, or t
  misc_feature (815)..(818): n is a, c, g, or t
gaagctcggaatcggtcgaggcagtctctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttcttttttttttttggtctctgtgaattattttgtatatttttagtctcttgtttatttttttgttatcaatatcagtttcttaaattttttatacttttttctgccatttttaatctctttgatagactgatatttatgacgaaaaaattaataaatgatttgaaatagtaaaaaaatgaaatttcattagagttaaaaatatatttaaccctataaattctgttctaaatcttacagaattatcgtcaattgtatttcttgtcgttgagatgagaattaatgtacactttcgttaatcggtcatgagtatctcatatagaagctatggaaaagtttgcatgttggtttgtataaaagaaaaaggtgtgactagtcggtcaattgangnnnnnnnagnnnnata

SEQ ID NO: 551 - DNA, 917 bp, Glycine max
  Predicted polypeptide sequence is orthologous to G226
ggcatgcaagaaaagttccgcttgcaaattcaatgctataggccaaggccaagcaagttgtagccacatgacaattgttgaaccattagcaagaagctaaatgaaccagaaatacacatgcacatgcaggtggtctgcattaagtacatactgcccttgacgtacatcaacagatctgaatcatagattgccttaaaacacttgggaacattacaaagataaattaagtagcattatacataagggcttttagaatggcatgcccctttttggttaccctaaaatgcaaatataagtacccatatataataggatcaacttccatttcatatcccgcaaattaagtcactgtataatgagttgcaggcacccaaaattgtcttgcttcgtttaatttctgccacttcattggctagtcgaaaatcttgaagtccaatatttctctatttcttctgcagttcttccaggaattcttccagcaatcaaagaccacctttctccaaccagattatacaccatggcaataaggatttcctcagcttcagaaaattcaacatcagaaacttggcttgatttctctacaaaacacaaatcaattctgtatgtttatgtggataacaacgagtgagccaatcattgaaataaaactgcatagagatcgatcatcattgtgtactctcaagtttgtaggtgcatgttatattataatattatagacccatcaaaaactaatctcaagatatattcttatctagctatcagaattgattattgaagacaaatggattttaaaagggtaccaatagaatcagaagaaacattattatcaaaggagcgatctatgtcagccattgcaataacaagttctcaaaagagctttgaaagtttcagtcttgtatattgaagatgcctggtgc

SEQ ID NO: 552 - DNA, 735 bp, Glycine max
  Predicted polypeptide sequence is orthologous to G226, G682
aaagatgccttacgaatacacttaatgtatgtgtatacatgcaaagaaaaaatccgcttccaaatccaatgctttaggccaaggcaaagcttgttgtaaccattagcaagaaggctaaatgaaccagaaatacacatgcccatgcaggggatctgcattaattaagtacatactgttcttgccatgatcgaacagatctgaatcatagattgcctaaaacacttgggaacattacaaagataaaattaagtaacattaaacataagggcttttaaaatggcatgcccctttttgttggttaccgcaaaatgcaaatataagtccccatatgattaataggatcaatttccatttcatatccccacaaagtcactgtaatgacttgtaggcaccaaaaatttccttgcttcgttttctgccaccgatcattggctagtcgaaaatcttgaagtccaatatttctctatctcttctgcagttcttccaggaattcttccagcaatcaaagaccacctctccccaaccagattatacaccatggcaataaggatttcctcagcttcagaaaattcaacatctgaaacttggcttgatttctcagtagaaacagcagaaacattattatcaaaggagcgatctatgtcagccattgcaataacaagttctcaaaagagctttgaaagtttcagtgttgtatattgcccacgcgacacgcccacgcgtccgcgggcgcgt

SEQ ID NO: 553 - DNA, 728 bp, Glycine max
  Predicted polypeptide sequence is orthologous to G226, G682
tcgggattcttctctgtttcactccctccctgccacccaatcttcacgagcaaccatgttgtcctagcaatgaccttcttctattaataccacccaaataaccttgtccgggaaaccacttaattctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactacgattggtgttcagtctaggacgagcaagaagattttgggtgcaagattagtgtgattttgtgggacataaaaactgaattaaagttggcatagtttataggtatttgtattggctataaaaaaagaagtggggcagcaactatagaagctggtttgtgttatatttctccatcttgaaatgttccttggtgtgatattttccatcttgaaatgttccttggtgattggtcttttctgaattgtacttagtgctgttcatcttcgtgtatcttattcatttaccattttggctttttatcttgcgtctgaaatctgtattggaaatgagaattaattagagac

SEQ ID NO: 554 - DNA, 680 bp, Glycine max
  Predicted polypeptide sequence is orthologous to G226, G682
ttcgggatcgcgcccttaatttttccacgccttcaatacaccacactcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactaccattggtggtcagtctaggatgagcaagaagattttgggtgcaagattagtgggattttgtggggcataaaaactggattaaaggtggccctattttatagggatttggatttggattggctataaaaaaaaaaagtggggcagcaactatagaagctgggttggggaatattttccatcctgaaatggtgcccggtgggatattttccatcttggaatggtacttggtgggtgggcttatctgaattggacttattgatggccaccttcgtgtatttttcttattcatttaccattttgggtttttatcttgtgtctgcaatctgtattggaagagtccaactatggaaatgagaattaattagagat

SEQ ID NO: 555 - DNA, 652 bp, Oryza sativa
  Predicted polypeptide sequence is orthologous to G226, G682
gagaaaagttcaaagcattttttcgtctattcacataaaggtttaagacggggtgtatggtgacccaactctgatgtacctttctttacgtttcgatgaagctcaagattcgatgaaccatggtctttcacatttggtgaaattgggcataggtttggactatctctttcgatgttctttaggaatatctcacgtgtgttctttttattttgggagcaatgtcagttagaccacaactattgcaaagtattacaaggtcacccgtggacattatttgtttagcatcaaaactgtcacttcataactgattacatccttctgggaaatgtttccaaacaccaaatttccccttcagtgtactgctcttttgctgttcttccagggattcttccagctataagttcccacctgttcccaacaagcctgtgcattctgaaaacgagatcttcctcttcttccgtgaaatgaacaaaattctgtgcagtgttattaacttcttttgtttcacaaccatcactggttttggaattctttccctggctaccactgctgctatccattaggcgtgaaaaactccaatgaaatgccgagttgagatcttgtgctagctaagatcctcagacccttgttatgaccttatgttttctagggc

SEQ ID NO: 556 - DNA, 895 bp, Zea mays
  Predicted polypeptide sequence is orthologous to G226, G682
  misc_feature (819)..(819): n is a, c, g, or t
attgggaccattgggtacctcgaggccggccgggaccttgtccagggactcaataggccagtaggcgattacaagggtggaagaaacatctagccttaacattccaggctacagcctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaaaaaaaaaaaaaaaaaagcggccaacttcagtaacgcagcttctcatggaggatgtgagctgttaccagcggtctttagatttctccccggcctgtatggaaaagaaagattcagcatcagaaacaaattcttaactagtcaactaccagcgaaagttgtccacaagtaatttgaggagcatggcgctcacaatggctagcgccctggacatccaggncattaacctatactggtcaggttcgttctttctgaggctttgaccacccggatcgtatatgacatgtgttttgcat

SEQ ID NO: 557 - DNA, 1372 bp, Zea mays
  Predicted polypeptide sequence is orthologous to G226, G682
ccggccgggatcttgtccagggactcaatagatcagtaggcgattacaagggtggaagaaacatctagccttaacgttccaggctactgcctaacccctctaatggatagcagcagtggtagccaggacaagaaattcagagacaatgatcgccctgaagcaaaaggttcaccattttcttgctttgctttgttttgctttacctttgctcgctgcctcttctgaagtctgaacttgtagctttttagttagtaccattgtgttcaagataatagctcatatgactttgttatttcaagagatctcacaccaacatatattctaatcctccgtgctttattttctctccgtcccaaaaagaatacaattctagcacagtgttatgtcatagtatcgtaaatttgatcaattatagataaaaaaagtaccaatatctatgataacaaataaatacgattagattattataagatgtgttttcataataaatttatttggagccataaatctaaatactattcactaaaaacgtgatcaaacatgaaccaatttagccggcatgtaacccatagttgcattctttttgggacagagtgaatacatgaaaactaaaacagatggtaaacagtgaccatttaggatacactataactgacaaaaactgtggggacaaacaggacgccatgtgatttaccatctgaccagcctaatgaagtgcagaggatttagccccttcgaaatagggggaaattattcctaggaaaattgcaaattctcttggcgaacataggattggcaaaccataatatatttctatatgggttggttaatggttttttttttcttactctcgtgatcaactatatcctttcacaattattgcagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaacttcacttgtgtaccggcagaaaacttcagtaacgcagcttctcatggaggatgtgagctgttaccagcggtcttt

SEQ ID NO: 558 - protein, 107 aa, Oryza sativa
  Orthologous to G226, G682
MESSGGSQLGKNSKTSDGRETKATSSLLLLITAIHFVALCPKGENEDARKEVNSTAQNFVHFTEEEEDIVFRMHRLVGNRWELIAGRIPGRTAEEVEKFWAIKHQAT

SEQ ID NO: 559 - protein, 78 aa, Oryza sativa
  Orthologous to G226, G682
MDSSSGSQGKNSKTSDGCETKEVNNTAQNFVHFTEEEEDLVFRMHRLVGNRWELIAGRIPGRTAKEVEMFWAVKHQNT

SEQ ID NO: 560 - DNA, 1422 bp, Glycine max
  Predicted polypeptide sequence is orthologous to G241
tacggctgcgagaagacgacagaagggggaagttgaaggggaaagagagaaaagaactagctagctggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgctggggaacaggtggtcagcaattgcagccaaattgccaggaagaactgacaatgagattaaaaatgtttggcacaccaatttgaagaagaggctgctgaaatcagaccagtccaagccaagttccaaaagagccactaagccaaaaatcgaacgttctgattccaattccagcatcataactcaatcagaacctgacaattttaatttcagagaaatggacacaataacatcatcagcatgcactacttctagtagtgatttttcatcggtcacggttggtgacagcaaaaatatcaagagtgaagacacagagtctacggaaacaatgcctgtgattgatgagagcttttggtcagaagctgcaattgatgatgaaacccccaccatgtcatcatctcagtctttgacaatctcaaatgagatgcgacttcaatacccttttgctaactatgaggaaactttccagcagggtcatcatgcttatgattcaaactttgatgatggcatggatttctggtatgacatatttaccaggaccaatgattcaatagaattgctagagttctgaagttttcatgtgacacgttgaacgagggcattattgaatttggcagatagagtagtttaaatggcatggtataacttgaatttgaccgttacaacaaaagggtacgataatttctggtgtggggacagcattatcaccagctgcaagatctagaggcataatccattgacaaagaaactagccagggtaatgcgaaaggctaatgaatgatatgtaatgtacacatgtaatcaagtagtgaaacactgactttctttctttttagtggaaaacagcaatgctctaacatttttgtattttacaaattagagtttaattaggctagagttacttgattgtaatatcaataaatgatgtattatgtgaattattcaaaaaaatttatgcccttgttgagctctcttttctaaaaaagaaaaaaaaaaaaaaaaagaaa

SEQ ID NO: 561 - DNA, 1102 bp, Glycine max
  Predicted polypeptide sequence is orthologous to G241
ctcgagccgcaagagagagctagcagtgcaagctttcaacatccaaaacaacagagagtttttggctttagaagctgaaggaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaattatctgagaccggacatcaaacggggcaactttaccagagaagaagaggacactataatcagtttgcatgaaatgttgggaaacagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggacatgatgatgccactatctcctcctcattgttctagcgacatgtcctccttcctcaccaccagtgacaacaataggaacgttaatattattaataataatcatgatatgtccttaaatgttaatgattatgatattgacaccccagagaataatcttgcattggacgaggatttctggtcggaagttttgtcatctgataattccggcgtgacaagcggatttccgacccttgactatgatcagtttcaaccaatgtctcctctagtgacagaagaaggggtccttatagattgttcgtcgagtacgtgcgacgatggcatggatttttggtgcaatgtttactcgagagctgaggaatttacccagttactggaattgtgatgttagctattgttgttgttcttaaatagagaccaagtccttcattcaacatgtcgttgttcttctgctgtttggacttgaattaattcccttgttagaaattaataaatcgtgtacattgatgattgcc

SEQ ID NO: 562 - DNA, 492 bp, Glycine max
  Predicted polypeptide sequence is orthologous to G241
cggctgcgagaagacgacagaagggggaagttgaagcggggaagataaaaagaactagctagcttgctagagtgtgagaactctagcatatactaggggtactacattccttcatcttcctttttatttttcaccataaaaaaacaagagcacaaagatggtgagagctccttgttgtgaaaagatgggtttgaagaagggtccttgggctaccgaggaagatcaaattctcacatcttacatccaaaaacatggccatggcaattggcgtgccctcccaaagcaagcaggccttctaaggtgtgggaaaagctgcagactccgctggattaactatttgaggcctgatatcaagagagggaatttcacaattgaagaagaagaaactatcattaagctgcatgaggatgtgtggaacaggtggtcagcaattgcagccaaattgtcaggaagaactgacaatgagataaaaaatgtttggcacaccaattt

SEQ ID NO: 563 - DNA, 643 bp, Oryza sativa
  Predicted polypeptide sequence is orthologous to G241
ggaattcggcacgaggagcatcagcaacacacacacacaccgagcagtcaatccatcacacacaaacacaaacaaacgcacagggcgcgagagctcgaacgagaggaggaaaggtcggcaatggggagggcgccgtgctgcgagaagatggggctgaagagggggccgtggacggcggaggaggacaggatcctggtggcgcacatcgagcggcacgggcacagcaactggcgcgcgctgccgaggcaggccggccttctccgctgcggcaagagctgccgcctccggtggatcaactacctccgccccgacatcaagcgcggcaacttcacccgcgaggaggaggacgccatcatccacctccacgaccttctcggcaaccgatggtccgcgattgcagcgaggctgccggggaggacggacaacgagatcaagaatgtgtggcacactcacctcaagaagcggctggagccgaagccgtcgtccggccgggaagccgccgcgcccaagcgaaaggcgaccaagaaggctgcggcggtggcggtggcgatcgacgttccgaccaccgtgccggtgtcgccggagcagtcgctctcgaccacgacgacgtcggccgccaccaccgaggagtactcgtactcga

SEQ ID NO: 564 - DNA, 1344 bp, Zea mays
  Predicted polypeptide sequence is orthologous to G241
ccacgcgtccgcccacgcgtccgcccacgcgtccgggacagtgctccctcccgtccccaaagacaaacaggcgagcagcaaacacacacgctcgaaccgagacaagccaatccaataatggggagggctccgtgctgcgagaagatggggctgaagaaggggccatggacgcccgaggaggacaaggtcctggtcgcccacatccagagcttcggccacagcaactggcgcgcgctgcccaagcaagccggcttgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggaacagcagcagcagcacgggacgacgccggtggctggcgccggcaagaagcacaggcccgcggcggcggcgaagcgcgggggcggcggagccaggaaggcgacggccgacgccgtcgtcgtcccggccaccgctgcgccggcgtcgcccgaacggtccgcggcctcgtcgtcggtgaccgagtcgtccatgacggagcaggagcaggagcacggcaacacggggagctcgcccgcgttccccaaggaggagagcttcaccacctcctcctcggacgccgaggagttccagttcgacgacagcttctggtccgagacgctgtcgatgccgctggacagcctcgacgacgtcgtccccatggagccctccgacgacgcgttcggcgacgtcgacgtcgacgtggccgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttctctctctctctctctctctgcacgtcttgcatcagaggggacggacaaggacagcatcagctgattaacagagaaggaaatcaggcaggaacaacgcgacacgccgttgcaacttggatcgatcttgtttgccttcttgttgtatagatactagaatccatccaagtctatgcgttctgagaacagaagcacgctgtgctgtgcatgcagattcccatgtatgtacagtagccacggccgccgccagaacagaaatggatccggcctcttccaaattccaaaaaaaaaaaaaaaaaaaaaaaaaaaag

SEQ ID NO: 565 - DNA, 662 bp, Zea mays
  Predicted polypeptide sequence is orthologous to G241
attactccgcggcatcaggcaggcaggctagccgtgctccctcccatctcttctcttctctcctctcccccgaagagtcaaagacacagggagagagaggactcctccgcatctgcatccgcgcacacgaattcgagagggagaggagcgataatggggagggctccgtgctgcgagaagatgggcctcaagaggggcccctggacgccggaggaggacaagatcctggtcgcccacatccacagccacggccacagcaactggcgcgcgctgcctaagcaagccggcctgctgcggtgcggcaagagctgccggctccggtggatcaactacctgcggccggacatcaagcgcggcaacttcaccgacgaggaggagcagtcaatcatccagctgcaccagctgctcggcaacagatggtccgcgattgccgcccggctgccggggaggacggacaacgagatcaagaacgtgtggcacacccacctcaagaagcggctcgaccccagcgcgcaggagcagcaccaggaggccaagaagcgcgagaagccggcggcggcggcgcggaagcgcgagggcaaggtcaagatgaggaagctcgacgcgctgaccgccaaggcggcgcccgtgctgtcctcgcccgagcgctccgtctcgtcacg

SEQ ID NO: 566 - DNA, 1084 bp, Zea mays
  Predicted polypeptide sequence is orthologous to G241
gtgtccacacagcaaaccacccgcgctccgccaatccagagagccagccagcccgagctcacacagcagcgagctcggtcttctcgccaggacacgaacacgaccccagcaggcggcaggcaagccacgctctctcgacggacggacgttaatcgagacatggggcgctctccgtgctgcgagaagatggggctgaagaggggtccgtggacggccgaggaggacaggattctggtggcgcacgtcgagcgccacggccacagcaactggcgcgcgctgcccaagcaggcgggcctgctccgctgcggcaagagctgccgcctccgctggatcaactacctgcgccccgacatcaagcgcggcaacttcagccgggaggaggaggacgccatcatacagctccaccaaatgctcggcaacagatggtcgacaatcgctgccaggctgccggggaggacggacaacgagatcaagaacgtctggcacacccacctcaagaagcgcctggagccacagccagccagccagcaggcgcccaagcgcaagcccacgaagaagcagcagccgcagccggagcccgagcccgtaacgacgctcgaggggccggccggggccgtgccgccggtgtcgccggagcggtcactctccacgacgacgtcgaccaccaccagcaccgcggactactcggccgcctcgtcgctggagaacgcgggcgacagcttcacgtcggaggaggactactaccagatcgacgacagcttctggtccgagacgctggcgatgacgacgacggtggacagcttccagtccggggtgcagcaggcggagggcagcttccgcgcgtcggcggcggcgccgtcgtcgaccaacgacgacatggacttctggctcaagctgttcatgcaggccagcgacatgcagaatttgccccagattatttaggcgggaaacggacctagacggtttgttatctctcggctgatgatgatattctttggcgcgcgctcacgattctttgaatctttgttctgctccgttttcggtggatgtatatatcccactgaaaccttgtgaagcggaaagc

SEQ ID NO: 567 - DNA, 1492 bp, Zea mays
  Predicted polypeptide sequence is orthologous to G241
gggacctcgagccgcccccctttgcttcgcacagcacgaccaggacacagtgctccctccccaaagacaaacaggcgagcagcaaacacacacgctcgaaccgagacaagccaatctaataatggggagggctccgtgctgcgagaagatggggctgaagaaggggccatggacgcccgaggaggacaaggtcctggtcgcccacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggagcagcagcagcagcacgggacgacgccggcggctggcgccggcaagaagcacaggcccgcagcggcggcgaagcgcgggggcggcggagccaggaaggcgacggccaacgccgacgccgtcgtcgtcccggccccggccccggccaccgctgcgccggcgtctcccgaacggtcggcggcctcgtcgtcggtgaccgagtcgtccatgacggagcaggagcaggagcacggcaacacggggagctcgcccgcgttccccaaggaggagagcctcaccacctcctcctcggacgccgaggagttccagttcgacgacagcttctggtccgagacgctgtcgatgccgctggacagcctcgacgacgtcgtccccatggagccctccgacgacgacgcgttcggcgacgtcgacgtggctgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttgtctctatctctctctgcacgtcttgcatcggaggggacggacaaggacagcagcagctgattaacagagaaggaaatcaggcagaaacaacgcgacacgccgttgcaacttggatcgatcttgtttgccttcttgttgtatagatactagaatccatccaagcctatgcgttctgagaacagaagcacgctgtgctgtgcatgcagattcccatgtatgtacagtagccacggccgccgccagaacagaaatggatccggcctcttccaaattccaattcgttgagttaattcaaacaaaaaaaaaaaaaaaaaaccccaaaaaaaaaaaaaaaaccaaaaaaaaaaaaaaaaaaaaaaaaaaaaaaaaaaaaaaaaaaaaaaaaaaaaaaaaaggggggggcccccgcttaggggcctcgcccccccggttttttt

SEQ ID NO: 568 - DNA, 1352 bp, Zea mays
  Predicted polypeptide sequence is orthologous to G241
cattgggtaccccgcgccccccggacagtgcagtgctccccgaggtccccaaaagacaagcaggcaagcagcaaagacacgcctccctgcttgcactccccacacgcccagtcgcccacacctccaacagacaaagacaatctagcaagcacacacagcatcaggaggaggagatcgagtaggagcagaagcaaagaatggggagagctccgtgctgcgagaagatggggctcaagagggggccatggacgccggaggaggacaagatcctggtcgcgcacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcaccctccacgagcagctcggcaacaggtggtccgccatcgccgccaggctgcccgggcggacggacaacgagatcaagaacgtctggcacacgcacctcaagaagcggctggagcccaccaccaagcagctggagcaggagcagcacggggcgcatgcaggtggtgacgccgccaggaagcgcagcaggcccaagcgcgcgggtgccaggacgaagacgacgacggccgccgtcgccccggccaccaccgcgccggcgtcgcctgaacggtcggcggcctcgtcgtcggtgaccgagtcgacggagcaggagcagggaaacacggggacgagctcgcccgggttccccaaggaggagagcttcacctcgtcctcggaggccgccgaggagttccagttcgacgacacgttctggtcggagacgctgtccatgccgctggacagcttcgacgacgtccccacggagccctgcagctccggcgcgttcggcgacgtggccgcctcctcctcctcctcgtccgttggcgccgacgccgacttggactactggctcggagtgttcatgaagtccggcgacgcgcaccaacaactgccgcaggtttagagcgcgcacgcgcgcccgagaattttcagttccctggctaattgattcatcgttctttctctctccctgcacgtcttgcaatcggaattcggaggggacagtcacaatagcagctaattaatagaggggtgtgtgtgttgaggaccacgacgagattaggaagaaacaacgcgacatgccattgcatctatctcttgtttgccttcttgtatataaagatcgatcgatcgacaagatatcggtgatcgaaacctatatatgctacccattttgagaggaattcttctgcacgcgcgcgcccgcctccgcggtgga

SEQ ID NO: 569 - protein, 277 aa, nicotiana tabacum
  Orthologous to G241
MGRAPCCEKMGLKKGPWTPEEDQILISFIQQNGHGNWRALPKQAGLLRCGKSCRLRWTNYLRPDIKRGNFTKEEEDTIIQLHEMLGNRWSAIAAKLPGRTDNEIKNVWHTHLKKKLKDYKPPQNPKRHSKNHDSKGPTTSESSNNSHLTFIYTQKHIIDSSVPAPNSPQISSSTEMSTVTLVDDHQMVIKQEEMESSEYFPEIDESFWTDKLSTDNNWSNTHDHVMVTADQELQVQLPFSSLKEENVDMLTTKMEDDMDFWYNVFIKTDDLPELPEF

SEQ ID NO: 570 - DNA, 694 bp, Glycine max
  Predicted polypeptide sequence is orthologous to G254
tttgagagggcgagcaaatcgaaagacaagagtcacagcgcacccccaaacagaaacagagttattgggagcacgaaacactaactgattcgattcgattgaggttacaaaacactaaactgattcgattcgattcgattgaggtttcggtttggtcttgatggtgtcggtgaacccaagccctgctcaaggcttctacttcttcgatccctccaacatggtccttcccggcgtcaacaatcttccaccgcccccgccgcctgctccgccttctcacgccgccgtggaggatccgagtaagaagatcaggaaaccctacacgattaccaagtccagggagagctggactgagcaggagcacgacaagtttctagaagctctccaattatttgatcgggactggaaaaagattgaagcatttgttggttcaaaaacagttatccagatacgaagtcatgcacagaagtattttcttaaagttcagaagaagggaacaagtgaacatgtacctcctccccggccaaagagaaaagctgctcgctcataccctcaaaaagctcctaaaactcctactgtatcccaagttatgggcccattgcaatcttcatcttctttcattgaacctgcatacatatatatcccggattcttcatctgcgcttggaactccattactaacatgccttacgtcatct

SEQ ID NO: 571 - DNA, 555 bp, Glycine max
  Predicted polypeptide sequence is orthologous to G256
gaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccatgaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggt

SEQ ID NO: 572 - DNA, 583 bp, Glycine max
  Predicted polypeptide sequence is orthologous to G256
ccaaaagagataaaagaagagagggagatagatattatagctagctagatagagattagaagctatataatatacataaaattgtattatagtgaactaaaagaaaagggtacaagggaagatgggaaggccaccatgttgtgataaagaaggtgtaaagaaaggaccttggactcctgaagaagacatcattttggtgtcttatattcaggaacatggtcctagcaattggaaagctgttcctgccaatactgggttgtcaaggtgcagtaagagttgtagacttagatggactaattacctgagaccaggaatcaaaaggggtaacttcacagaccaagaggagaagatgataatccatcttcaagcacttttagggaacagatgggctgcaatagctgcttacctaccacaaagaacagataatgacataaaaaactattggaacacctatttgaaaaagaagctgaacaaattggaagcaggttctgatcagggacataatattggggtatcagtttctcagccaatgtcaagaggccagtgggaaagaaagcttcgaacagatatgtcgatgggtaaa

SEQ ID NO: 573 - DNA, 662 bp, Glycine max
  Predicted polypeptide sequence is orthologous to G256
ggcagaaccttgtctctgcatcatcataattctctcaattgaggagcccaaagggatcaaatctcttcaacccagaagaagaaaaacaaaagagaaattatagaattaagttgctatagctaatagctataactggcttagatataccatttttattttatttttattttggggtgtacaaaatgggaagaccaccttgctgtgataaaattgggattaagaaagggccttggactcctgaggaagacatcatcttggtctcttacattcaagaacatggacccggaaattggagatcggttcccagtaacacaggtttgatgagatgcagcaaaagctgcagactcagatggaccaactatctccgacctggtatcaaacgaggcaatttcaccgatcatgaagagaaaatgataatccacctccaagctcttttgggtaacagatgggctgctataacttcctaccttccacaaaggacagacaatgacataaagaactattggaacacccatttgaagaagaagctgaagaagatgcaaaattggaggtggtaatgagatgataataatgatggacagagaaactcttctaacaattcaccaaattagggttcaatgcgaagaagaacttatacagatttccacatggcaagacatgct

SEQ ID NO: 574 - DNA, 1342 bp, Glycine max
  Predicted polypeptide sequence is orthologous to G256
ccccgcgcccccaccagtccgtaagaagaaaatcatgaaaagagagaaaagaagagagggagatagatatattatagctagctagatagagattagaagctatattattatatacataaagttatattatttatattgaactaaaagaaagggtacaagggaaagatgggaaggccaccatgttgtgataaaggtgtgaagaaaggaccttggactcctgaagaagacatcattttggtgtcttatattcaggaacatggtcctggcaattggaaagctgttcctgccaatactgggttgtcaaggtgcagtaagagttgtagacttagatggactaattacctgaggccaggaatcaaaaggggtaacttcacagaccaagaggagaagatgattatccatcttcaagcacttttagggaacagatgggctgcaatagctgcttacctaccacaaagaacagataatgacataaaaaactattggaacacatatttgaaaaagaagctgaacaaaaaattggaagcaggttctgatcaaggaagcttgttgggaggaggacataataatattgggttttcatcagtttctcaaccaatgtctagaggccagtgggaaagaaggcttcaaacagatattcacatggccaaaaaagcacttagtgaagcactctcaccaaacaaggcatcatcatcatcatcaaccttgttagctgaatcaaattcaaacctctccaatgaaaatagtaccttctataatagtaacactaataaaccaacaacaacacaatctatgtgctatgcttcaagtgctgataacatagctcgtttgttgaaagggtggatgaaaaacacaccaaaatcagcctcatgtgctgcctcggctgtgactcaaaattcctgttcttctagtgaaggaattacaacaacaaagggaagcacaacaagcactagtactgttgaattgtctgagacttttgagtccttgtttggttatgagtctttcgataattactcttcaaattctgagttctcaccatctctttctcctgaggctactcttttccaagatgagggcaagccagatataactacaggattaatagacatgcctttctctttgcttgagaaatggcttctagatgttgatgctggtagtcaagagaaacttggcttctagattattagttcaatttgatatgttttttcttagttacaggagagtaagttaaatctctctctcactttggccctcaacccttcttttggttctagaagtgtatattccaatccaatgttcacattattatatgataaatctataataccactatcctataatt

SEQ ID NO: 575 - DNA, 1671 bp, Glycine max
  Predicted polypeptide sequence is orthologous to G256
catcgcaggatcaactttacatcttagttgcttgttttccagtgtggcatctaacacagtatgataacaataatcataatttcaatagttattaacatatacacgtctagcaccaaaggcttgaaaaacttctctctctaaggccaaagcgaagattaattgatgaggccctacctataacttatgaaataaaataaaaaattccacagtctcatatatgtcacaaaatgaacccaacttagaaaaacttggcatcatcaccacaaccaactaatttctcttggcaaccagcctcatcaagaagccatttctcaagcaaagagaatggcataatttctgcaccaataacatcaggcttgctttcatcttgcaaaacagtggcctcaggagacaatgaccgagagaattcatcagagtttgaagactccaaagactgatcaaaatcaaacaatgattcaaaattgttttcagacaattcagcactgcttggtggtccctttgctccaatactagaagcagtatcagcacctgctgcagcaaagttgttgaaggagttctgagtcacagatgatgagtttgttcttgaggactttggtgggtttttcatccaaccctttagcattctagctatgttgtcagcacttgaggcatagcacacagtttgtgttgttgttggttttgtggaagagaaggagctgctactatctgaagggtttgagtttgaggcagataaattacaagatggcttctctggtgaaagagcttcactgagggctctctttgccatttggatatcagtttggagccttctttcccactggcctctagggatttgccttgaggctgaaaacccttctccaaagctaccaccttcacaacctacttgcatcttcttcagcttctttctcaaatgggtgttccaatagttctttatgtcattgtctgttctctgtggaaggtatgaagctattgcagcccatctgtttcctaaaagatcttgaagatggattatcatcttctcctcttgttctgtgaagttgccccgtttgattcctggcctcaggtaattagtccatctaagtctgcaactcttgctgcatcttgacaaccctgttttggcaggaactgccctccaatttccaggaccatgttcctgaatataagacaccaatatgatgtcttcttcaggagtccaaggccctttcttgaccccttctttgtcacaacaaggtggtcttcccatgtcttcttcttgtctttctcttttatttcaccgcctttatacttgtgtgtccttctaattttccttagccccttcaggtctcaaggaaaaagaatattaagtcgttttcctctctctatctatgtgctgtcggctttctctttttatttctctaaccctctttacttgatagggttctaatcggacgctcggagcctaacctttgcttgatgcacatttatagctaaaaatgaaaggggtaaggatatgtatggtgtggggtgtgatgagaagctgacttaaactagtaaaccaggtagccaagtcaaaagttgacagcaagagcattaactgaaggagtaaggaccaaaattattcacctcatagatacctctctctcgaaaccgcgtgacattcaatgtagctgcactgggaaaagctcaattatc

SEQ ID NO: 576 - DNA, 1537 bp, Glycine max
  Predicted polypeptide sequence is orthologous to G256
cctttttttttttttttttttttttttactttaaaaacaattaattcataaagcaagatctcgtcgcaagatcaactttacataagagaagcaagtttgccagtgtatggcaactaacacagtatgataataatcatcataatgtcaataataattaacatatacacgtctagcaccaaaggctggaaaacttctctctctaataaggccgaagcgagattaattgatgaggccctacctataacttatgaaataaaataaaataaaataaaaaaatcccacaggctcatatgtcacaaaatgaacccaacttagaaaaacttggcatcaccacaacaaccaactaatttctcttggcaacctgcctcatcaaggagccatttctcaagcaaagagaagggcataatttctgcagcaatattaatatcaggcttgctttcatcttgcaaaacagtggcctcaggagacaaggactgagagaattgatcagagtttgaagactccaaagactgatcaaaatcaaacaaggattcaaaattattctcagacaattcggcactgcttagtggtccctttgctccactactacaagcagtatcagcacctgctaagttgttgaatgagttctgagtcatagacgagttggttcttgaggactttggtgggttcttcatcccacccttgagcattctagctatgttgtcagcacttgatgcatagcacacagtttgtgttgttgttggttttgtggaagagatggagctgctcctatctgaagggtttgagtttgtgccagataaattacaagatggctttttctctggtgaaagagcttcactgagggctctctttgccatttggatatcagtttggagccttctttcccactggcctctagggatttgccttgaggctgaaaacccttctccaaagctaccaccttcacaacctacttgcatcttcttcagcttctttctcaaatgggtgttccaatagttctttatgtcattgtctgttctctgtggaaggtatgaagctattgcagcccatctttaacatagccaatgtgatccagttaagttaagcatgtggatccaaaagatagaacttcccaaatcaaaatactcaaaaacagttataaaaaataaatcttcaaaacaaagtttttttcttttttataagctaaaagatttcattagtaacttaattgcttgaattgaacacaaaactccaagtaagtaggtgcttggaagattgacttgtacctgtttcctaaaagatcttgaagatggattatcatcttctcctcttgttctgtgaagttaccacgcttgattcctggcctcaggtaattcgtccatctaagtctgcaactcttgctgcatcttgacaaccctgttttggcaggaactgccctccaatttccaggaccatgttcctgaatataagacaccaatatgatgtcttcttcaggagtccaaggccctttcttgaccccttctttgtcacaacaaggtggtcttccctcgagccgaat

SEQ ID NO: 577 - DNA, 1659 bp, Glycine max
  Predicted polypeptide sequence is orthologous to G256
attcggctcgaggaaggatggtaaaactcattagtttccttccatcaaggtcatggagtatataaagcactcacatgcattggtactatttgcaatacaagctcatctcttgggaagaaattagtttaagccttagctagaaaaaggagagtgagttagtgagttgagaggcagaagaaaagaagaagaaaggtggagtgagtgagtgaatagaaaaaaaaaacccaccatggggaggcctccttgctgtgacaaagttggcatcaagaaaggtccatggacacctgaggaggatattatccttgtctcttacatccaagaacatggtccaggaaattggagatcagtgcctactaatactgggttatcaaggtgcagcaaaagttgcaggcttagatggacaaattacctaaggccaggaatcaagagagggaacttcaccccccatgaggaagggatgataattcatttgcaagctctactgggtaacaaatgggcagccatagcttcctatcttccacaaagaacagacaatgacataaagaattattggaacacacatctaaagaagaagctgaagaaatttcaagcagctttggatcctcactcagcatcagactcaacagccagtggtcaatttctaccaaagagctttagtgacagaagaagtactttagacatcagcagcaacaacaacaataatcatggctcgtccattaggcttagtcatcatcaatctcagtcctcttccacaacaacatatgcctcaagcactgagaatatctcaagactcttggaaggttggatgagatcttccccaaagcaactcaacaagggatcatcaatatcccaagatgatgaagatcttcagctccaaggcatcaatgatgatgatgataataacaacaacaactttgtaagcactactaagctagtgaaccttcatcatcttcatcagcacaaagttagaaacaaagatcagcagcaagagggtggtggtggtggcgtagataataacatggtttctcatcatgaagagttcgattctattttgtcctttgagaaccaaaacaatgctgcttgggacaagtccacttgtgattccatgccagaaaagagttctgaagcttctgctgctgctgatcatcatcatcatcatcatcatgatatagctgctgctcatgagaggaacaatgtcaggcaaaaatctgagaatagtagtggtgctcctccattgtcatttcttgagaagtggctcttggatgaaaacgttggtcatcaagtggaggagatgatggagttgtctccgatgttctaaattaacatggaattgggtcaccaatttaatccctttaagtttgggatgtgacattcaaatgatcatatgatattagtcagatgaaagaagagatcaaaggaatgaaattcttttgaaatctgactagggtttaatccattacaatggtggagagattcacagaagctataagggatctctttcaacttgtaacttggaagtctatgaagaatggtttaattatttcaagtaatactatatgcttagtgcatgttgctctctttgtcttgtagaaaaattacaaattaatgttaacttcagctcaaataataatactacaataacagttatattttcaaaaa

SEQ ID NO: 578 - DNA, 553 bp, Oryza sativa
  Predicted polypeptide sequence is orthologous to G256
gcacgaggctctcactctccaccaccaaactctcctcctctcttgcaacatcaaactcatccatccatccatcgatctgagaaatccagctttccagttcttggatctccatcgaccatggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacttcaagaactactggaacacccacctcaagcgcaagctgcagggcggcggcgccggcggtgacggagacggtggcgccgccggcgacgcggtctccccgaagcccgccgcgcagaggcccgcgtcgt

SEQ ID NO: 579 - DNA, 829 bp, Zea mays
  Predicted polypeptide sequence is orthologous to G256
ggaccccttgtcctcaacctcaagccgccacgcaccaccaacacgcgcgcgctggcttcttcaacctcggttgctcgctcgcaacaagacacggatcgtcagagcaagagctctggtgacctgacgattctgctcttgttctcgtacggcgccggtgcctagcgtctgtagcctttttgtgtgtgtgtttttcgcccatatctctccccaccaccaccaccaacctagctcagccgcagttcacccgcgtcaccgcacgagtacacgagcaatccgcaagcgataacctgcaagctgaggggccagctgttttgctcacggagaaagaggttctagctagtcgttcatcaacacggacacaccatggtgaggccgccgtgctgcgacaaggagggcgtcaagaaggggccatggacgccggaggaggacctcgtcctcgtctcctacatccaggagcacggccccggcaactggcgcgccgtcccggccagaaccgggctgatgcggtgcagcaagagctgccgtctgcggtggaccaactacctccggccgggcatcaagcgcggcaacttcaccgagcaggaggagaagctcatcgtgcacctccaggccctcctcggcaacaggtgggcggccatcgcgtcgtacctgccggagcggacggacaacgacatcaagaactactggaacacgcacctcaagcgcaagctgcagagcggcggcgacggggcggccaagccgccggcgcacaggccgccgtcgtcgtccaagggccagtgggagaagaggctgcagacggacatcaacctggcgcgccgcgcgcttcgcg

SEQ ID NO: 580 - DNA, 987 bp, Zea mays
  Predicted polypeptide sequence is orthologous to G256
gaatccccggggattatctagctcagctattcttcccggggatcaaactgtgttgccagcacgtgccagggtgtgtgtagccagccactactgtacaatagctctcttctttctctcgccgtagcttcgctcgtgctgtgcgtgtgtgtatatataagcatcctgcccccactccttttatctctctactcgtctccacgggatcgatcgatcggggcgtggatctctgagcctgagcaagcgggcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcggctcctatgtccaggagcacggccccgggaactggcgcgccgtgccgaccaacaccgggctgatgcggtgcaccaagagctgccgattgcggtggacaaactacctccggccgggaatcaagcgcggcaactttaccgagcaggaggagaagctcatcgtccacctccaggctctccttggcaacaggtgggcggccatagcatcctacttgccgaagaggacggccaacgatatcaagaactactgcaccgcgcatcttaagaagaagctgaagaacatgcaggccggcgaagggggcgcgggagggaagcgcccggccgttcccaaggggcagtgggagcggcggctgcagactgacatccacacggcgcggcaggctctgcgcgacgcgctctcgctggagccttcggcagacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgc

SEQ ID NO: 581 - DNA, 955 bp, Zea mays
  Predicted polypeptide sequence is orthologous to G256
ccacgcgtccgccacggaatcgatcgatcggtgctttgatctctgagcctgagcaagcggtcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgccgattgcggtggacaaactacctccggccgggaatcaagcgcggcaactttaccgagcaggaggagaagctcatcgtccacctccaggctctccttggcaacaggtgatggtcactcgcctgtcgtcgtcttaaagcttttgttcccgttttgttttttccgctgtaacaaatggatcggacaaaccaaatcatccacggcacgaggtgatcgtgtgctgagcttgttgatctgcatgccgtgcacttgttgatgtgtcgtgcaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcgctggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgcca

SEQ ID NO: 582 - DNA, 847 bp, Zea mays
  Predicted polypeptide sequence is orthologous to G256
cgtctgcaccgaatcgatcgatcggtgcttttaatctctgagcaagcgatcgagctcaccaacaaccaccgcgctcaagagtagcagccggccggagccgaaaacgacgaggcggtggcatggggaggccgccgtgctgcgacaaggtgggagtgaagaaagggccgtggacccccgaggaggacctcatgctcgtctcctatgtccaggagcacggccccgggaactggcgcgccgtgccgaccaacaccgggctgatgcgctgcagcaagagctgcaggttgcggtggacaaactacctccggccgggaatcaagcgcggcaactttaccgaccaggaggagaagctcatcatccacctccaggctctccttggcaaccggtgggcggcgatagcgtcctacttgccggagaggacggacaacgatatcaagaactactggaacacgcacctcaagaagaagctgaagaagatgcaggccggcgaagggggcgggggagacggcgacggcgcagcaggtgcctcggaaggcggcgccgtcgccaccgcaggcgcgggagggaagcgcccggccgtgcccaaggggcagtgggagcggcggctgcagaccgacatccacacggcgcggcaggctctgcgcgacgcgctctcgctggaaccttcgccttcggcgccgccgccggctaaggtggagcctctgccggcgaccgccccggggtacaagacgtacgcgtctagcgccgagaacatcgcgcggctgctggagggctggctgcgccccggcagcggagggggcaaggggcccgaggcgtcgggctcgacgtcgacgacggccacgacgcagca

SEQ ID NO: 583 - DNA, 1600 bp, Zea mays
  Predicted polypeptide sequence is orthologous to G256
ccggccggacctccggcgcccccctgtcctcaacctcaagccgccacgcaccaccaacacacgcgcgctggcttcttcaacctcggttgctcgctcgcaacaagacacggatcgtcagagcaagagctctggtgacctgacgattctgctcttgttctcgtacggcgccggtgcctagcgtctgtagcctttttgtgtgtgtgttttttcgcccatatctctccccaccaccaccaccaacctagctcagccgcagttcacccgcgtcaccgcacgagtacacgagcaatccgcaagcgataacctgcaagctgaggggccagctgttttgctcacggagaaagaggttctagctagtcgttgatcagcacggacacaccatggtgaggccgccgtgctgcgacaaggagggcgtcaagaaggggccgtggacgccggaggaggacctcgtcctcgtctcctacatccaggaccacggccccggcaactggcgcgccgtccccaccagaaccgggctgatgcggtgcagcaagagctgccggcttcggtggaccaactacctccggccgggcatcaggcgcggcaacttcacggagcaggaggagaagctcatcgtccacctccaggccctcctcggcaacaggtgggcggccatcgcgtcgtacctgccggagcggacggacaatgacgtcaagaactactggaacacgcacctcaagcgcaagctgcaggccggcggcggcgacggcgacggcgacggggcggccaagccgccggcgcacaggccgccgccgtccaactccaaggggcagtgggagaggaggctgcagacggacatcaacctggcgcgccgcgcgctccgcgaggcgctcaccccgctcggcgacctcaagccgcagccgcagccgcagcgcgacggcgctggcgtgggcatcgtcggcggtgacagcccggcggcctcgagcttgtcgtcgcagtgctccccgccgccagcgcctgccgccttggggacgtacgttctcaccgcggacaacgtctcccggatgctggacggatgggccggcttgaacgggaagcgccgcggcggggctccgggcacgcccggcggcgccgagaccgcgtccaccgggtcctcctcggaggtgtcgtacggcggtggcaccgccgtcgtcgcgccggccgctggtggcccggtgttcgagtacgagacgaagccgccggccgcgccgttccagctgatgatgccgctgtctgcgatcgagtcgtggctgttcgacgacgacacccacttccaccgtcctgtccagagcgccagcttgctggacgccgcccccatggattattacctgttgtagctagcgtgtccagcagctgatccagaccaagctaatccgttcaagcaaggaagtcggtggctgattagtcggctagctagctacctgtttctaaagttgttagttttcattatatttagccttttcttttctaggtgggtaaaagttgagtgcgtacttccccttgtgcaagctgcatgttgcatgggaaaataacatatatagctcttgcttgagacccaaaaaaaaattaccacggcggccgc

SEQ ID NO: 584 - DNA, 1632 bp, Zea mays
  Predicted polypeptide sequence is orthologous to G256
gaattcccgggtcgaccctcgcggccgcggacgcgtgggcggacccgtggggccacaactccggccagaagctagctagccaagttattagctagtacatactagtggccggccggacacgatcgatgggcaggccgccgtgctgcgacaaggcgggggtcaagaaggggccatggacgccggaggaggacatcgtcctggtgtcctacgtccaggagcacggccccggcaactggcgcgccgtgcccgtcagcacgggcctcatgcgctgcagcaagagctgccgcctccgctggaccaactacctccgccccggcatccggcgcggcaacttcacaccccacgaggaaggcatcatcgtccacctccaggccttgctaggcaacagatgggcggccattgcttcttacctcccacagagaaccgacaacgacatcaagaactactggaacacccacctcaagaagaagctccggaagcagcaagccatcggcgccatcttcgcgccacctcccccctccgaacccaccgccggccatgccgattgccgtcgtcacgacatggcccgctcctccaaggacagccacgcttgcctggccgacagcacaccagcggctgatgaggtcgtcacccagctcatcgcccagcagttcgccgccaccgacggtgacacctcgtcgtcgtcgtcgtactcgtacgcctccagcacggacaacatctccaagctgctcaacggctttcatgaagagcgcctcgccggcgcgggacgacgctaccgacaccatcaagacttcctcggccattgacatcgaccctttcgaccacaagtccggcggggcactactaccaccacccaagaagcggcagcagcagcagcatctgtcctccatagagaactggttgttcgacgatgccactgagcaggtcgttgtccagctgatggaggagatctccggcggctcatgctcagttcccatgctgctttattagcaccaagaaaaagaagcgaacatgcatgatagccgatcgatagatgtgacttggataggagaatgaatgtgtgcatgggtgcaagttacccagctgataggagaattttatatacacccatgcatgtttagttttatttacacaaccatgagccatgagataagaacaatatatatgcatagtcaatcaaaactcccaagcgagaggcacctcaaagagcgcggaaaaaaaaaaaaaaaaaaaaaagacaacgcctggtccaacaagtcttggtgacctggtccggccttccagatgagttggctacgtgggaggatcaggaagccttgcatcagcgctttccattggctcctgcttggggtcaagccggctttccagggtgagggaatgtcacgagctcatccacaccacacaagccacatgaacctgaagaagcagcaaggagaggagagcgtgtccgtcggacaaatgtgagaattactgggcctgaatgggtgtagtgcgttgaatgggccactgttgggctggctttgtaggattcctgtgtgacccttgtaatgggagatagttaaactctgcagtagccagggagatgaggaagaaagaaatagacactgctcctatctacctcctccttccttc

SEQ ID NO: 585 - DNA, 1377 bp, Lycopersicon esculentum
  G3500  Predicted polypeptide sequence is orthologous to G256
cccaagaaaagaagaattccacaaaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtggaatggggttgatggaagcatttgagtcactatttggtttggaatcatttgaatcatcaagttcagatgagttgtctcaaacaacaactcctgaggctattaaaattgaaataaagaaggaagaaaatgaacatgatgttgaagtgccactatctattatcttagagaattggttgcttgatgaaaatacactcaatattcaaccaaaaaatgacttgactaccttgatatcttttgatgaaactccacaacttttctacaagtttttttttttgttgattcttttgatggaataattttgaaaaaattgtatgtttttgattgatttccccattgattgtttttattttgatgtggcgattttaacaagtcatgtatatttagccattattattatatttagactatatatagctcaatcaagacttaatctagagtggttttatcatatgactaagttgtatcctttttaaatttcgttttatagatttcaattattgtactaagttagggaattttatatctctttcaatacaaaattttgttttattttaaaaaaaaaaaaaaaaaaaaaaaa

SEQ ID NO: 586 - DNA, 1426 bp, Lycopersicon esculentum
  G3501  Predicted polypeptide sequence is orthologous to G256
tataaacatagctagagaaaaaaaaaaaaaacttcaagaaaatcaaaagtgcttttgttgttgaattaaatcaaagaagatttgtttattttgatttttagaaatgggaaggcctccttgttgtgaaaaaagtggggtgaaaaaagggccatggacaccagaagaagatatcattttggtttcatacattcaagaacatggccctggaaactggagaaatattccaactaatactggtttgctaagatgcagcaaaagttgtagacttcgatggactaattatctccggccagggatcaaacgtggaaacttcactgaacatgaagaaaaaatgatcatccatcttcaagctcttcttggcaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgacctttagctgaaactaatgatttgttttgaagaaaaaaaaaattgtttactagtactcccttcgtttcaatttatctgccttgatttgaccgaacatgaaagtgaagaaaaaaaataagtaaaacggataaattgaagcgcagggagtagtaaatatttcttcaaacaacataggacagtttggggtaagtgggcttttggggtattttaatagttgg

SEQ ID NO: 587 - protein, 307 aa, Oryza sativa
  G3385  Orthologous to G256
MGRPPCCEKEGVKKGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLALTSSSSSPPTPTTPLVARGQWERKLQTDIDLARRALRDALSVDDAASPAMISSGPPAPAAAAAYALSERNISVMLSGWAAPPPARKGLSACNPAAATTTPGGAAAESASTAGTSLELTADCCSGGGDSSASNCLPSSMLLACDDGDATATAAGVAPLSAIESWLLLDDSGEPQLALDEQLLDVALRNYAF

SEQ ID NO: 588 - protein, 341 aa, Oryza sativa
  G3386  Orthologous to G256
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGHWERRLQTDIDMAPRASREALTSLEDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 589 - protein, 341 aa, Oryza sativa
  Orthologous to G256
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGQWERRLQTDIDMARRALREALTSLDDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 590 - protein, 321 aa, Oryza sativa
  G3384  Orthologous to G256
MGRPPCCDKVGVKKGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKKMQAAEGGEDSGAASEGGGGRGDGDGGGKSVKAAAPKGQWERRLQTDIHTARQALRDALSLDHPDPSPATAAAAATPAGSSAAYASSADNIARLLQGWMRPGGGGGGNGKGPEASGSTSTTATTQQQPQCSGEGAASASASASQSGAAAAATAQTPECSTETSKMATGGGAGGPAPAFSMLESWLLDDGGMGLMDVVPLGDPSF

SEQ ID NO: 591 - protein, 385 aa, Oryza sativa
  Orthologous to G256
MAGGGGSLAVGGGLNGWRGVSGSVGAAGLEEGSGPAWWRGHLTANGSRMKKGGGSRRHAIPTGEAVGGGGAVVGIDGEAAVLREGGGEEGAVDAGGGPMLVAYVQEHGPGNWRAVPTNTGLMRCSKSCRLRWTNYLRPGIKRGNFTDQEEKLIVHLQALLGNRWAAIASYLPERTDNDIKNYWNTHLKKKLKKMSATGGGGDYGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLYGEASHSGGATAPTPDGSTVTSKTKDEETAGAPSSSPPPAFSMLESWLLDDGMGHGEVGLMDVVVPLGDPSEFF

SEQ ID NO: 592 - protein, 310 aa, Oryza sativa japonica
  G3502  Orthologous to G256
MGRPPCCVKAEVKKGPWTPEEDLMLVAYVQEHGPGNWRAVPTNTGLMRCSKSCRLRWTNYLRPGIKRGNFTDQEEKLIVHLQALLGNRWAAIASYLPERTDNDIKNYWNTHLKKKLKKMSATGGGGDDGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLSGEASHSGGATAPTPDGSTVTSKTKDEETAGAPPPPPPPAFSMLESWLLDDGMGHGEVGLMDVVVPLGDPSEFF

SEQ ID NO: 593 - protein, 347 aa, Lycopersicon esculentum
  G3500  Orthologous to G256
MGRVPCCDKMGVKKGPWTPEEDIMLVSYVQQHGPGNWRALPTKTGLRRCSKSCRLRWTNYLRPGIKRGNFTDQEEKMIIQLQALLGNKWAAIASYLPERTDNDIKNYWNTHLKKKMKRLDQCHGSNDLFSLENGLTHLSSSNSSTSRGQWERTLQADINMAKKALHNALSLENPTSSHNNNIKQENTQVSSTSTIYASSTENIARLLQGWIGSSTSSTNNSESSKTSSNNIATTDSSSCDGTPNAETKGGMGLMEAFESLFGLESFESSSSDELSQTTTPEAIKIEIKKEENEHDVEVPLSIILENWLLDENTLNIQPKNDLTTLISFDETPQLFYKFFFLLILLME

SEQ ID NO: 594 - protein, 371 aa, Lycopersicon esculentum
  G3501  Orthologous to G256
MGRPPCCEKSGVKKGPWTPEEDIILVSYIQEHGPGNWRNIPTNTGLLRCSKSCRLRWTNYLRPGIKRGNFTEHEEKMIIHLQALLGNRWAAIASYLPQRTDNDIKNYWNTHLKKKLNNNKKVEGHDDHQEGTSASSSSSQSKIIKGQWERRLQTDIHTAKQALCDALSLDTTPNNKNNNNNPPPHDQDQQPPSVQTPTTYASSAENIAKLLQNWMKNSPKSTSSSSSKITPMSSLNNNLSIGAVSSSSPSEGTVNVTPGQGLDSIFSFNSSNNSDVSQSVSVDEGGNFSTPENHNNNNNNNAGIYQVESKPNLPDFKPENGNFQEESKQNMETQQVPLTMLEKWLLEDANAQAEQEDQLMGIGMGMGMTFS

SEQ ID NO: 595 - DNA, 633 bp, Oryza sativa
  Predicted polypeptide sequence is orthologous to G278
gcacgaggacacagagcccttgactctgacgatgtagagctagtcaggatgctgctcactgaaggagagacaaatcttgatgatgcgtttgcactgcactacgccgtcgaacattgtgactccaaaattacaaccgagcttttggatctcgcacttgcagatgttaatcatagaaaccctagaggttatactgttcttcacattgctgcgaggcgaagagagcctaaaatcattgtctcccttttaaccaagggggctcggccagcagatgttacattcgatgggagaaaagcggttcaaatctcaaaaagactaacaaaacaaggggattactttggggttaccgaagaaggaaaaccttctccaaaagataggttatgtattgaaatactggagcaagctgaaagaagggacccacaactcggagaagcatcagtttctctttgcaatggcaggtgagagtctacgaggaaggttgctgtatcttgaaaaccgagttgctttggcgaggattatgtttccgatggaagcaagagtagcaatggatattgctcaagtggatggaactttggaatttaacctgggttcttgtgcaaatccaccttcttgaagacaacggacaactgttgatct

SEQ ID NO: 596 - DNA, 1773 bp, Zea mays
  Predicted polypeptide sequence is orthologous to G278
gtcgccgccctgcccaaggcggcctgcctctgcgtcgacgaggacgcctgcgcgcacgtcggctgccgccccgccgtcgccttcatggcgcaggtcctcttcgccgcgtccaccttcgacgtcgccgagctcaccaatctcttccagcggcggctccttgatgtccttgataaggttgaagtggacaacctcccattggtcttatctgttgccaacttatgcagcaaatcttgtgtgaaactgcttgagaggtgccttgatgtagtagttcgttcaaaccttgatatgatttctcttgaaaaaaagttgcctccagatgttgtcaaagaaattgttgatgcaagggtaagccttggattagtttcaccggaagacaagggcttccctaacatacatgtaagaagaatacacagagcactggattctgatgacgtggagctagtccggatgctactcaaggaaggaaaaactaatcttgatgatgcatatgcattacactatgccgtcgaacattgcgactcaaagatcacaacagaacttctggatctcgcgcttgcagatgtcaatcataggaacccaagaggttatacggtccttcacattgctgctatgaggagggaacctaaaatcattgtctctcttttgaccaagggagctcggccatcagacctcacatttgatgacagaaaagcagtgcagatctccaaacgacttacaaagcatggggattactttgggcctactgaggacggaaagccttctcctaaagatagattatgtattgaggtactagagcaagctgaaagaagggacccgcaacttggagaagcatcagtttctcttgcgatagaaggagactctgcgcgtgggaggctactctaccttgaaaaccgagttgctctagcaagaatactgtttcctatggaggcaagggtagcaatggacattgctcaagtcgatggaacactggaattcacccttgtttctagtgtgaatctgcctgccgagatacaacggacagttgacctgaacgatactcctttcacaatgaaggaagaacacctggctcggatgagagccctatccaagacagtggaagtcgggaagcgtttcttcccgcggtgttcgaaggtacttgacacgatcatggacgacgaagccgagatggcttccctcgggcgagacacatccgcggagaagaagaggaggttccatgacctgcaagacctggtccagaaggcattcagcgaggacaaggaggagaacgacaggtccgcggcgcggtcgccttcctcctcgtcgacgacgacgacgtcgatcggggccgtccggcctcggaggtgaaagggaaaacatgcatgggtcctgtttccgtcccgccattttggtagccgatgcggtggccacatagagaccgtaaccgtaatcatgctcacttttgctggcgtatagcattaatgcagaacacgtatactaactaactatataatatacgagtaggtgtagatcggtactggaggttgtaatggcagtagcgaaacatagtgcattctggcgggcgtgtgtgtcgagcaggtagctggctgctcttgattgtaatggcgttttgagcagctaactaggatccctcttcacttcactcgaaaagggtctggcatggcttgtggaattgtggtgtgctgaatagtgtcaggttcagtgtcccaaaccctgaagaaatgcaaacatgtagtgttgccctatctaccaaaagccaaggggaagtgtttgtcc

SEQ ID NO: 597 - protein, 615 aa, Oryza sativa
  Orthologous to G278
MEPPTSHVTNAFSDSDSASVEEGGADADADVEALRRLSDNLAAAFRSPEDFAFLADARIAVPGGGGGGGDLLVHRCVLSARSPFLRGVFARRAAAAAGGGGEDGGERLELRELLGGGGEEVEVGYEALRLVLDYLYSGRVGDLPKAACLCVDEDCAHVGCHPAVAFMAQVLFAASTFQVAELTNLFQRRLLDVLDKVEVDNLLLILSVANLCNKSCMKLLERCLDMVVRSNLDMITLEKSLPPDVIKQIIDARLSLGLISPENKGFPNKHVRRIHRALDSDDVELVRMLLTEGQTNLDDAFALHYAVEHCDSKITTELLDLALADVNHRNPRGYTVLHIAARRREPKIIVSLLTKGARPADVTFDGRKAVQISKRLTKQGDYFGVTEEGKPSPKDRLCIEILEQAERRDPQLGEASVSLAMAGESLRGRLLYLENRGNLHIYHNGFIMLVSLELTVFGLGNKRKFLYDVVALARIMFPMEARVAMDIAQVDGTLEFNLGSGANPPPERQRTTVDLNESPFIMKEEHLARMTALSKTVELGKRFFPRCSNVLDKIMDDETDPVSLGRDTSAEKRKRFHDLQDVLQKAFHEDKEENDRSGLSSSSSSTSIGAIRPRR

SEQ ID NO: 598 - DNA, 2261 bp, Glycine max
  Predicted polypeptide sequence is orthologous to G312
  misc_feature (525)..(525): n is a, c, g, or t
  misc_feature (646)..(646): n is a, c, g, or t
ctctactcctcgcttcaacggttcaatcaatcaactcttcatccgtccctttatacccccccttctgtgtgttgtacatatttatatcgtaacatagctaggctgctttactctagtgctctcctacactcaatgaaatgctgtgacgtgatttgcagaggagaagagggaatggcggcttacatgtgtgcagacagtggcaacctcatggcgattgcgcagcaagtcattaagcagaagcagcagcaagagcagcagcagcagcagcagcagcagcaacagcagcagcaacacttgctacaccaccaacagaaccctctctcccttcacactccaattccatggaacaacactcctcctctcggctaccctctacctcccaccacccatttcccccccgaccccttccaacccgatccccctttccacttccaacccgacccccactccttccgcttctccgacttcgactccgacgactggatggactccctcatcgccgccgccgacaccactgatttcccncttccccccctccgatctcaacccgctccctctccaacccactccccccttcccctccccctccaccggcccagtcccccgtggactccgactccgactcctccgtacatcccctcctcanagccctggccgagtgcgcctccctggccgaaacggagccggatcaggccgcggaatccctaagccgtttgcgaaaatccgtttcccagcacggaaaccccactcagcgagtgggcttttacttctggcaggccctctcccgcagagaagaaaagggccataatagcacttgggatgaggagttaacactctcttacaaagccctgaacgacgcctgcccttactccaagttcgctcacttaaccgccaaccaagccatccttgaagccacccaaaccgcctccaacatccacatcgtcgacttcggtatcgtccaagggattcaatgggccgcactcttgcaagctttcgccactcgtccttctggaaagcccaataagatcagaatctccggaatccccgccgtctcccttggtccctctcccggcccttctctctccgccaccggcaaccgcctctctgacttcgccaggctcctcgacttgaacttcgtgttcacgcccattctcactcccattcaccagctcgaccacaacagcttctgcattgacccaaacgaggtcttggccgttaacttcatgcttcagttgtataacctcttggacgagcctccctccgcggttgacactgcgctcaggttggccaagtctctcaaccctagaattgtcacccttggcgagtatgaagcaagtgtcacacgtgtcgggtttgtcaaccggttcaggactgcgttcaagtacttctctgctgtgtttgagtctctggagcctaatttggccgcggactcgccggagaggtttcaggtggagagtcttcttctcgggcggcgaatcgcggcggtcattggggggcccgggtcggtgaggagggagagtatggaggacaaagagcagtggagggttctgatggagcgtgctggttttgaatcagtgagtctaagccattatgcaattagtcaagctaagatacttctctggaattacagttacagttctctgttttcgctggtggaatctacaccaccggggtttttgtctctggcttggaaggatgttcctctcttgaccgtctcctcttggcgttagttaatgggttcgacttggttgattgttattggaaagggtttccacctggtccttttttccctggtgtggaacaactaattattattattattattattatttgtcgatatgccatggatgatcgatcatgttgtgctatgctagcctcttcaattactgaagttatgcagaagatttgatatgtgaattggctggcactacaagaaattgaggtttttgggagaattgccacctttagcagcagtttggtcctctactagttccacacctccttacttttgtttttttagttgatttttctatttcttatcagcgttttttttttcttctagtggcaatgatgttattattagcttcaagaattggctaggcaaactgtgacaatgaaaatagggagaaatgggatggagaaaagctttctttctcattgcttctagtcattgtgatttgtgactctgtaaattggattttgttgtatggatttaaattggtctgaatgaatgaaatgaatatcaaaggatttttatcttt

SEQ ID NO: 599 - DNA, 1024 bp, Zea mays
  Predicted polypeptide sequence is orthologous to G312
cgcgcttcgcccccgacgagctcacgctctgctacaagacgctcaatgacgcctgcccctactccaagttcgcgcacctcaccgccaaccaggccatcctggaggctacgggcgcggcgaccaagattcacatcgttgacttcgggatcgtgcagggtatccaatgggcggcgctgctgcaggcactcgccactcgcccgggggagaagccatcccgggtacgtatctccggcgtgccttcgccgtacctggggccaaagcctgcggcgtccctcgccgcaaccagtgcccgtctccgcgacttcgccaagcttctcggagtggacttcgagttcgtcccgttgctgccgccggtgcacgagctggatcggtcggatttcttggttgagcctgacgagaccgtagccgtcaatttcatgctccagttgtaccacctccttggcgactccgatgagcccgtgcgacgtgtcctccggctggttaagtcactcgatccatcggtggttacccttggggaatacgaggtcagcctgaaccgggctgggttcgtcgaccggtttgccaatgcactgctgtattacaagccagcgttcgagtcgctggacgtggcgatgccacgggactcaccggagagggtgagggtggagcgatgcatgtttggggagcgcattagaagggccattgggccagaggaaggagcagagaggactgataggatggcggctagtagggagtggcagacgctgatggagtggtgtggctttgagcccgtcagactcagcaactacgccatgagccaggctgatcttttgctttggaattacgattcgaagtacaagtattcgcttgttgagctaccaccagcgttcttgtctctggcttgggagaagcagccgctgctcaccgtgtccgcttggcggtgagtccctttttgtgtgtgtgtattggtgctgttgtatgtagcattgtcataggaccagggaagaaatgaatagactggttttgcattgtcttaaaaaaaaaa

SEQ ID NO: 600 - DNA, 509 bp, Euphorbia esula
  Predicted polypeptide sequence is orthologous to G312
gttaactagttccgaaagcaccagcgaagaatttactctctcttacaaggccttcaacgatgcctgcccttattctaaatttgctcatttaacagcgaatcaagcaatccttgaggctacagagagagcaagcaagattcacatagttgatttcgggatcgttcaaggtgttcaatgggctgctcttttacaagctctggctactcgttctgccggaaaaccagccagtatccggatctctggtataccggctcctgtactaggtaaatctcctgaagcttctctttttgctactggtaataggcttcatgattttgcaaagcttttagatttgaatttcgagtttgagccgattcttactccaattgaggatttgaaagaatcaagttttcgagttgatccagatgaggtattagccgtgaatttcatgcttcaattgtataatttattggacgaaactaatgattctgtagaaactgctttaagagtggctaaatcattggaaccca

SEQ ID NO: 601 - DNA, 2491 bp, Glycine max
  Predicted polypeptide sequence is orthologous to G325
ccacgcgtccggggaatttagaatgcttagaataaatgaatgaataaagttgagttccctctaacagttatgttagagtttagttgagttatcatgaataatcatcagtgacactgtaggagcatggatcctctatgtgagttttgtcgggtggtgagagctgtggtttactgtaagtcagattctgctcgtctctgcttgcattgcgatggctgtgtacactctgcaaattctttgtctcgcaggcattcgcgttccctcctatgcgataagtgcaattcccagccggcaatgatccgctgcatgaatcataagttgtcattatgtcaaggttgtgactggaatccaaatgactgttctgcattgggacataggcgccttgcattgaattgctacactggttgcccctctttggctgagttttctaggctctggtcttttgtgtttgatgctaattcctcacttggtggttgggaatcggttggtactttgccaaaaagtgagagctgcactagccagtgtttggagcaaactgatcataatggtggttattttggtttggtgagtgacaagttggatgaaattgaatcttgtgtcagatatcaacctcggatggatcagtctcaaatcattccatcaaatccaaattacacaccgtactgcaaagacgaagcatttttctttcctcaagactcaaaccagccaaagctgcaggaatgtcctaatctaggaattcatgatgggaatgaactttgtgaaggtttcaatgtggataacgttcaattaaactttgaaattgctgatgaaatattttactgttcacaagttgccacaagataccaccttgaagatggaggaatggactgtttattgatggataaaaacatagcagttacagaatctagttcacttattgagagtgccatggaggcatcatcatctatccaacaagattgtgtggcttttcaatcatcgagggctggtgggtcagctagtgtgatgcaggttatcaacagcaataccaattgtgcacttatgaatcctagctgcactaaaaacatcagtctgggatttcctcagggcctagttcattcaaacatgccacttcaatttcccaacatagttggtgaaaataattctactgaatatcaagactgcgggttatcgcgagtgggtgaatccccctgggaatcaaatttggagggtacatgcccacaagcaagggataaagctaaaatgagatacaatgagaaaaagaaaactcgaacctttggtaagcaaataagatatgcttctcgcaaagcaagggccgatacaagaaaacgtgtgaaaggtagatttgttaaagcaggtgaagcatatgattatgaccctcttgggacaagggacatctaagcatattatctacaataactatcttttccatgaaagatattcttctgactggtaaggtggtccctggaccttgtgagtacattgctttgttgccaattcttcatcaacagacgttttgtttatcttgtgaaagtgggagagttataatgcagctagatatttattcaaaacttgactgcttaggtgattgatacagatctattagagattttaacatatttagaagataacaaagatatgaaggtgttgcaattgggaattgcagaggaagggattggatgtatgccaagataatgcgtttaattatacataggaagtgtgagaggtaacaggcatgggacatagaggagcagaacatttgaacagatttcaaacagcatcacagtcattgtcaattcagacaaaaacagagggcctggatattcctccttgcatttagaggagatgtgcagagtgatccatcctgaatttcaaatgtgatattgtgagtctctgagcctatgtgttctatataaataaacactgcctagtgtaatgaataaaagagaaactggtgtttggcaagcaacaatagccaacctcacactttctgctttcagtttggtccttccgtcctcatggggatccttcacacgaccttattctgtcatcttaagccattgttcaaggacagcaacaccatattttggaacctcttcatttattccattttcatcagattagtgagcacgatcgactgttgattgagatactattgttcttgacttgctggaagccagttttacctgccgcaactattggcatctttgacattgcctcaactatttcatttgttgtattcctctatatttgctttgaggatggcacctatttcttcaataattgtacaaacattgtgtacaaactttcctgatttcaagggacgtttgtttctcctatgaaataggagatattaatgactgttttattgttttgtaatttgcacaaatctgttattattcattaaatttctgtagaatgttgataagaaagaaactacagtctttactgttccgagtaaaaaaaaaaaaaaaaaaaaaaaaaaaaaaaaaaaaag

SEQ ID NO: 602 - DNA, 1110 bp, Glycine max
  Predicted polypeptide sequence is orthologous to G343
caaacaaacacaactctctctatcaacaaaaccaaccaacacaagaaagaaagaaaaacaatggacttgtacggttccttttccaccccttcagattgcttacatattgatgattttctagatttctccaacatcaccaccgacacccaccaccaccttcctcctccgcaaaactctccattaatctcccacgacgacgccaatctcttcttcaatttcccttccgttccgaccgacgaagcggcggagctggagtggctctcccagttcgtggacgacgacgcgacgtcgtttcacagcttcccagcaaccgcatcgattggatcccactcgacgtcgtttctctccaacaataacaacagaaacgataataacgaatatcccaaatcttcattatcttcaaacattccatgttcttcagcggtggcgggaaaatcgagagcgaggagggaagggtcggttaccggcgacggcggcgtgcggcggtgcagccactgtgcctcggagaagacgccgcagtggcgcgcgggaccgctgggaccgaagacgctgtgcaacgcgtgcggggttcggttcaagtcgggtcggctcgtacccgaataccgacccgcggcgagccctacgttcgtgctgactcagcattcgaactcgcaccgcaaggtcatggagctccgtcgccagaaggagctgctccgcctccaacaacagcaacaattactacaagagcaatgccgccgtcacactcacaacctccgcgatttcaaagtttgctgacgtgtcctttgtatccatccatccattattatctaatgaattgctcaataaatgagtgccataaacggtgaagcagagatagcgctatttgtttcttggctgtttatttatgctctctctctgatctcaaattgagtgaagggttgatttttttttttttcttttttatgtcgaggagaagagaagtgcccttcgtgggaaaagggaaaaaaattgtctttactgttacggttttaaagcttcaactgtcatttgctgcattttcactaggagtgattgcaggagatacgttctgaatttgaattaatttgaataaattatttttatatttgagtt

SEQ ID NO: 603 - DNA, 857 bp, Glycine max
  Predicted polypeptide sequence is orthologous to G343
ggacttgtacggttccttttccaccccttcagattgcttacacatcgatgattttctagatttctccaacatcaccaccaccaccaccgacacccaccaccactttcctccgccgcaaaactctccatcaatctcccacgatcccaatttcttcctcaatttcccttccgttccgagcgacgaagcagtggagctggagtggctctcccagttcgtgaacgacgaggcgacgtcgtttcacaacatcccaccacccgcatccattggatcccacacgacgccgtttctttccaacaataacaggaacgataataataacgaatatcccaaatcatcatcatcttcaccggtgttggcgggaaaatcgagagcaagaagggaagggtcggtgaccggcgacggcgtgcggcgctgcagccactgtgcgacggataagaccccgcagtggcgcacgggaccgttggggccgaagacgctctgcaacgcgtgcggcgtgcggttcaagtcgggtcggctcgtacccgaataccgacccgccgcgagccctacgttcgtgatgactcagcactcgaactcgcaccgcaaggttatggagctccgtcgccagaaggagctgctccgccaccagcagcaagaacaatgctaccgtcacactcaccacgacttcaaagtctgctgacgtgtctcttgtctgtccttacttttttctttttttcttcttttgaataaataatcaaattcgaccagtgatgcactaataaattgatctttaaaaataaagaatttaaatgtaataagtataatgaatttatctttgaattttatattttaatgtcaatttttttaaaaataaaaaa

SEQ ID NO: 604 - DNA, 541 bp, Glycine max
  Predicted polypeptide sequence is orthologous to G343
ggttaccggcgacggcggcgtgcggcggtgcagccactgtgcctcggagaagacgccgcagtggcgcgcgggaccgctgggaccgaagacgctgtgcaacgcgtgcggggttcggttcaagtcgggtcggctcgtacccgaataccgacccgcggcgagccccacgttcgtgctgactcagcattcgaactcgcaccgcaaggtcatggagctccgtcgccagaaggagctgctccgccaccaacaacaacaacaattacaacaagagcaatgccaccgtcacactcacaaccaccacgatttcaaagtttgctgacgtgtcctttgtcggtgcttccttcttttataattaatgatgactaatgtcttcagaatattatcagtaaataaaaaaatgatttttttttccatttttactagtttcataaggagaaatgctggtaatctacatcacaatgtttttgccttaaaaaagaaatatcacgaagttttgtaaatctaatttgttatttaatgaattttactcgtaattttttaaaaa

SEQ ID NO: 605 - DNA, 582 bp, Oryza sativa
  Predicted polypeptide sequence is orthologous to G343
tttttggtgttttttttttttttttataccaacagaattgattgatctctctcatagaggaggaagaacttgcaagggaggtaggtaccaacaaattaattaacaaaaaagcattgaaaaatatctggaataaggcaaaaaagagaaaaaaagggagaggaaataaacaagagaaagggagacgggagaatttcgcaaaaggatctaagcccgcgcgtctgtgctgtgcatgcatccatccatgcatgcgatgtgatgcgtagctgcgcctgcatggctcgctctggacgccgcgtgcgccgcttgatcagcacacgccgtagtcgcggaacatgagctccggcctcccggtcgccgcggcggatcccgcggcggcggcggcggcggctgctgctgcggccgcggcggcgtcgcggtggctgccgcggatgatgaggagctccttctggcggcgcagctccatgaccttgcggtgggagttggagtgctgcgtcagcacgaacgtggggctcgccgccggcctgtactccggcatcagccgcccggacttgaacccctcgtgccgaattcctgcagcccggg

SEQ ID NO: 606 - DNA, 1475 bp, Oryza sativa
  Predicted polypeptide sequence is orthologous to G343
ggcacgagggagagagagagagagaactagtctcgagtttttttttttttttttttttttttttggttgttttttttttttttttttttttttttttttttttttttgcaagacaatggtgggataacaaaggtagcaaccacccattggtattaaactgatgatctccaacaactagcagattaatttctcaagttaaaaaacggctagagctaacaaagagttcatgacgcctaactagattctgctttcgttttctcagcatctaaggctgagagcccctaaaagctcaatgcagcagattgagatgtgattatcagctcacttctacgaccaaggagcccgcctaaaattcaatgagacagattaagatgttcttcactatcagcttacttctacaactgaagagttcctaaaactaaacgcaacagatcgagacgttcccgaccaccagttcacttccttgggtgtggaacagaattcctcagctgcatgaccttcttatgagaattggagtgtatgtcactcacaaaagttggactattagcaggcctgtattccggcagcagcctgccagacttgaacctcacaccgcaagcattgcatagcgtcttaggccccaagggaccggtcctccactgtggcgtcttgtaggacaagcaatgggtgcacctcttcattggctcctccgatagcagctcatcattcacataaacagccttcttgatcttcttcttatctcgccgctttcctatgtcctgttctttgtcaatctcttggccatagcgcttcttggaactggtggtgtgcccattcctcgcctcaatcctcagacgacaagcatcgcaggtaggccctgatggaccatcccaccactgtggtgattggctggacaaacaatagctacaagtgatcaccagttgctcctgctggaattgcattcctgcactcattttgtaattctcttcctcctcttgttcttgctcttggacaagttcttcatctttgtccttcttggggaggataagctcactctctgctagccagtccttatgatcgagcaggagtagcggtggctcgacaaacagcgtgatacaatgttggtcatcagtgtcgcttatgacagatgccaggctccttttcttttttcttgcattggtagatgagcgtggtggtaactttggttttgcagcaccttgacttgccattgtaataggcggtagttctgcagagacagggtttgtgcaggatgcagaggttgacaggcagtcctctacatagacagagagccactctatgccacttctatcactttccgtggcgggctggtgcgggaacaactcctccagcgaggaggcggccgcattcggcgggtgcacatccatgcccagcgacgaggaggagcagccgcacggttgaggagagagaaagaggagagagagagagagagagagaagcggaggaagaagaggggt

SEQ ID NO: 607 - protein, 387 aa, Oryza sativa
  Orthologous to G343
MASEWEMAMGVDLGMGMSTYHNASGGIAAAPMMGHHGGGGGGGGYSAAHHHHHHYYGMPHQAAMGDAMRVDDLLDLSNTPGAHDFFPASAAAAAAGDHGHHHHHHIGGMGEPSGATPSATSSDHQTSMLSFADDFYIPTEDAAELEWLSKFVDDSYSDMPNYQSSAHAAMAAAAASAANNGGGSSAGQDSCLTAAPGRGARSKRSRATAAAAAAWHSLVPRPPSQSSPSSSCSSSDFPSSNKPSGTARPNGSGGGSRGKKSPGPAGAEVGMEAGVRRCTHCASEKTPQWRTGPLGPKTLCNACGVRFKSGRLMPEYRPAASPTFVLTQHSNSHRKVMELRRQKELLIIRGSHRDAAAAAAAAAAAAAAGSAAATGRPELMFRDYGVC

SEQ ID NO: 608 - protein, 219 aa, Oryza sativa
  Orthologous to G343
MVGDKDAAALAGELTGDAGASLNGFFDHTGLESAVVGEGQGEGEEEEELEWLSNKDAFPSVDTMAAEVESAAPGAPARAAVGPRTKGLRRRRRVTAPWSLAPLLSRPRQAAAAAADAGAPRRRCTHCAVDETPQWRLGPDGPRTLCNACGVRFKSGRLFPEYRPANSPTFSPLLHSNSHRRVMEMRLQSEEDASAASRVNAKARRAERAAARLAGKDKK

SEQ ID NO: 609 - protein, 309 aa, Oryza sativa
  Orthologous to G343
MDVHPPNAAASSLEELFPHQPATESDRSGIEWLSVYVEDCLSTSASCTNPVSAELPPITMASQGAAKPKLPPRSSTNARKKKRSLASVISDTDDQHCITLFVEPPLLLLDHKDWLAESELILPKKDKDEELVQEQEQEEEENYKMSAGMQFQQEQLVITCSYCLSSQSPQWWDGPSGPTCDACRLRIEARNGHTTSSKKRYGQEIDKEQDIGKRRDKKKIKKAVYVNDELLSEEPMKRCTHCLSYKTPQWRTGPLGPKTLCNACGVRFKSGRLLPEYRPANSPTFVSDIHSNSHKKVMQLRNSVPHPRK

SEQ ID NO: 610 - DNA, 851 bp, Glycine max
  Predicted polypeptide sequence is orthologous to G353, G354
agcggattgaaaatggcttggtttgtgttctgttgcaaatatttttttcagtgactcagaatatcacgatgaagttctaattttgcccaagaaatgagcaatttttcatacagtatgataaacaaatatagacggtagattaaaaaaacaaaacattcacctatctatgatacacaaactataccttcctaagtttaattaacagtacactcaacagatcaatcaatacaaataatcaacaaaagtagttggctttccaatcttcaaaaactccaaatcattctcaaagggtgtcagattcaaatccaaaaccaaaactctcttgttgtcagctttcttcttgggcgatgaatcaaaactgctacccccactactactactcgtagccgtagcagaattgtacacgttgtttccattcaaattcgccgctctgtgcctcctcatgtggcctcccaaggcttgccctatagcaaactccaacccacaaatggaacactcatgagtcttaggctttgggggtgaatcatgaagcaattggccttcgatattatctcctgccatcaacctaggctttttgtggctagccctgtggccaccaagtgcttgaaatgaagggaattgcctattacatgtcttgcactcaaagacacgattgctcatagaagtgcttgagtaggtggcctcaaattcacttccacgagaaagcaacatcaaacaattcgccatggttaagctatcaacctctctttctctcttcatgacaactaaccaaaacaaaaattgaaatatggccgggtgcttggttttaaggtgtggaaaatgaatatgtgaatgtatgaaaagggacaaag

SEQ ID NO: 611 - DNA, 803 bp, Glycine max
  Predicted polypeptide sequence is orthologous to G353, G354
gtcgacccacgcgtccgtacggctgcgagaagacgacagaaggggagggcacttctccaatctcaacaactttcgtgtagtgcactgttttgctatagtaacccattaattaaaccgacctacgtagtagccatgaagagaggcagagaagagagtaagttagacatggctaattgcttgatgctattgacgaaagttggagagagtgaaaccaattacccaatatcaaagggtagtgatattggtgatttcaagtgcaagacttgcaatagaaggttctcttcttttcaagcccttggtggccatagagcaagccacaaaaaaccaaagctcatggtcacagatctttcgtgccatcaagagttaccgaacccaaccatgaaacaacaacctaggatgcacccgtgtccgatttgtgggcttgagtttgctattggacaagctttgggagggcacatgagaaagcatagaactgctattaatgatggcttgttgtgtggtaaaccttcttcttcgttgtccatcttgaaggaatcatcgaaagatggtgatcaaaagttgaatttgcgcttggacttgaacttgacgccattggaggaggatgatcttaagctcaacctaaggacgcccgtgctcaattgtttcatttgattggaaattaattttgtactaaaccagattctttttttcttattaatatagttaatgtgtatttttcgtaatttattattatacgtacgacctataggtagctcattttgtagtcatattgtgttcataatacgaaacttcttagttcttat

SEQ ID NO: 612 - DNA, 924 bp, Glycine max
  Predicted polypeptide sequence is orthologous to G353, G354
tgccgcccccgcggccctgcttccccattagagaacattttaccaattgagcactttcaaacaacgttgttgttttttgtacacaaccatcagagataaggagagtgaggtgggcatggctagttgtttaatgttactaaccaaagttagtgataccgaaaccccatcaagaaagagggttctaagtggtggtgattttaagtgcaagacttgtaacaggaaattccaatcgtttcaagcacttggggggcaccgagccagccacaagaagctaaagctcatggcttcaaacctttcgtgttcgaccgtgacacaaaagatgcaccagtgccccatttgtggaattgaatttgcgattggacaagcactgggagggcacatgagaaaacatagagcttccttaaacgatggtttgataactcatgatcatgttgtgccaacatctattggtactaaaaggcttcgcttgtgcttggacttgaacttggcaccgtacgagaatgatctcaacctcaatttaaggacacctactttaaatttgttcgtttgatcgatttgagtgttttttgggcgaattcttgttggaaattgttttatttttattttttgtttcttactttgccgtgctttttagtttatgacgtacgcgtgattctatagggttctatgtatattcatggtgctaacttgaaagtacagggaaaattttgctgactaccgttaagcaaagcatattaagcatactatcatggctcttttcaggaacatgttttgaaaagtcactttcaatatgaaggattcagttactgttagttgagggtagtaattattggttggatctgttatgatagataccattaactgtgagattaaaaacaaaatagaattgcccacacttatctttgtctaaaaaaaaaaaaaaag

SEQ ID NO: 613 - DNA, 760 bp, Oryza sativa
  Predicted polypeptide sequence is orthologous to G353, G354
ggtcaccctgcggggcccggcgcgggtatcgatctgcccccaaccaaaaatctctctctcaatccattgatccattaattcacaagcttatcgaatcggagatgaagcacccgaggcaggaggaggaggtgtcgctggcgctggcgctgagcacggactgctcgtcgacggcgtcggactcgtcggcggcggcggcgggcggcgcggcgaggaggaagagggcgcggcggaggagcgtggtggcgacgtcgggggaaggggagttcgtgtgcaagacttgcagccgcgcgttcccgaccttccaggcgctcgggggccaccggaccagccacctccgcggccggagcaacgggctcgacctcggcgccatcggcgacaaggcgatcaggctgcacagggcggccgacaaggagcacagggacaagcacgagtgccacatctgcggcctcggcttcgagatgggccaggcgctcggcggacacatgcggcgccaccgcgaggagatggccgccgccggcggtggatcctccgccgacgactgggtctggcgctgcgacgcgcggccggaggggatcgccgccgagccaccggtgttgctggagttgttcgcctagttaccgctggtctccattagtttcgtccaagttttgaactgacgcagtgtgtgtcaccattaattagttcatgtacatggtctagaaaaaaaagtcaggttcattcgatcttgtaactatgaataggggtttaatttttttttttc

SEQ ID NO: 614 - DNA, 568 bp, Zea mays
  Predicted polypeptide sequence is orthologous to G353, G354
ccccgcgtccgccaagtctcaccgccgtctctctcccagtcccaaatcttgagctcgatcgcaaaccctcagacacttcttcccccagccgacgtacatgaagcacccgagagacgccggcgccatgccgctctccctcgcgctgtccctcggcgccggcgtggcccccgggcacggcagcagcaagcggccccggcgcgcggcgggcggcggggacggcgagttggtctgcaagacgtgcagccgcgccttcgtctcgttccaggcgctgggcgggcaccggacaagccacctgagggccggccggcacggccttgcgctcgggatgcccgcgccggcgccggcgaaggaggcgccgccgcccgcgacgacccacctgtgccacgtctgcgggctcggcttccagatgggccaggcgctaggcggccacatgcggcgccaccgcgaggaggctgccgccaccaccgcgcaggcgccgcccgtcctcctccagctcttcgtgtagagttttgcccgtccacggagtctagctagtagaaggaattcttcgcgttccctgtcgtcactc

SEQ ID NO: 615 - DNA, 1503 bp, Zea mays
  Predicted polypeptide sequence is orthologous to G353, G354
acccacgcctccccccacgcccccggcacaaaacacatcaccgcatctttttccttccgagctgtacgtatctgcagagagagagagagagagagagagagagagaaagattaggtcagagaccatgaagcacccgaggccgacggagcaggatgtgtcgctggcgctgtcgctgagcacggactcgtccacgacgacgtccgactcggcggggacgccaccggcgaagcgggcgcgggcgcgggcgcggcggcggggcgccgtggtggccacgtcgggggagggcgagttcgtctgcaggacctgcagccgcgccttcccctcgttccaggcgctgggcggccaccgcaccagccacctgcgcgcgggccgccacggcctcgacctcggcgtcgtcggcgcccgggcgctcaagcagcacaagcagcaggccgccaacgccaacgccaacggctgcgaaggaggcaataagcagcagcggcggcacgagtgcaacgtctgcgggctcggcttcgagatgggccaggcgctgggcggccacatgcggaggcaccgcgaggaggagatgggcgccgccgacgcctgggtcaccctctggcgcaccgaggcgtcgcgcgccgccgacccgcccgtcttgctcgagctcttcgcttagatgattagatcgatccggccggcatcgggtcgggctaatccctccttgttatttggggggaggctaactcgtcatctagacatctagtagcgtcggtagtttaatccaggacatgtaaatcgtattggttcgttcgttgccttttttttgtaattacgctagtatagtactagcttctgctgtgtttagcggttcggtcatggggccggttggattcaaaaaaaaaaaaaaaaaaaaaaaaaaaaaaaaaaaaaaaaaaaaaaaaaaaaaaaaaaaaaaaaaaaaaaaaaaaaaaaaaaatggcaacgaccctttaaaaagatatcagagtttccgtggggcgcccccctctgttctttcccttttccccccccccccccccgtgccgccttctctttttcccttttttgcccccctttttactttttccccccccccgccttttccccccctttgccccgttggccccccctcccccccccccccctttcgcctcttcccccctttcccccccttttcacccgcgctttttaacagcacatgccccccccctgtgctcccttccccccccttttggtcccctttttggtaccgggcccccccccttcccccccccccacccccccccctttttttatagcccccctcccccggtcttttccctttttttcccccccctttgccccccccttttggggttttttcccctccgctttccggccccctgggccccctttttcccgcctatagtttttaagcttgggcgccccctttccgcctacactattttatgggttttgccccccttcccccccccgatacccctggttggtgggatcgcgggtccc

SEQ ID NO: 616 - DNA, 499 bp, Zea mays
  Predicted polypeptide sequence is orthologous to G353, G354
ccacgcgtcccactgcggcctgctgctttcacctccctctccctctcgggctctctcctaacatctcgagctcgatcgcaagccctcaccccctcagacactccttccccaccaccgacatacgtacatgaagcacccgagagacgccggcgccgtgccgctctccctcgcgctgtccctgggcggcggcggtggcgtggccaccaagcacggcatcagcaagaagccccggcgcgcggcgggcggcgagttcgtctgcaagacgtgcagccgcgccttcgggtcgttccaggcgctgggcgggcaccgcaccagccacctgcgggcccgccacggcctcgcgctcggcgtgcccgccgccgcgccggcgaaggaggataccgcgacgaagccggcagcggcggaacccgcgcccgcgagccacctgtgccacgtctgcggcctcggcttcgacatgggccaggcgctcggcggacacatgcgccgccaccgcgaggaa

SEQ ID NO: 617 - DNA, 798 bp, Zea mays
  Predicted polypeptide sequence is orthologous to G353, G354
gtcagcaaacttccgtcgatctctctcgatggtcatgacgcttacgagacacgactcgggagagagcaaggagatggagggcctccgtgcgcactccgaggccgcgctgctcacgctgtcgtcgacgacgacgggcggcaccggcaccggcaccggcaccggcacggccgcggcggcggagggcgcgttcgagtgcaagacgtgcagcaagcggttcccgtcgttccaggcgctgggcgggcaccgcaccagccacacgcggctgcaggcgcggacgctcgtcggcgacccggccgagcggtacgacgacaggccggcggcgcgggtgcacgagtgcgccgtctgcggcctcgagttctccatgggccaggcgctcggcggccacatgcgccgccacaggggcgagggcccgccgccaccggccgcgcacgacgacgacggcgacggccccgcccagccggaccgggacatgcccgacctcaacctgccgccgttggacgacgacgatggcagccaagcaggttcacggcagtcgggcggtggtcgcggctccgggcctcagctgctcaacctgctcgtatagcgtgcgtggcgtgcacagattgtggttcggatcgagatgtaaatgaatcgtggcttagattttggaacctactacacgtgagatggaattcttcgatgacgagcttatttagttccataggttgttcctggttttagttggtttgctccttcgtgtaatgcctattgttcggttcaattcatttgttgtgagtaaaatatactctcacattagac

SEQ ID NO: 618 - DNA, 570 bp, Zea mays
  Predicted polypeptide sequence is orthologous to G353, G354
acaccacctgcgcatcttctttccgagcagtacgtacgtagctgaattgctgaaaagagaggcagagatccgatccggaccgcgaagagacgatgactcacccgaggccggatcatgaaccgtcgggcgaggtgtcgctggcgctggcgctgagcacggactcgtccggctccgcgggtgccccggcggcgaagcgggcgcggcggaggggcgccgcggcggccacgtcgggggagggggagttcgtgtgcaggacctgcagccgcgccttcacctcgttccaggcgctcggcggccaccggaccagccacctgcggggccgccacggcctcgagctcggcgtcggcgccagggcgctcagccggcagcagcacaagcatcatcagcaggccggcggcggcggcggcggcggcggcggcggaggaggaggtggagacagggagccgcaggcgcagcacgagtgccacgtctgtgggctcggcttcgagatggggcaggcgctgggcggacacatgaggcggcaccgcgaggagacgacgacgggcgccgccgacgcctgggtctggggcg

SEQ ID NO: 619 - DNA, 788 bp, Zea mays
  Predicted polypeptide sequence is orthologous to G353, G354
  misc_feature (646)..(646): n is a, c, g, or t
  misc_feature (693)..(693): n is a, c, g, or t
gattcacccgcttccgagaaagaattaatagcactcgatcgatcgggctcaccacgtccagctctcggtcctcgtctttgctgctagcagctagctagcttcgcgatcgtgctcaagatcaacgacgatccatggcgtatggcaagaggtcacgccagaaggccgaggagatggtctggctgcccgacggcgccgatgtcgcgcgcttcctgctgctcttctcgggccaccagcactaccacggcgacggcatggcggcctcggcgcccgagcgggtgttcgagtgcaagacctgcaaccggcagttcccgtccttccaggcgctgggtggccaccgggccagccacaagaagccccgtctctcggacggcgtcgatgccgcagcggccgagccgcccaagcccaaggtgcacggctgctccatttgcggcctcgagttcgccatcggccaggcgctcggcgggcacatgcgccgccaccgggctgccgatcagacagacggcggcagcctcggcaccgggctcaccccgaaatacgacagcggcaagacggccgcatcgccggccgagctggttctggaccttaacgccgtgccggagctggagggggagcaggatcacgccaagctggagctctccatcgaatntcccgtagcagtagttgactttcacgcacgctaagaaataacgtggnaatagattgaatccttctcggtttcatttttccattattatttacataaattacaaaaatacacattaatcaaaaaaaaaaaaaaaaaggcccct

SEQ ID NO: 620 - DNA, 1132 bp, Zea mays
  Predicted polypeptide sequence is orthologous to G353, G354
gtaggccgcgaacctttttcccattatctaaaaaatctatctccaagccatgaactgcaaaagtcagaagaagcagctgagtcagtaacaataacaagtaatcctgatctgattcccagcagaagcttctttctgtccctccaacggaatctgtccatggttcatcaaccatgcgtgctgccgtggcacggcgtcgactcggcgcgaatcgacgccgtctgcacttgcctctgtgcccaatcatcgtcgctactgcacgccgtagctgcgaatcgatccacataaaacaactccgtctccagcctagctaatactaacagctatagagctgagtgactgacacccattggcggctggactattagtttatgcttggcgtttgtaatgctcggcctataaatacgcctgctcagtgatctgatgctccggcattcagatatatacagataagattttcttgctagcctcgaatcgcgatcgagtagctcatcagctgattcacaagtgcaagcatttgatgaagaggtttgcagttcaggagagcgagatggcgcgcatgctggtgctcatgtcgcgctcgcacggccaggaccaggcgctgccactgtcggcctgcctcgccggcggccagcaaggcgaggaccggcaggcgccggagcgcgtgttcgtgtgcaagacgtgcaaccgcgtgttcccgtcgttccaggcgctgggcggccaccgcgccagccacaagaagccgcggctggacggggacggcggcggcgacccctcgctcgccaagcccaagctgcacggctgctccgtctgcggcctcgagttcgccatcggccaggccctcggcggccacatgaggcgccaccgcgccatgacgggcggcgtgccggcggtgccgcccgcgacgacgaggatcgtcgtcgacgagaagccggacggcgacgtcgtcggcatcatccgccacgaccacgtccacgaccacggcggcgtcaagcagccccgcggcgggctgtggctcgacctcaactacccgccgtgcgacgacggccgcgacgcgggggaggcggagtgtggccgcaatgccgccgccgccacggggatcacgttccatcaatttcctcgacactgccaccat

SEQ ID NO: 621 - protein, 198 aa, Oryza sativa
  Orthologous to G353, G354
MKRFAFEDSDMARVLMLMSSHGQQEQALALPVPVQLPLAAARGDRAPERAFVCKTCNRVFPSFQALGGHRASHKKPRLDGDGDLSLSKPKLHGCSICGLEFAIGQALGGHMRRHRAMTGGMPRAIVVDKKPDVVDVHVHGHDDDGGIKRGGLWLDLNHPPCDDAGDDDAECGHNAAGAGITFHQFLDTGAMAVDCVGY

SEQ ID NO: 622 - protein, 187 aa, Oryza sativa
  Orthologous to G353, G354
MSVASPSPSWQTPYRIGDEAPEAGGGGVAGAGAEHGLLVTASDSSAAAAGGAARRKRARRRSVVATSGEGEFVCKTCSRAFPTFQALGGHRTSHLRGRSNGLDLGAIGDKAIRLHRAADKEHRDKHECHICGLGFEMGQALGGHMRRHREEMAAAGGGSSADDWVWRCDARPEGIAAEPPVLLELFA

SEQ ID NO: 623 - protein, 186 aa, Oryza sativa
  Orthologous to G353, G354
MKRLTFGAEPEMVDSASIAQEVMLLLARSGGGGAGYVVGHGGEAPRVFECKTCRRRFPSFQALGGHRASHKRPRGGGGGGAAAAVAAAAGEGEAGVALSLAAGTPAVKASRAHGCAVCGVEFALGQALGGHMRRHRIAGAEADEAVSARGGEPAPERNPREARGVVGLDLNAAPADDTGLLLVDCL

SEQ ID NO: 624 - protein, 206 aa, Oryza sativa
  Orthologous to G353, G354
MSKRQFGEMDGGIDTARVLMLLSRRRRQHGDVGHARAARVFECRTCGRRFPTFQALGGHRASHKRPRHGAERAPRPAGDDDVGAGAGAALRLVGAASSLSTDEARAGGGGRRTRGAGAAHGCPVCGLEFAVGQALGGHMRRHRAAAGDVAAPRVKTDDVVVGDECTGGICLDLNLTPSENCDKCRHAQLGVAVNSVQRTILLDRPL

SEQ ID NO: 625 - protein, 217 aa, Oryza sativa
  Orthologous to G353, G354
MSKRSRSMWDMQEFVGSVDTARVLMLLAQQSQHGLLGGGGFAAGAQPVVVRGGAHDRVFECKTCNRQFPTFQALGGHRASHKRPRQQQQHALGGGAGADDAGLCLGRQPTPPRPQPAKPRVHECPVCGLEFPIGQALGGHMRRHRAEAEAAATTTTTTTKNGDVGKAAAVKACDGGGVCLDLNLTPSENRAKCRNVVGLGAGGQGVHKALAMLDCFL

SEQ ID NO: 626 - protein, 159 aa, Oryza sativa
  Orthologous to G353, G354
MESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 627 - DNA, 1088 bp, Glycine max
  Predicted polypeptide sequence is orthologous to G361, G362
gtactaagtgaaataaataattcgcttgaaaaaataggaagtgaatatgaaaatgtacactatatgaagctgaaacagccatgatatgcctttaaacggcgcgtcaagcctgaacaaagagactactattagactcacagtcacagaatttcaagccgagccgagagatgagggcgcagctggcgcaagactaaggtgcaagtccaagccccatgcatcatcaaatttgggcccactgtcacctttggaaaacctactcaaagagggcccatcaatcctagcgtggtgggcccgggcctgaacctgcaccgttgacaaagctaatgacgaagaatctcctacaacgccaacatagggaaacatcccagcacccgcagatttcacacccgttgttatggtcacgttattactattattactactactgctgctgaagccgttgttgttgctgttgccaggcgccgacgggaacgcacaaccgtgcgacactgacacgtggaagggaggaggcgcggcacgtggtggcacgtacacccacgagggaggtgccgccgggaccaccacggtccccggcggagccagaaggtgcggcggaggggcgaaggcggagatcatcggattccgaacgaacgaaacggcggcgtttcgggaggcctgtaactgcgcccgcttcagctgctgacgctccttcttgtgcgcgttctggtgtccgccaagtgcttgtgaatttgcgaactctcggcagcagtattggcactcgtatttccggtcggcggaggaaggtggtccggcaccggcgacggaggagtccggcgagtcagacggggaagaaggggaagtggaagaagtgaccttggtggtggagtctgccacgtcatcatgcgccacctcgtcttcgtccatgatgtcttcgtggtgtacgctgaaaccgaagagcttcaagcgcgttggggaagtggggtttgtttttttagtgttgtagtcaagttgggtggtttccatgagaaggaaggaaggggtagtagtgaaagtgtggaacaagaaagaagggtagttaatgtgtttcccgagccggatcgggctcgagc

SEQ ID NO: 628 - DNA, 1020 bp, Glycine max
  Predicted polypeptide sequence is orthologous to G361, G362
  misc_feature (935)..(935): n is a, c, g, or t
cccacgcgtccgtacggctgcgagaagacgacagaaggggattgctaaacaaaagaagcatgtctaatcatcatcacgtagttcagacctcgccaccgaaactattcggtttcccactaacagagcaggaggaattgaattcagatgcagaaagaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctaccctcctccatttacttacgaggaggccctcctactacttcttctcttctacccatcttccatcctcgtcaacccaataacactaagcacttcccatcacggcccattttgattccttcttccacctaccaccgtgctaattgcactccatcctttccttttcagctttatgcctcaccctctgtactgcaatctgctcctaacgtccgtgatttttctgctgagagcagggaagttgatgtccatctcaaattataactcttagattgattattattaatttttttagtgctagtttctagctgcttcagccttctttgctccaaatagatcttatctttttttctcgccccttcagattatgcgagcttgctttaccaattattggctcgaatagttaaacagtactttccagagtaggagctagacactgtagtgtggtaaatcccccagtccttatatttcattttactactatatagccaaaacttgcatgtaaatcagatcagcaaaaaaaaaaaaaaaatgaaacattagcattccctgctnaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 629 - DNA, 676 bp, Glycine max
  Predicted polypeptide sequence is orthologous to G361
tgccactactgctgccgcaacttccccacctcccaagccctcggcggccaccagaacgcccacaaacgcgaacgccagcacgccaaacgcgcgcacctccagtccacgatggtgcagggcagcaccttctccgacgcgcaccatgtctacaatctcatgaactaccgctacggttcttccattccaacaccaccaccaccaacaatgccttatccaacatggaacaacaacaacaacaacacgcgcttctacggaacaacaacaacgacgtcgttttctcaccaccaccaacaccaacaacaacctattaacggaagccccttagcattttggcgaattcctaatggcaccaccattaataataataaccctagtttcagccacgagcgttcttcgacgttgccgcctttgttcgcgactgaggaaatagcgaacgtgagagcctcctcgcaggttgttgtcggagcctcggggccgatgacgacgcaaaaccgctacgtgtatgactcgaaacaacgcgaccatgtgagtttggatcttcatctgtaatagtagtaacatgtttcatgttttcgtacatagtattatcatgagccagtaataacaactctattatgatgatgatgatggcatggcgctacgagagaatcgagggatttgcaggcagcgactcttt

SEQ ID NO: 630 - DNA, 882 bp, Glycine max
  Predicted polypeptide sequence is orthologous to G361, G362
tttttacttattaaataaaatttacattcacatacaattcagagtacaaaggttgctattaacaagtcgatacttttaaggaagattttatgtttgagtacctgaagaaaaaaaatatgaccgagaagagattcactaaagtgacttgtcaggttcaatctttatagcagagacacaccaacaacatggtgataaaaagaaaaaagaaaaaaaaaatagaaaagctgctacacatttggtgctaaattgaatgaaaaaactgattcacaaaactcacaggctaagatgcaaatccaaacctaaccctcgttcacgaccaccaccactaccttcacccccgttgaagccaccgaactgcggcagagggtggcggtgaccatggccatcagtgatggaggcaccagctgctgcaacatagattcgtcttccagaagccacaaaggcagctcctgaatgatatgcaccaccatgtggtgtgcataaccacgacaaaggtggctgagactgtggtgagaagcttgatatgattgtgttgtgaatctgtgaagaaacaaaaccacgagcagcttgcatttgggcacgtttcaagagctgtctttctttcttgtgcgcgttttgatgccctcctagtgcctgtgagtttgcaaattctctgcaacagtactgacactcgtactttcttgaactgaaaggctcagaattcgaacctgcttcatgagtttgatcttctggggacttgctaatgttgatgccaaagagctttaggggttgagtgttagtattggattttgcatggtattcaatttcagccatgatgaattgtgtgagggaaaaagaaaagatgcaccaaaatatgtggttaagtagtaacagcggctcgag

SEQ ID NO: 631 - DNA, 619 bp, Glycine max
  Predicted polypeptide sequence is orthologous to G361, G362
cggttcggaatttccggttttacttacgcgtccgccactcgtccgcccacgcgtccgcactaacagaggaggaggatttgaattcagatgcagaaggaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctacccttctccatttacttacgaggaggccctcctactacttcttctcttctacccatcttccatccttgtcaacccaataacactaagcacttcccatcacggcccattttgattccttctttcacctaccaccgtactaattggcactcatcctttccttttaaagtttatgccttaccctttgtactgcaatcttgttctaacgtccgtgatttttctgctgagaagcagggaagttgatgtccatcttaaattataactcttaggatgatcattattaaattttttta

SEQ ID NO: 632 - DNA, 463 bp, Oryza sativa
  Predicted polypeptide sequence is orthologous to G361, G362
  misc_feature (439)..(439): n is a, c, g, or t
  misc_feature (452)..(452): n is a, c, g, or t
ccatttctcatcactgagctgagctcagttcagttcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaagctcttcccttgcctcttctgcaacaagaagtttctcaagtcgcaagcgctaaggggacaccagaatgcacacnagaaggagaagancgtcgggtgga

SEQ ID NO: 633 - DNA, 824 bp, Zea mays
  Predicted polypeptide sequence is orthologous to G361, G362
  misc_feature (731)..(731): n is a, c, g, or t
gccggccgggccgggatcagagcagctcgcaccatgccaacataccaccataaacgcaacagcagccgggcagtcgagagaactcctggagccgtgggtgcctgggtggctagctgtaggtcttccttcttgcttccctacacatccgatcccttaccctaggggcacatctcgcgctcttgcgctgcgacggcgaattggcaatgagtgagcaagacgggcagcacgtcgggggcagcccgccggacgcggccatcgagtccttctcacagctccccttcgtgcgccccaagcccccgcagccggcgtcctcgtccagtccgtcgtcgatccggctgttcggcttcgaggtcccacccgacgccgccacgtcctccaccgcaaccagtgacgctaccgccgccagcgccaccgtagcgggccaggcggcggcgtcgggcgcggcgggtgcaggtgcaggtgcaagcgatggcaccggcggagggcgcaagttcgagtgccactactgctgccggaacttcccgacgtcgcaggcgctgggcgggcaccagaacgcgcacaagcgggagcggcagcacgcgaagcgcgcgcagtaccagagcgcgatggccatgcatcacgcccactacccaggccacccccacgcggaccccgccttcactagctaccaccagcagcagcgcttcggcatggcgcgctacgagcccccaccgccgggaccgccgccgcantaacccctcgtggtccccgcaggctgctccgccagtggtgccagatactacgggaggggctgctccctgtcgcagcccatcacggcaccccat

SEQ ID NO: 634 - DNA, 1414 bp, Zea mays
  Predicted polypeptide sequence is orthologous to G361, G362
tacctcgaggccggccgggccttcagctcctcgctctcctcagtccttaccatccatcgatcgcgaaggaagggtgctgaggaggctttcccatgcaccctcgttcctactagccacaccagctatgagacaccccggctacttccttcttggtacgtactggtggcggtactgaaaactactccgcagagatacacgagaagacgtatagttctgtacctagccaagccaagctacctccctcgctcgctccacacctgcctgcatgggcggcggcggcgaaggcagagacagcggcggcggcggcggcgcggcgagctttcgggaggcggctcgtgacttcagcaacgtcgcgtccttctccgagcttccgttcctgcagcgctccgccgccccgccccgtggaagcccccacaactccggcatccgcatcttcggcatcgacgtcccgcactccccaccggagagaaactctaataaagatgccacggccgctactactactaccgccgccgcttccgccacgcagagcagcggcggcggcggggccaccaccgacagcagcagcagcagcagccgcaagttcgagtgccactactgctgcaggaacttcccgacgtcgcaggcgctcgggggccaccagaatgcgcacaaacgcgagcggcagcacgccaagcgcgtgcagatgcagtccgcgatggccgccgccgcagccgcggcggcggcggctggcggcgcgcaccaccaccacctactcggctacccgcagcaccgcttcggcgtcgcaggccccacggtggcgacattgtacccctcgtggccaacaatgaggcctccagctccagcaggcgccggtgccggtgccgtcgccatcggcggcccgcagttctacagcgggatcggctcgatcgcccagccgatcaacgggagccccctcctcacggctgccgggctctggaggggcccgccgccgcctgctgccgggcatgggaacgcgagcttgccgtcgtcaccaggcggagagcgccgccggccggtcgcgctctcgtcctcgtcccccgtgttccgcggagacgatccgagggcttccacttctcttttggcggcggcgtcgtcgccctcctcttcctcctctttgctgctatctccacaaggtcagtttgtctgtgagcagcctgctgccaccactgcggccgagggcgtgagcctagatttgcatctataattgtttccttttggtcgtctatgctgcttttagcggacgacggtggtgtgagcctagattttcacttgaattcagatcgtgccttgtttcctgacacgggtgcacaagaatttcatctatcgaagtttcggaactttttgtctgtgtgcatacacatatacagaaagattcagacaatatgttagggtt

SEQ ID NO: 635 - protein, 242 aa, Oryza sativa
  Orthologous to G361, G362
MAGVVQTVQCDQPSKQQLTEAAEAAAAAAAAASLRIFGYEVGGGGGGGGVAAAAGARREAADVVVGAGRRFECQYCCREFANSQALGGHQNAHKKERQQLKRARLQLAVAAAGTPAGMGFAAAQAPAPPPGHVIAVGHHAGSVASYALPRWVYLAAHHLQPPAVGLPFHATVQAAAGACHGGGDVETRLLSVAAAGRGSSTAGSSAHSYEVCAPAAPADDSDEEASAMGLDLHLSLAPASSA

SEQ ID NO: 636 - protein, 210 aa, Oryza sativa
  Orthologous to G361, G362
MEAPPSLSIVDEDGFVIDLSLTLGLTSPPPSPGGASPSIPPGRGGGGGTSGGDNNRGSRGGGNGGGGGGVRLFPCLFCNKKFLKSQALGGHQNAHKKERSVGWNTHLYLPAGVAAATTTTTTTTAMAVPDMVGMPTHQMSSMALHSCRPHQGSHVTAADIATLAAPPHYTVDHGVAGIASGGGDSSVGWRQRQREAGGEKQRQVDLNLKL

SEQ ID NO: 637 - protein, 267 aa, Oryza sativa
  Orthologous to G361, G362
MSMTSPRLKLFGFDVSEEETAEHEEQYSAEPESAPVCGGNGGGGGGGSDSSSSSTTTTTTATAGGDGRRYECQYCCREFANSQALGGHQNAHKKERQQLKRAQLQAAAAAAGRVAGGAAALYPRANPMVSAFAPTPHLLGGGEAGPTSWVYFSPRAAAVAGGAQGQQFHVSHGCVFPARGAGPAAVAAASPAVFSYTPATSAAAVAAASAPYVTTDEHHGRRIHASSAASLARYPGPAMVVAEPVATVPEDTCLGLDLQLSLAPAGL

SEQ ID NO: 638 - protein, 128 aa, Oryza sativa
  Orthologous to G361, G362
MSMTSPRLKLFGFDVSEEETAEHEEQYSAEPESAPVCGGNGGGGAVGSDSSSSSTTTTTTATAGGDGRRYECQYCCREFANSQALGGHQNAHKKERQQLKRAQLQAAAAAAGRVAGGAAALYPRANPM

SEQ ID NO: 639 - protein, 279 aa, Oryza sativa
  Orthologous to G361, G362
MAKPQDMRSVDSFSQLPFIRPAPPPQQQARDTIRLFGCEFSNDLQLRPTEAGAGSPDAANGSTVTSEGSNGGDGGTKNGGAATAAAERKFECHYCCRNFPTSQALGGHQNAHKRERQHAKRAHLQASLAMHRYMPGHMYGLFNYHHHIGGRFDHHPPPPPPPPPPAHYPMWTSAAPGAFAGPGSMAQPINGSPVQAGLWSVPPPTENFGSTAGRQGADKLATTVAGTPAAGEVACKDEMVPMSLLSSSPSLSSCSSTSPEMLGRCELGQKEGVSLDLHL

SEQ ID NO: 640 - DNA, 3416 bp, Glycine max
  Predicted polypeptide sequence is orthologous to G390, G391, G438
ccacgcgtccggaagaacaaccgctaactgtggttgcactaaaatatactcactctttttctctgtctccattcgtttctctccgctttaacgttgccccagttaagttttcttatgtaaaggcacaccctttacctaattactagtaccaacaccaaacaaccttgcctttttattctctccttcttgtgttacctttgttgtgtagtgagtgagtgaaagcatggctatggttgtggctcaacacagagaaagtagcagcagtggaagcattgacaagcacttagattctggtaagtatgtgaggtatactgctgagcaagttgaggctcttgaaagggtctatgccgagtgccctaagcctagttctctgcggaggcaacaattgatcagagagtgccccattctctccaacatcgagcctaagcaaatcaaggtttggttccagaaccgtaggtgtagggagaagcaaagaaaagaggcatctaggcttcagaccgtgaaccgcaaactcactgcaatgaacaagttgttgatggaggagaatgatcggttgcagaagcaggtgtcacagcttgtttgtgagaatggttttatgaggcagcaattgcatactccatcggcaacaactactgatgctagttgtgattcggtggttaccactcctcagcataccctgagagatgctagtaaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacaaagattgcagagatccttaaagatcgtccatcttggttccgtgactgtcggagcctagaagtttttactatgtttcctgctggaaatggaggaaccattgaacttgtttacacacagacatatgctccaacaacactggctcctgctcgggatttctggactctgagatataccacaagtttggaaaatggcagtcttgtggtttgtgagaggtccctgtctggttctggaactggccctaatccagctgctgctgctcagtttgtaagggctgaaacactccctagtggctacttgatccgaccatgtgaaggtggagggtcaatcattcacatagtagaccacctaaatctcgaggcatggagtgtgccagaagtgttgcggccactttatgaatcatccaaggtggttgctcagaaaatgacaattgcagcgcttcgctatatcaggcaaatagctcaggaaacaagtggtgaggttgtttatggattgggtaggcagcctgctgttctgcggactttcagccagagattgagcagaggcttcaatgacgctgtaaatggattcaatgatgatgggtggactgtattgaactgtgatggtgctgaggatgtaattattgctgttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcaatgttgatgcttattctgctgcatcactgaaagctggcacctatgcctatccagggatgaggcctacaagattcactggcagtcaaataattatgcctcttggtcatacaattgaacatgaagagatgctggaagttattaggctggaaggtcactctcttgctcaagaagacgcttttgtttctagggacattcatctcttacagatatgtagtgggattgatgagaatgctgtgggggcttgttcagagctcgtatttgctccaattgatgaaatgttccctgatgatgctccattggttccttctggtttccgcattatcccattagattcaaaaccaggtgacaaaaaggatgctgttgctacaaatcggaccctggatttgacatctggttttgaagttggtcctgcaacaactgctggtgcagatgcatcatcaagtcaaaacactcgatcggtgttgactattgccttccagttcccttttgacagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactttgccaagttaatggagcagggttttgcttatctgccagctggaatctgcatgtcgacgatggggcgccatgtgtcatatgaccaagccattgcatggaaagttcttactggggaagacaacactgttcactgcttggctttctctttcataaattggtcatttgtatgaaaaatccaattcgtgtgccctgctttttcccacttgaacataaaaatgaaagggttaaaagggagacaagacaagtttggggggaaaaagaagtcgtaaatttttgtataacacatcaggatcaggtttgcatttaattcgatttaatttatttcttatttagtgcagagaccaaattgaattaatcttgtaaattatttagtgctagagtgaagttgagacttttgaatgacacatgttgagtactttgtttttgtctctactatctttccctcgaccttgagctcatacacagaagaacttgtgtgatgacaaagcgcgtttgtaatgtttattcttacacaatcacagttctgacttgtgtgtccaatgtagtactttgtttttgtatgtagtatgatcatatctttcaactcgagttaaatattagcacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccccccttttgggtctcgtccccccggaatttaattccggcccggtccctgggggggtcccagttttccttttaggggggcgttttaaagctgggggaaaaaagggaaatagttgt

SEQ ID NO: 641 - DNA, 2837 bp, Glycine max
  Predicted polypeptide sequence is orthologous to G390, G391, G438
cggacgcgtggccggccgcctgcgtgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggcggctgcgagaagacgacagaaggggggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccttgtgaaggaggtggttccatcatccacattgttgatcatatggatttagagccatggagtgtgccagaagtgctacgcccactgtacgaatcatcaacagtactggctcagaagacaactatggcggccctacgtcatctaaggcagatttcacatgaagtttctcagtccaatgtcactgggtggggtagacgaccggcagcactacgagctcttagccaaagattgagcaggggtttcaatgaggcactcaatgggtttaccgatgagggatggacaacaattggcaatgatggtgtagatgatgttactattctagtgaattcatcccctgacaagttaatgggtctgaatctttcctttgccaatggatttccgtctgtcagtaatgcagtgctatgtgccaaagcatcgatgctattacagaatgtgccccctgccattctcctaaggttcctgcgggagcatagatcagaatgggcagacaacaatatggatgcttacacagctgctgctattaaagttggcccttgcagcctatcaggatctcgtgttggaaactatggaggtcaagttatactccccctagcacacacaattgagcatgaggagtttttggaagtcattaaattggaaggaatagctcattctcctgaagacacaataatgcccagagaaatgtttcttttgcaactctgcagtggaatggatgagaatgctgttggcacctgtgctgaacttatatctgctccaattgatgcttcctttgctgatgatgccccccttctaccttctggatttcgcatcattcctcttgaatctggaaaggaagcttccagccccaatcgcacccttgaccttgcatctgcccttgacgttggtcccagtggaaaccgagcttcaaatgaatgtgctggaaattccagctatatgagatctgtgatgacaatagcatttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttagagaaaatatttgatgatcatggacgaaaaattctcttttcagagtttccacagattattcaacagggttttgcatgtcttcaaggtggtatttgtctttcaagcatggggcgacctgtctcgtacgaaagagttgttgcttggaaggtgctgaatgaagaagagaatgctcattgtatttgctttatgtttgtgaactggtcttttgtttgacatcttgttctgagtacactagtgcttattgtaatctaaagtgttagataaagatttactccagacacttgtgctttgttggttggtgttttactgtatttgcactaaatacttggattgcacatttaatgactatttatgtgttattagcttatgtaacttgtttccttattcaacatccagctaatatttatgcattcttaagaagtgttgcagcttcttatgtgtgtgg

SEQ ID NO: 642 - DNA, 3118 bp, Glycine max
  Predicted polypeptide sequence is orthologous to G390, G391, G438
ccacgcgtccgctcttataagcaaccccatctctctgtcccaatcccaacataccccccactggtccttttccattctttatacagacacacacaataaagaaaaagaaaaactacgttttcctttcactattctttttcaccctctccctctctcccatatatgatccaatatattgctataatacaatagaaccaacaactgtgacagacaaactctgagtagtacctcttttattctcctcctccttctctttcattctcaaaccactctgccatagtcttttctttcacctcttaatgaaacctcttggtttgtgtggttgaaacaaacaaagataagtcataataataaatcgggttggattcggaagggatgatggcggtgagttcagcctgcaaagatgggagcaaggtggcactggacaacggcaagtacgttaggtacacacctgaacaggtggaagcactggagaggctctaccatgaatgtccaaaaccaagttctcttcgccgtcaacaactcatcagagagtgtcccattctctccaacatcgaacccaaacagatcaaggtttggttccaaaaccgaaggtgcagagagaagcagcggaaagaagcgtcacggctgcaagctgtgaacaggaagctaacagcaatgaataaattactgatggaggaaaacgacagattgcagaagcaggtgtcacacctcgtctatgaaaacagctttttccgccaacagacacacaacaacaacgctacgcttgccacaacagacacaaacacaagctgtgagtcggtggtgacgagtggtcagcggaacttgacaccgcagcagcattccgcgagggatgctagccctgcaggacttttgtccattgcagaggagactttagcagagtttctttcaaaggccactggaactgctgtcgagtgggtccaaatgcctgggatgaagcctggtccggattccattggaatcgttgctatttctcacggttgccctggagtggccgcacgtgcctgcggccttgtgggtctagaacctgccagggttgccgaaatcctcaaagataggctctcatggtttcgtgattgccgaactgtggatgttctaaatgtgatgtccactggaaatggtggaaccattgagctgctttacatgcagttgtatgcgccaacaactttggcacctggtcgtgacttctggttgctgcgctacacatcacttttggaggacggtagtcttgtggtctgtgaaagatcacttaacaacactcagaatggtcctgctatgcccccagtgcagcattttgttagagcagacatgctgccaagcgggtatttgataagaccctgcgaaggagggggatccattattcatattgtcgatcatatggttctagagccctggagtgtacctgaagttttgcgcccactgtatgagtcatcaatgctgctagctcaaaggacaactatggcggccttacgtcatttgaggcagatttctcaagaggtttctcagccaagtgtaactggatggggaagaaggcctgcagcttctgcgtgcgctgagccagagattgagcaagggctttaatgaagcagtcaatgggtttgcagatgatggctggtccatgttagagagtgatggcattgatgatgtcacccttcttgtgaattcctcacctagcaagatgatgggagttagccttgtctataacaacaatggatttccttctgtgagcagttctgtgctatgtgccaaagcatccatgttgctgcagaatgtccctccagcaattcttcttagattcttgcgggagcaccgatcagaatgggcagacagcagtattgatgcttactcagctgctgccatcaaagctggtccctgtagcttgccaggggcccgatcaggaggttttggcgcgcaggttattcttccactagctcacacaattgagcatgaagagttcatggaggttatcaagcttgaaaacatgggctactatagggacgacatgagtatacctggtgatgttttcctcttgcaactttgcagtggagtggatgagcatgcggttggcaccagtgcagaacttgtttttgctccaattgacgcatctttctctgatgatgcacccattttaccttctggttttcgcatcatacctctagattctggcacagatgctgctagtccaaaccgtacacttgatttggcttctgcacttgaggttggcacaacagcaaacaaagcagctagtgacaactcagctcattctgggagcacaaagtctgtgatgacaatagcattccagtttgcattcgaagttcaccttcaagagaacatagcaaccatggccaggcaatatgttcgtagcatcattgcatctgttcagagggtttcattagcactttctccttcgcgctttggttctcacaatgcttttcacttaccacctggcactcctgaggcacaaacacttgctcgatggatctgtaacagctatcggttctatcttggggtagaacttctaaaatgtgaaggcagtgagtccattctcaagtctctttggcatcactcggatgcagttttgtgctgctctttaaaggcattacccgttttcacgtttgcaaatcaagctggacttgacatgcttgagacaactttggttgcacttcaagacatcactctggaaaagatttttgatgacaatggaaagaaaactctgtgcactgagttcccccagataatgcagcagggtttcatgtgtattcaaggtggtatctgtttatccagcatgggaaggccagtgtcctatgagagagcagttgcatggaaagtgttaaacgaagaagaatccgcccattgcatctgttttatgttcatcaattggtcctttgtctaatatattaaacagtattaggatgtaggaaagaaaagtagagcacaagagtacctaactttggcgaatccctagaatgctttaaaactctagtgggcatatgcgccaccaagatctatctatggccccatttgttttatttttaaaaaaaaaaaaaaaaaaaaaaaaaaaaaaaaaaaaaaaaaaaaaaaaaaaaaaaaaaaaaag

SEQ ID NO: 643 - DNA, 1005 bp, Glycine max
  Predicted polypeptide sequence is orthologous to G390, G391, G438
  misc_feature (972)..(972): n is a, c, g, or t
ccaaaaaagacattgttgcttttcattttggcatcacagagtatcagagagaaagagagagagagcggttttgcagaaaaaatccaagtaaatttaaggagccaccactgttccaatcagcccctttcattttgcagtgcccgtttattttttcgtgtttgcattcaccgttccacagaaggaaaaaagagtgctttgttccatctctttctgtggtgtgtctcaagataaaaagctcactcactcacagcagcaacaacccttttaccttaactcttgaaactttgttcagagtttggattttgagagagcatgatctgatgaaggagtgtggaggctctcttgggggagagggcaaggaagaagaggactacacaaaacaagtgttgtctttttgaaccccaaaaaaaaacgtttttttttgttttgttgttatggcactttgtatgcagagtcagcagagagattcagcatcaaacaagctgctcatggattgtggcaagtatgtgaggtacacacctgaacaggtggaggctttggagagggtgtatgttgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggctntcctttcaaaagctactggaactgctgtcaact

SEQ ID NO: 644 - DNA, 2252 bp, Glycine max
  Predicted polypeptide sequence is orthologous to G390, G391, G438
cctcgtgcccacgccgccgcctcgggagaccctggcggcgttcctttccaaagctactggaactgctgtcaactgggtccagatgattgggatgaagcctggtccggattctattggaatcgttgctgtttcccgcaactgtagtggcgtagcggcaagagcctgtggccttgtgagccttgagcccactaaggttgccgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattattcacattgttgatcatgttgatttagatgtttggagtgttcctgaagtacttagacccctctatgaatcaccaaaattcttggctcagaaattgactactgctgccttgcgacatgtaagacagattgcacaagaatcaagtggagaagttcagtatggtggtggacgccagcctgctgttttaagaacatttagccagagactttgcaggggctttaatgatgctgtgaatgggtttgttgatgatggctggtcactgatgggtactgatggagtggaagatgtgactatagccataaactcatctccaaacaaatttttgggctccaattacaacgcatcaatgtttccagcatttggaggtggggtcttgtgtgccaaggcatcaatgctcctgcagaatgttcctcctgctttgcttgttcggtttttgagggagcatcgatcagagtgggctgattatggagttgatgcatactctgccgcatgccttaaagctagtccctatgcagttccttgtgcaagacctggaggcttccccagcacccaggtcattttaccccttgctcatactattgagcacgaggagttcctggaggtagttcgaatagagggtcatgcattttctcctgaggacgtagcgatggcacgcgatatgtatctattgcagctgtgcagtggagttgatgaaagtgcagttggggcatgtgctcaacttgtgtttgcacctattgatgagtcatttgctgatgatgctctgttactgccatctggttttcgtgtcattccgttggatcctaaatcagatggtccagctccaactaggacattagatttggcatcaacgatggaagtaggttctggtaatgcccgtccagctggggaagcagacttgaatgggtacaaccttaggtcggtcctcactattgctttccaatttacctttgagaaccatacacgggacaatgtggctgctatggctcgccagtatgtgcgtagtgttgtgggatcagttcagagggttgccatggctattgctccctccaggttcaatacccagctggggccaaagtcactttctggatcacccgaggcccttaccttagcgcgatggatctgtagaagctacagggttcacactggcacagagctttttaaagctgagtccacagctggtgatgcaatccttaagcaactttggcaccatcccgatgcaatcatatgctgttctgtgaaaacaaatgcatctccagtgttcaccttttcgaaccaggctggtttagacatgcttgaaactactcttgtttcccttcaagatataatgcttgataaagttcttgatgaatctggcaggaagattctctgctccgagttctccaagataatgcaacagggttttgcatctctccctgcaggaatatgtgtatctagtatgaatcggccagtgtcctatgagcaggttgttgcatggaaagtcctcaatgatgatgattctaatcactgcctagccttcatgttcatcaattggtcttttgtatgatggatgaaccatatctagagactactacttattttatctactaatcagatgatactatcacagacagatgtactgatgtcagcttttctttatgccctatgtatgaagtatgctaatgttacttattcgctatatatataaaatatctagttaatttggtgaaaaaaaaaaaaaaaaaaaaaaaaaaaaaaaa

SEQ ID NO: 645 - DNA, 1824 bp, Glycine max
  Predicted polypeptide sequence is orthologous to G390, G391, G438
ccacgcgtccgctctttctcctttctttttctctctttctctacaatctcgagattggtgtgccgcgcgcccgaaagaccactgtttcccccctttagtttctcttctaagttggattttgaaggaactgagcagcatctaatgaaggagagtggaggctctcttggagaagagagcctgcccgagactaacaccaagaacagtgaagaagaagaaccaattaactagttcctttttttctttctttctttctcactcactccctccctcccaatcccattttcttcaaatagtgtgcgtgtgtgtgttaagagaagaatagggtgtgtgtgtttagagtgatggcactttctatgcacaaggactcagccaacaaccagatggattcaagcaagtatgtgaggtacacaccagagcaggttgaggctttggagagggtctatgctgaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgcaggtactaccacagacaatagctgtgagtctgtggtaatgagtggtcaaaaccaacagcaaaacccaacacctcagcatccggctcgaggattatttgtttgtttcagtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactaaaagatcgacagtcgtggtatcgtgactgtcgatgcgtggatgtgttaagtatagtccccactgggaatgggggcaccatcgagctcctgtacatgcagacatatgcgcccacaactttggctgcagcacgggacttctggacactaagatacacgacaagtttggaagatggaagtcttgtgatatgtgagagatcattgacatcctcaactggtggccccacagggcctccttctacaacctttgtacgagctgaaatgcttcccagtggttttctagttagaccttgtgagggtggtggatccattattcacattgggctccaggttgatttagatgtctggagtgtccctgaagtactgaggcccctctatgaatcaccaaaattcttggctcagaaattgactactgctgccttgcgacatgcaagacaaattgcacaggaatctagtggagatgttcattatggtgggggtcgtcaacctgctgccttgaggacattaatgcaacggctacgcaaagggtataccgatgcctgcaacgggtttgtggatgatggttggtcactgatgggtaatgatggggtggaagatgtgaccatagccataaactcgtctcccaacacgatattcggttcccattacaatacatcaatgctttcagcatttggaggtggggtcatgtgtgccaaggcatcaatgctgctacagaatgatcctcctgctttgcttgttcgttttgtaggggagcatcgttcaaagtgggctaattatgaagttgatgcatactctt

SEQ ID NO: 646 - DNA, 1271 bp, Glycine max
  Predicted polypeptide sequence is orthologous to G390, G391, G438
  misc_feature (255)..(255): n is a, c, g, or t
ccccggcttttgcctttaaggtttcgggtcggattttttttgggaattggaacgggaaaccattttcccccgggaaaaggtaaggccatggttttgcccaggtttaattttaattcctataaggaaaaatgggacgccttcaggttccggttccggatttattttcgggttgggggggtccatatttggggggcgccccttttctttttttttttttttttctgtgttttttttctcagtatttcaatttttatnttttttttttaatttttttttattttgccagtgttggtttttttttaggaataagtaggctatacttcaacaaggagtttatatagtaagaaaggtacatccttggtaaaagcataaagcaaagctaatctaatggcacacacaaccatgagttcatgaaatccagtcattagttacattcgttgttggtgtgacaatatcttagtaaagtactcaaaatataaattaatagatataataaagtatctaaatgatggttcccccatcagacaaaagaccagttcatgaatacgaaggcaaggcagtgattggaatcatcatcatcgagaactttccatgcaatggcctgctcataagacactggtcgattcatacttgatacacatattcctgctggcagatatgcaaatccctgttgcattatcttggagaactcaatgcagagaaacttcctgccagcttcatcaagaactttatccagcattatgtcttgaagagcaacaagagtggtttcaagcatgtcaagtccagcttggtttgcaaaggtgaacactggagatgcatttgtttttacagaacagcacaatattgcatctggatggtgccaaagttgcttcaagattgcatcaccagatgtggactcaacgctgaaaagctctgtgcaggtgtggagcctgtagcttctgcagatccatcttgctaaggtaagagcctctggtggaccaggaaatgactttggccccaactgtgtactgagcctagagggagcaattgccatggcaaccctctgaacagatcgcacaacattacgcacatactggcgagccataacagccacattgtcccgcaaatggttctcaaaggtaaattggaatgcaattgtgaggaccgacctaaggttgtagttattcgagtcactttcaccagctgagcgggcattaccagatcctgtttccagtgttgatgctaagtccaatgtcctagttgaagccaaaccatctgtttatgcaaccaat

SEQ ID NO: 647 - DNA, 578 bp, Glycine max
  Predicted polypeptide sequence is orthologous to G390, G391
  misc_feature (8)..(8): n is a, c, g, or t
  misc_feature (39)..(39): n is a, c, g, or t
  misc_feature (41)..(41): n is a, c, g, or t
  misc_feature (363)..(363): n is a, c, g, or t
ggtccggnaattcccggcgtcgaccccacgcgtccgggngnaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggntgatgcatactcttctgcatgtctcaaagctagtccttatgcagttccttgtgcaagacctagtggtttcccgagcagccatgtcattataccacttgctcatactattgagcatgaggagttcttggaggtagttcgtattgaggctaatgcatttccccctgatgatgtagctttggcatgtgatttgtatttaatgcagctgtgcagtgcaa

SEQ ID NO: 648 - DNA, 628 bp, Glycine max
  Predicted polypeptide sequence is orthologous to G390, G391, G438
ccacgcgtccggaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgctggtactaccacagacaatagctgtgagtctgtggtaatgagtggtcaaaaccaacagcaaaacccaacacctcagcatcccaaccgggatgctaacaacccaactggtcttctcgccatagctgaggagaccctggcagagttcctttccaaggctactggaactgctgtcgactgggtccagatgattgggatgaagcctggtccggattccattggaatcgtagctggttcccgcactgtagtggcgtggcagcacgagcctgcgggcttgtgagcctggagccccttaaggttgctgaaattctcaaagatcgacagtccggggtttcgtgactgtcg

SEQ ID NO: 649 - DNA, 739 bp, Glycine max
  Predicted polypeptide sequence is orthologous to G390, G391, G438
  misc_feature (704)..(704): n is a, c, g, or t
catgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacaccacccaaaatactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgcctggaatgaagcctggtccggattccattggaatcgttgctatttctcacagttgcactggagtagcagcaagagcttgtggnttagtgggactagaacccactagggttgcagaaat

SEQ ID NO: 650 - DNA, 2901 bp, Oryza sativa
  Predicted polypeptide sequence is orthologous to G390
cgttctgagtaaaccacccccaccacgagcacgagcacgagcaaccatggcggtggcagagggagctgcgactgcgagctacgggccatgactgcggcgagttcttgctgggttgttgttgtacaagcagcgacgaggaggatgggagcagaggaggaggaggcggagggatggcagcggcggcggtggggggaaggggggagaggctgtcgtcctcctccccgacggcggcggcgccgcaggtggacgccggcaagtacgtccggtacacgcccgtagcaggtggaggcgctggagcgggtgtacaccgagtgccccaagcccagctcgctccgccgccagcagctcatccgggagtgccccatcctcagcaacatcgagcccaagcagatcaaggtctggttccagaatcgcagatgccgggagaagcagcgcaaggaggcctcccggctgcaaactgtgaaccggaagctgaatgcgatgaacaagctgttgatggaggaaaatgaccggctgcagaagcaggtgtcccgtctcgtctacgagaacggctacatgcggactcaactgcacaatccttctgcagccaccacagatacaagctgtgagtctgtggtgacaagtggtcagcaccatcaacagcaaaacccagcagttctgcatccgcaaagggatgcgaacaacccagcaggtcttctcgctattgctgaggagaccttggcagagttcatgtcgaaggcgacaggaactgctgtcgaatgggtgcaaatggttgggatgaagcctggtccggattccattggaatcatcgctgtttcgcacaattgcagtggcgtagcagcacgagcttgcggccttgtgagccttgagcccacaaaggttgcggagatcctcaaggatcgcccctcttggtaccgcgattgccggtgcgtcgatatcatccatgttatccctacgggtaacggcggaaccattgagctaatctacatgcagacttatgcaccgacaactttggcggcaccacgcgacttttggactctccgctacacaagtggacttgaagatgggagtcttgtgatctgtgaaaggtcattgactcagtccactggtggcccatctgggcctaacactccgaattttatcagagccgaggtacttcccagtggttatctgattcgaccatgtgagggaggtggctccatgatttacattgttgatcatgttgatttggatgcttggagtgtgcctgaggttcttcgaccgctctatgaatctccaaagatccttgcacagaagatgaccattgcagcattgcgacacattaggcaaattgcacatgagtcaagcggtgaaatcccctacggtgctggtcgccagcctgctgttttcaggaccttcagtcaaaggctcagcagaggtttcaatgatgctgttagtggatttccagatgatgggtggtctttgttgagcagtgatggtagtgaggacattacaatttcagtaaactcgtctccaaacaagcttgttggatcccatgtcagcccgaaccctctgttttctactgttggaggtggcatcttgtgtgcaaaggcatcaatgctacttcagaatgtacctcctgctctacttgtgcgatttctgagggagcatcgttctgaatgggctgatcctggtgttgatgcttattctgctgcttctttgcgagccagcccatatgcagttccaggcttaaggaccagcgggtttatgggcagtcaggttatactacccctcgctcataccttagagcatgaagagttcttggaggttattaggctcgaaggacatggtttcagccatgatgaggtgcttctatcacgggatatgtaccttctacagctttgcagcggggttgatgagaatgctgcgggtgcatctgcccagcttgtctttgctcccattgacgaatcttttgctgatgatgcaccactgctaccctcaggcttccgtgtgataccactggatggcaagacggatgcaccatctgcgacacgcacacttgacctggcatctactcttgaggttggatcgggtgggactacacgggcttctagtgacacctcgagcacctgcaacacaagatcggtcctgaccatagctttccatttctcatatgaaaacccccctcgtggaagcgtagcggcaatggccaggcagtatgtccggaccgtggtggcatcagtgcagagagtggccatggcaatagctccttcacgtcttggtggacagattgaaacaaagaaccctccaggatctcctggggcccatacgcttgcaaggtggattgggaggagctaccgattccacactggagcggatctccttcgcacagactcacaaagcacggattcttccttgaaagcaatgtggcaacactctgattcaatcatgtgctgctccctgaaggctgctcctgtgttcaccttcgccaaccaagccggcctcgacatgctggagacgacgctgattgctctccaggacatctcgctcgagaagatccttgatgatgatggccggaaggcactatgtacagagttccccaagatcatgcagcagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaaaaaaaaaa

SEQ ID NO: 651 - DNA, 687 bp, Oryza sativa
  Predicted polypeptide sequence is orthologous to G390, G438
gagcaagaagccgaaaggtaaggatcaggctataacgttggggcattggcaactcaattaaaaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttggttgcgcagaagatatcgatggcggttgcctacaaagatacccgttctgtgatcacaggatggggaaggaagcttgcggctttgcatgctctgagccaaaaagctcaccacaggcttcaatgaagttctcaatgggcttgcggatgatggatggtccgt

SEQ ID NO: 652 - DNA, 3498 bp, Zea mays
  Predicted polypeptide sequence is orthologous to G390, G391, G438
attgagccaagcagataaggtctggttccagaaccggaggtgccgcgataagcagcggaaggagtcttcgcggcttcaggctgtgaacagaaagttgacggcaatgaacaagcttctcatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgacccatttttttttttgtatggaaaatcatcagctgtgacaaaaggcatatgttgcatgcactagttgaagaaactggtccaattgcttttttggtctgtcattccattcagatgttgctaggtgtggagtggaaatggggcaatagtgatgcacggctacacatgacccagcattaaccaaacaaccgcgtcgccagtttctttctattcgatcagggagatgcatttttctggcaaaaatcttccattttttttcgttgcaaatttggtctgtatatggaactgctgctggacgccgagaaagcaaaacatatgcggaaactcactatggctcgaggaagatatatgcctacactgtcttcagaaaacataatgcagtaatgcttttcgaacccgaagcacactagacacaaaagccagatgagcaggtaggtccctcgcaaggctgatgccaacaattaaaccgacgacccttcacaacaaaattacgattctttcttctcatcctgctccagttgaggctccttctctgcagcctcctcaaatgtctctccttggacaagctcagggacgtcgtcatcatcctgtgcagctgcttcagcaccaggtacctgcctctggaaaatctcagccagcttcttaaggttgtccaggttatcaggacccagttggttgataattgatggcagaaggtcttgcagactttttgtctggggtactccactaaccacccatgtatttgcaggaatggatgcttgcactttagggttctgaaactggataacaacatcgtccttgaagatgttgacctcctcgataccaggaatggtgttccccccgatccttttcaaggtgctctgaagccgcttgtcatctgtggtcgtggtcttgtgaactgccttcttcttcctgcgcatgctgcccttccctccggtgcgtacagcgccagccatcttcttgagcttctccacattcatcttgcacaggcggcggcggcggcggcggatggagtggtggatggggaggcggaaggggtttgagctacagcaggaagcagatagagatagaagaaggagagtcgagtcggaaggccagtcactgtaacatttaggggctttttccggccgaacctcggggg

SEQ ID NO: 653 - DNA, 3126 bp, Zea mays
  Predicted polypeptide sequence is orthologous to G390, G391, G438
gtcgacccacgcgtccgcccacgcgtccgcctgctcccgcccctcaatcaatcacgacgccacagccgcacccccgcgaaccctagctcgcagtcgcaccgcgcgccggacgctgaccaggtgcctgctctatctcctgcggtggccgtcgcgctgccgccgccagacccgatccgtccgaccgtgccaagcgccccccctccggcgatcgatgcgaggcgccgcgggaggcggctcgggctcgggcaggctgtgagctggagcctgtccgctcgctgcgtcgtgcgcctgccttccctctcacggtcggcctcgccgcgcgtttgctttcccgcccacgcagggatcttcgcgggcggggagttgaagcgcgagatttgcgcggctacgattctgcgttgccgagggagcaagggaaccaatggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcggcagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcacatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatcttgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggccgattacaatattgatgtgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttccggcttccctgaagctgccacacttgctagatgggtttgccagagttatcactaccatctaggtgtggaattacttaaccaatcagatgaagctggtgaagcattgttgaaaatgctctggcatcatccagatgctattctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatcgagtgtatttatgaagaaattggatactgcgcaaaaaaaaaaaaaaaagggcggccgc

SEQ ID NO: 654 - DNA, 1816 bp, Zea mays
  Predicted polypeptide sequence is orthologous to G390, G391, G438
ccggccgggtggttgcccagaagatgacaaccacagcgctacggcaccttagacaaattgctcaagaaacaagtggagaggttgtatatgcgctaggaaggcaaccagctgttctacggacatttagtcagaggctgagtagaggctttaatgatgctataagtggtttcaatgatgatggttggtccgttatgtgtggagatggcatggaagatgttatcattgcttgcaactcgaagaagatcaggagcagtagcaatcctgctactggttttggagcccctggacctggaggtatcatatgcgctaaagcatcaatgttgctgcagagtgttccaccagcagtccttgttaggttcctgagggaacatcgatctgagtgggcagattataactttgatgcgtattcagcttcagcattgaaaacaagcccttgttcccttcctgggttgcggcctatgaggttttctgggagtcagatcatcatgccccttgctcacacggtggagaatgaggagatcttagaagttgttcgtcttgaaggacagactcttacacatgacgagggccttttgtctagagatatacatctgcttcagctttgcactggaatggacgagaaatcaatgggatcctgcttccagcttgtctttgcaccaatcgatgagcttttccctgatgatgctccattggtatcttcaggctttcgcgtgatcccgttggacataaaaacagacggaccaccctctggaagaacgttggatttggcctctagccttgaagttggcgcaaccacgcaacaagtggcaggggatggatctcaggacgtttgcaacctgcgatctgtgctgacaattgcctttcagtttccctatgaaacacatctccaggacaccgttgcagctatggcccggcaatatgttcgaagcatcgtttctgcggttcaaagagtatcaatggccatttctccctcccattctggcttgaatactgctgggcagaagctaatttctggctcccctgaagctgctacacttgttcgctggatttgccaaagctaccggtatcacttgggggtggatttggtcagccactcggatcaagctggggaatcacttttgacaatgttctgggaccatcaagacgctgtcttgtgctgctctttcaaggaaaagcctgtgtttactttcggcaaccagatgggagttgacatgttagaaacgactttagtcgctctgcaagatctcacccttgacaagatctttgacgagcctggtagaaaggcactacatgcggaggttccgaaactgatggaacagggctatgcgtacctgccggctggggtgtgcctgtctgggatgggccgccatgtctcctacgagcaagctgttgcttggaaagttctcggtgaggacggcaacgtgcactgcctcgccttctgtttcgtcaactggtccttcgtctgatgtgatccaatgcaccgcggaaactttacgatcagcgtccatttttgcattctctgtagacgagaatggtgcggtgttgctgctactgttagctaggcaacggcatgttcaggtaaggtagtcttggggaaagccagtattgtgaagatgtaaatttgcgcccgtttccgctaatttaacccgctgaacttgctgttgtttgttaaggccaggggcactcgtacgtgagattaaatgttgtgaaattgtatgtgctgaaacataggtttacattgaaattggcataaaaaacggaatcatgtgggctaaacggcccctaaaaagttttgatattaattaaggggggtttg

SEQ ID NO: 655 - DNA, 784 bp, Zea mays
  Predicted polypeptide sequence is orthologous to G390, G391
gggccccctctcgagttttttttttttttttttttttttttttagcaaatagtaatactgcaacctgcaacagtgatcaatatcgccggcgacaggccggggagacgagaccactaccaggcacggatacagctgttgtagttgtttgtcacgcacacacacacacacaaacaaacagagtcagttctcgatcatccacacagtacacaaattcttaacacaagcggcacaacggaaaagcaactaatgatacgtagtagggcaaaaggcggcatccggtctggcgctgccgagcgatgttgcgagcctcagatgaaggtccagttggcgagcatgagcgccaggcactgcggggcgccgtcgtcgcccaccaccttccacgccactgcctgctcgtacgacgcctgccgccccatgctcgacctgcacacgccgccggggaggtacgccaggccctgctgcatgatcgcggggagctgcgcggacagggccttctggccctcgtcgtcgaggaccgcctccagcggcaggtcctggatgttcaccatcgtcgtctccaggatgtcgaagccggcgctgttggcgaacttgagcgtgaaagccggcgacttcagagagcagcagagtatcgcgtcgctgtgcttccagaacagcatcagcggagagtccgcgccttcggtgtccgaccagcggatctccgttccggtgtgcgccctgtagctcctgccaatccacgtagctagtgcaagtgcctcgggagagcccggcggatgatatcagttcg

SEQ ID NO: 656 - DNA, 2346 bp, Zea mays
  Predicted polypeptide sequence is orthologous to G390, G391, G438
gatcacaaagattcaatgataacagcagtagtaatagggttaagtctcacacataaacagacagcaggggcattgttctccaactcccgatccaccacagtagacttaggccataaacagacagcaggggggcattgtctcgagcagttgtagtacacaggtgcaacggaaagcaactagtaatacgtagtcggataggataggataaaggcggcaaccgatctgacgctgccgagtgaggcatcgaggctgtgaacgtcaagagcggaggagcatcagatgaaggtccagttgacgaacatgagcgccaggcactgcggcgcgccgtcgtcgcccaccaccttccacgccaccgcctgctcgtacgacgcttgccgccccatgctcgacctgcacacgccgccggggaggtacgccaggccctgcagcatgatcttggggagctgtgcgaccagggccttctgtcccccgtcatcaaggaccgcctccagcggcaggtcctggacattcgccaccgtcgtctccagtatgtcgaagccggcgcggttggcgaacttgagcgtgaaagccggctttagagagcagcagattatggcgtcgctgtgcttccagaacagcgtcaggggagagcccgccgcgtcttcagtgtccgaccagcggatctccgatccagtgtgcgccctgtagctcctgccaatccacgaagctagtgcgagtgcctcgggagagcctggcggatgcttcagttcgacatgcgggccaaggcgagagggagaaatcgccatggccaccctctgcacgatcgccatcactgccctgacatactgcctggccatcgctgccacgctctcgcggaggtggttctcgaacgagaactggaaggcgatggtcaggaccgacctcgtgctgcgcgtgcctgacccgctatcgcttaaagcacacagacctccgcctgatccgacctcgagcgcagaagcaaggtcaagggtacgtgtggcagatggcacatccgtcttagcatcaagcggtatcacacggaagccagagggtagcaacggtgcatcgtcagcaaaagattcatcgataggagcgaagacaagctgtgcacaagcacccggcgcatcctcatcgatgccgctgcacaactgcagaagaaacatatccggggacataagaacctcgtcatggctaaagccatgtccttgaagtcgaataacctccaagcactcttcatgctccacggtgcgtgcaaggggtagtataacctggttgcccataaacccaccagcccttaaacccggaacattatatgggttggccctcagagaggcagcggaataagcatcaacaccagggtcagcccattcagagcgatgctccctcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcactgctcaacaaagaagaccagccatcgtctggaaagccactcacagcatcattgaagcctctgctgagcctttgactgaaagttctgagaacagctggctgtcgcccagcaccatagggcgtttcaccacttgattcgtgtgcaatttgcctaatgtgacgcaacgccgcagcagtcatcttttgtgccagtatcttaggagattcatagagcggtcgaagaacctcagggacactacaagcattcagatcaacatgatccacaatgtaaatcatggaacctcccccatcacaaggtcgaatcagataaccactaggaagcacctcagctcttataaaatctggagttttaggtccagaaggacctccagtggagtgggtcaatgacctttcgcagatcacaagactgccatcgtcaagaccactagtgtatcgtagtgtccaaaagtcgcgcggttccgccagagttgtcagtgcataagtctgcatatagatcagctcaatcgttccaccgttacccgtagggataacatggaggatatcaacacgccgacaatcgcgataccacgatgcgcgatccttaaggatctcggcaacctttgtgggctcgaggctcacaaggccgcaagctcgtgctgctacgccgctgcagttgtgcgaaacagcgatgattccaacggaatccggaccaggcttcatcccaaccatctgcacccagttgacagcagttccggtcgccttggacatgaactccgccaatgtctcctcagcaatagcgagtagaccggacgcgtgg

SEQ ID NO: 657 - DNA, 1669 bp, Zea mays
  Predicted polypeptide sequence is orthologous to G390, G391, G438
cactcccccagttttttttttttttttttttcgagcaagcagaactagcaaatagtaatactgcaacctgcaacagtgatcaatgtcgccggcgacaagccggggagacgagaccacgaccaggcacgcatacagctgttgtagttgtttgtcacgcgcacacacacaaacaaacagagtcagttctcgatcatccacacagtacacaaattcttaacataggcggcacaacggaaaagcaactaatgatacgtagtagggcaaaaggcggcatccggtctggcgctgccgagcgatgttgcgagcctcagatgaaggtccagttggcgagcatgagcgccaggcactgcggggcgccgtcgtcacccaccaccttccacgccactgcctgctcgtacgacgcctgccgccccatgctcgacctgcacacgccaccggggaggtacgccaggccctgctgcatgatcgcggggagctgcgcggacagggccttctggccctcctcgtcgaggaccgcctccagcggcaggtcctgggatgttcaccatcgtcgtctccaggatgtcgaagccggcgctgttggcgaacttgagcgtgaaagccggcggcttcagagagcagcagagtatcgcgtcgctgtgcttccagaacagcatcagtggagagtccgcgccttcggtgtccgaccagcggatctccgttccagtgtgcgccctgtagctcctgccaatccacgtagctagtgcaagtgcctcgggagagcccggcggatgcttcagttcgatacgcgaaccgaggcgagaaggagcgatcgcccatggccaccctctgcacggagggccatcacggcccctgacgtactgcttggccattgccgccacgctctcgcgaaggtggttctcgaacgagaactggaaggcgatggtcaggaccgatctcgtggcgcacgtgccggaaccatcgcatgaagcgcgcatgccgcttccacctgatccaacctcgagcgcagaggcaaggtcaagcgtgcgtgtggtggcggcagttggcacatccatcttagcatcaagcggtatcacacggaagcctgagggcagcaacggtgcatcgtcggcaaaagattcatcaataggagcaaagacaagctgtgcacacgcaccaggtgcatcctcgtcgacgccactgcacagctgtagaagaaacatatcccgggacataaagaacctcgtcatggctgaaaccatgtctttgaagtcgaataacctccaagcactcttcatgctccacggtgcgtgcaaggggtagtataacctggttgcccataaacccaccagcccttaaacccggaacagcatatgggttggccctcagagaggcagcggaataagcatcaacaccagggtcagcccattcagagcgatgctccttcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcggtgttcaacaaacaagaccagccatcatctggaaagccactcacagcatcattgaagcctctgccggacgcgtgg

SEQ ID NO: 658 - DNA, 3186 bp, Zea mays
  Predicted polypeptide sequence is orthologous to G390, G391, G438
ggtccaatcaatttttcaggagcaaaccaggatccatcataagatagcaagcaagcgaagacgaacaactagtacaaagctgtttgttccacgggggtgatgaacaactacaaaggtgtgtttcataggttgcctggacacaggcaaaagcgacggtacatggggtacagagttcaaacaacagagccgcaaacgctaggcaacttggctctactgactactaggggaccgggttctcacacgaaggaccagttcacgaacatgaaggcaaggcagtgcggggtgtcgtcgtcgctcaggaccttccacgccaccgcctgctcgtacgacaccggccgccccatgctcgacacacacacgccaccggggaggtacgcgaagccctgttgcataatcttagggtactcggtgcagagcgcccttcctgccatcgtcatcaaggatcttctcaagggagatgtcctggagcgcaatcagcgtcgtctccagcatgtccaggccggcttggttggcaaaggtgaacacgggagcagccttcagggaacagcacatgatcgagtccgagtgttgccacagcgctttcaaggaagcatccgtgcatttgggtgtcccgtgcggaggagttcggctcccagtgtggaacctgtagctcctgccgatccaccttgccagcgtgtgtgcctcaggagatcctggagtttgcttcatttcaagctgtccaccaatgcgcgaaggagcctattgccatggctaccctctgcaccgatgccaccacggtcctgacgtattgcctggccatggctgcgacgctctctcgtaggtgattttcatatgagaactggaaagcaatggtcagcactgatcttgtgttgcaggtgctggaggcgtcactcgaaagcacgcgttgttccccaccagatccaactcgagggggtagatgcaaggtcaagtgtgcgtgtgcctgatggtggatccgtctttgcatcccagtggaatgacacggaagcctgagggtagcagtggcgcctcctccgcaaaagattcatcgatgggtgcaaacacaagctgtgcacatgccccagctgcattttcatccaccccactgcacaactgcagaagacacatatctcgtgacagaacaacttcgtcatggcagaggctgtgtccctcaagcctaataacctctaagaactcctcgtgctctaaaggtatgtgcaaccggcagaataacctggctgcccgtaaacccactagcacgcaaaccaggaactgcatatgacccagccctcaaagcagcagcggaataagcatcaacaccaggatcagcccatttgggagcgatgctccctcagaacccgtactagtagggcaggtggcacattctgaagcagcattgatgccttagcacacaggatgcctcctccaattgcggtaaacagctgggaggagttgacatgaggaccaataagtttgtttggagaagagttgatagcaatagtaacatcctcagcaccgtcactgctcatcagtgaccaaccatcatctggaaacccattgacagcatcattgaaacccctgctaagcctctggctaaatgttcttaaaactgctggctgtcggccccctaagggaggcatttcccccactcgattcatgcgcaatttgcctaatgtgacgcagtgcagcaatagttgttttctgtgcaagaatctttggggattcataaagtggtctaaggacctcaggcacactccaagcatctaaatcaacatgatccacaatgtgaatcatggagccacctccctcaccagggtcgaattagatagccactaggaagcacttcggctcttacaaaatttggagtgttgggtcctgatggacctccagtcgattgtgttagtgatctctcacagatcacaagactgccatcctcaagaccactagtgtatcggagagtccaaaagtcgcgcggtgccgccaaagttgtcggtgcgtaagtctgcatgtagataagctcgatagttccaccattacccgtagggataacatggagaatatccacacaccgacaatcgcggtaccaagaagggcgatccttgaggatctccgcgacctttgtgggctcaaggctcactaggccgcaagctcgggctgctacgccactacaattgtgcgaaacagcgatgattccaatggaatccggaccaggcttcatcccaaccatttgcacccaatcgacagcagttcctgttgctttcgacaggaactctgccaaggtctcctcagcaatagctagtagaccagctgggttattcgcgtcccgctgaggacgcgggagctgctgggttttgctgttggtggtgctgaccacttgtgaccacagactcgcagctcgtgtctgtagtcgcagcagaaggattatggagctgctgtcgcatgtacccattctcgtagacgagtcgggagacctgcttctgcagcctgtcattctcctccatcaacagcttgttcattgcagtcagcttccggttcacagtctgcaggcgcgaggcctccttccgctgcttctcgcggcatctgcggttctggaaccagacccttgatctgcttgggctcgatgttgctgagtatggggcactccctgatgagctgctgcctgcgcagcgagctgggtttggggcactcgctgtagacgcgctcgagcgcctcgacctgctcgggggtgtagcgcacgtacttgcccgtgtccacctgcggcgccgccgccgccgccgggcgacggccggtccttgccgcccccgaccaccgccagcgccgtcgacatctggctagcaccgccgcccagggaggagtcggagtcggaggaggaggggttgtcgtcgtcgcggggagacggagaatacggagagccacggccacgggcggcgccgagtcatagcctcggggcgagagcgcagccgcccgacgccatggtggtggtgcgagagagagagagagagagagagagagacgagagagagagaggagtggcggcggtgctggggggttgtgcagctgttgcttgcttggctgcctgccgagccgcgcggcgcgcggggagggtgaggaggaggacggaggggaggagcagcggggggaaagggaaagctagcggcgagacggggatgggagagcccggccggcctc

SEQ ID NO: 659 - DNA, 721 bp, Zea mays
  Predicted polypeptide sequence is orthologous to G390, G391, G438
  misc_feature (512)..(512): n is a, c, g, or t
gtcagccacggtgctcctgctgctggtccggaggcagccacgcttgcaagatggatctgccagagttacaggttccatttcggggctgagcttatcaaatccgcagacggtagcggctgtggtgaagcagtgctgaaaactctctggcaccatgccggcgctatactctgctgctctctcaaggccttgccagtgttcacgttcgcgaaccagtccgggctcgacatgctggagacgacgctggtggcgctgcaggacatcgcgctggagagagtgttcgacgaccaagggaggaagaacctgtgcgcggagctccccggcgtcatggagcaggggttcgcgtgcgtccccggcgggatgtgcgtgtcgggcctaggccggccggtgtcgtacgagaaggcgctggcgtggaaggtgctcgacgacggcagcggcggcgtgcactgcgtctgcttcatgttcgtcaactggtcgtttgtgtgacgcgtctgctaccaggtccgtcgcgctcnaggggaaaatcagttgatcggtgacgtgcttgagggtacgtacgtctcaaatcgccctttggttattgggatgtaaaatggtttcggttttttttttgttttttttttgaagaaaaatgtgaaatggtagaaggaaggacctgaatagcagtattgtacacggatggatcgtgtgatgtcaaacaagaatgactttttgtttgatggtg

SEQ ID NO: 660 - DNA, 674 bp, Zea mays
  Predicted polypeptide sequence is orthologous to G390, G391, G438
tccaatggcggccttgcgctatctcaggcaggttgctcacgaagataccgcccattctgtgataaccgggtggggacggcagcctgctgctctacgggctctgagccagaagctcaccagagggttcaatgaagctctgaatgggctcgctgacgacgggtggtctgtgatcggaagtgacggggtggacgatgtctgcgtctctgtcagttcatccccgagtagagtggtcagctgcaatgcaactttcagtaccggacctgtagtcggcactggcagcagcagtgtgctctgcgcaaaggcatcgatgctgagctaggacgtttctccgccagagctcctgcgcttcatgcgggagcagcggtcgcagtgggccgacagcaatctagacgcgttcttcgcttctgcgatgaaaccggatttctgcagcttgcctattcctcctcgccttggagggtttggtggccaggtcatacttcctctagcccacacgtttgaccctgaagaattcctcgaggttataaaagtaggaaatgccggtaactaccaagacgcgctcctgcaccgtgatctgtttctgttgcagatgtacaacggggtagacgagaacatggcaggcacttgttcagagctcatgctttgcccctatagacgcatcgttcagcgacgactcg

SEQ ID NO: 661 - DNA, 467 bp, Zea mays
  Predicted polypeptide sequence is orthologous to G390, G391, G438
ggttccagaaccgcaggtgccgggagaagcagcggaaggagtcgtcccggctgcaggcggtaaaccggaagctgacggccatgaacaagctgctcatggaggagaacgaccgcctgcagaagcaggtctcgcagctcgtctacgagaacggctactaccgccagcagacgcagagcgcggggctggcgaccacggacacgagctgcgagtcggtcgtcaccagcggcccccagaacgtggccgcggtgctgccacaagcccagccgcgcgacgcgggccctgccgggctcatgtccatagcggaggagacactgacggagtttctgtccaaggccaccggcaccgccgtcgagtgggtccagatgcccgggatgaagcctggtccggattctattggaatcattgccatctcgcatggctgccccggtgtcgccgcgcgagcttgcggcctcgtgggcatggagcct

SEQ ID NO: 662 - DNA, 558 bp, Zea mays
  Predicted polypeptide sequence is orthologous to G390, G391, G438
  misc_feature (278)..(278): n is a, c, g, or t
  misc_feature (522)..(522): n is a, c, g, or t
gaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgtgaaggcaacctgcagtcctacggacctttagtcaaagactaagcagggggtttaatgatgccattagcggtttcaatgatgatggctggtctgtaatggggggagatggcattgaagacgttgntattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattntctgaggggcagatgatcatgccacttgctcacaca

SEQ ID NO: 663 - DNA, 500 bp, Lycopersicon esculentum
  Predicted polypeptide sequence is orthologous to G390, G391, G438
atccttgttctgttgtaacctttaaaatgcactctttactaaactaggtgattgtggaggtggtacatatgtttacatgttgctggaggtcattaagttggaaggagtttgccattccccagaagacgttataatgccaagagatatgtttctattgcaattgtgcagtggaatggatgaaaatgctgttggtacctgtgctgaactcgtttttgctccaatagatgcctcatttgccgatgatacaccactccttccttctgggtttcgcattattcctttagactctgctaaggaagcctccagtccaaatcgcacccttgatcttacttctgctcttgaaactgggccagtaggaagtaaggtggctaatgatctcaagtcaactggtggcacatcaaaatctattatgacaattgctttccagtttgcatttgaaagccacatgcaagagaatgttgcatcaatggctagaaaatatgtacgaagcttcatttcat

SEQ ID NO: 664 - DNA, 370 bp, Oryza sativa
  Predicted polypeptide sequence is orthologous to G391, G438
aattgctgcgtgagtgccccatacttgctaacattgagcccaagcagatcaaggtctggttccagaacagaaggtgccgggataagcagcggaaggagtcttcacggcttcaggctgtcaacaggaaattgacggcaatgaacaagctacttatggaagagaatgagcgactccagaagcaggtctcccaattggttcatgagaatgctcacatgcgacagcagctgcagaatactccgctggcaaatgatacaagctgtgaatcaaatgtgactacccctcaaaaccctttaagggatgcaagtaacccctctggggctcctttcaattgcagaggagaccttgacagagttcctctcaaaggctactg

SEQ ID NO: 665 - protein, 148 aa, Oryza sativa
  Orthologous to G390, G391, G438
MAASDRPPAQDCRGEGGNFGGGGGRSGGWRQRWRCPMRSGSGSDGSGYDKAGMDSGKYVHYTPGQVEALERVYAECPKPRFSRRQQLLCELSILANIEPKQKIKVWFPKQKWKELIGVPLLKWLLCILIVSHVCFISVFKGLALLKVV

SEQ ID NO: 666 - protein, 886 aa, Oryza sativa
  Orthologous to G390, G391, G438
MDASKYVRYTPEQVEALERLYYECPKPSSLRRQQLVRECPALANVDPKQIKVWFQNRRCREKQRKESSRLQALNRKLTAMNKLLMEENDRLQKQVSQLVYDHGRHGVAAAGMMRRVPAFPPQAAAAAGHQLATATDTSCESVVTSGHHHQQQQHNVVQPPPRDASPAGLMSIAEETLTEFLSKATGTAVEWLQMPGMKPGPDSIGIIAISHGCAGVAARACGLVGMEPAKVAEILKDRPLWLRDCRSMDVVNVLPAGANGTIELLYMQARTHKPENSEPEPEILKLKFVFDLQLYAPTTLAPARDFWLLRYTSILDDGSLVVCERSLSSKQGGPSMPLVQPFIRGEMLPSGFLIRPSDVGGSVIHIVDHMDLEPWSVPEVVRPLYESSAMVAQKISMAALRYLRQVAHEDTRSVITGWGRQPAALRALSQKLTRGFNEALNGLADDGWSVIESDGVDDVCISVNSSKVIGCNATFSSGLPIVSTGVLCAKASMLLQDVSPPSLLQFLREHRSQWADSNLDAFFASTMKPNFCNLPMSRLGGFSGQVILPLAHTFEPEEFLEVIKLGNASNYQDTLVHRDLFLLQMYNGVEESSAGTCSELIFAPIDASFSDDSPLLPSGFRIIPIDSPLDTSSPNCTLDLASTLEAATPRSRISGVNGGGGGCAAAAASSSSKAVMTIAFQFAFDGHLQDSVAAMARQYMRNIISSVQRIAVALSSSRLVPPGAGAAAAQLSPVTPEAATLPRWICQSYRFHFGDELIKSVDANSSNESILKAVWHHPSAILCCSLKAMPVFTFANQSGLDMLETTLVALQDMTLEKVFDDQGRKNLCTELPNIMEQGMACMEGGVCVSSVGRAASYEKAVAWKVVDGDGGGAHCICFMFINWTFL

SEQ ID NO: 667 - protein, 855 aa, Oryza sativa
  Orthologous to G390, G391, G438
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKVDCQLLRFTLPASNDPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 668 - protein, 806 aa, Oryza sativa
  Orthologous to G390, G391, G438
MAAAVAMRGSSSDGGGYDKVSGMDSGKYVRYTPEQVEALERVYTDWPKPTSSRRQQLLRECPITANIDPNRSRCRDKQRKESSRLQAVNRKLTAMNKLLMEENERLQKQVSQLVHENAHMRQQLQNLYQLGPYASVPLELIYELILRMLLSIAEETLTEFLSKATGTAIDWVQMPGMKPGPDSVGIVAISHGCRGVAARACGLVNLEPTKLYAPPPLVPARDFWTLRYTTPMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLTGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTLELIEAFGFKYSLGKIKQDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 669 - protein, 880 aa, Physcomitrella patens
  Orthologous to G391
MTETWKDQTMDASGKYVRYTQEQVEALERVYHECPKPSSIRRHQLIKESPILANIEPKQIKVWFQNRRCREKQRKEATRLVSVNAKLTALNKLLMEENERLAKHTSQLTLENHALRQQIPNLPFPDGRHRLPSQILQSPLKKEGAVNGGDESSTQGGICVKVHGQAGIASTDTSCDSAVTGGLPHRLTPQHSPRDSSPAGLLATAEETLTEFLAKATGTAVDWIQLPGMKPGPDAIGIIAISHGCVGIAARACGLVALDISKVTEVLKDRPRWLQDCRRMEILGALPTGNGGTIELLYTQMYAPTTLAPARDYCTLRYTTILEDGNVVICERSLSGVQGGPTMPPVQSFVRGEMYPSGYLIRPCDGGGCIIHVVDHYNNEPRSVPEVLRPLYESPAVLSQKSTLAALRHLRRLAAEESGEGVPRNGQHPAVLRTLCQRLTKGFNNAVNGFPDDGWEATISDGLDDVSVMLNATPKSMEGQIASDKLLYSLGGGILCAKASMLLQNVPPSLLIRFLREHRSEWADYDIDANVASFRSNGNGYVPRCGGVSHVQLPLPLAYSGESGEILEVVKVEGHSSVQHMVLSRDTFLLQLCSGVDESAVGACAQLVFAPVDVALADDIPLLPPGFCVSPIDTNVVDGFGLDRTLDLASTLEGGNDLRSNGDAKSSNSPGQMRSVLTIAFQFAYEVHTRETVAAMARQYVRNVVASVQQVAMALAPSRGAPPPRQVPSNPDALSLVRHVLSSYRFHMGIDLIRPENGSDEALFKAFWHHTDAIVCCALKGIPEFVFANRSGLEMFETATASSLKDLDWEKTLNENDRKLSYATFTHVLQQGYCSLPAGVRMSSTGRTATYEQALAWKVLNDSEAVECIAFLFINWSLAT

SEQ ID NO: 670 - DNA, 1896 bp, Glycine max
  Predicted polypeptide sequence is orthologous to G409
gtcgacccacgcgtccgccctcgcgtccgcccacgcgtccgtacgggcgagaagacgccagaagggggaactccaaaacacaaacaaaaactcccgttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagtaaacatggcggctagtggaagttccttttccaacatcactagcttccttcgcaaccaacaaccctcttcccaacctctcgattcttctctcttcctctctgctccttcaatttttgtttcaggttcgagatccatggtgagttttgaagcagaaggagggaaggggtgtaacggctccttcttccgcgcgtttgacatggacgacaatggggacgagtgcatggatgagtactttcataaacccgagaagaagcgtcgtctctccatgaaccaggttcagtttctggagaagagtttcgaggaggagaacaagcttgaaccggagagaaagaccaagcttgccaaagaccttggtttgcggccacggcaagttgctatttggttccagaaccgtcgagctcgctggaagaccaagacgctggagaaggattacgaggctctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagtgaagaagaaacaaaaagattattgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctctacccttcgtacctctttcccaaacttgaagaagatgtggattactccgacccgcctgaaagttcttgtaattttggattttctgaggaagatcacgccctttggacctgggcatactaagttttcttccatgttcatgtgtgtgtttgtgtcatatgtttttttagtaattagtatttagtatttgcactttttgtccaggcttcaaaaatggctatagctttagctttatcaggaaagaaatgtttgttttctttttgcctcattttgttagtacttgtaatcaaactgttggttccaatgtaattaaataatgtcttctcgttgagaatgtaactatggatttcatttaatttcactaagaaaatcaagtaagaaacttgatgaaatggggaaaaaaaaatggaagccaattgcttggtagagtggaaaagattgaggcctatagtatttatactatttaagatgactatgattcattgattcttcttcacttgggttctggacttctgggtccatgttgttttgattggtaagcaaccctgcatgacgaagttgacttgcttgcacctttgcaatactttcctacttgagagcatttaagttttgtgacagaaggggtgtcactttcactatgaattggacaaaaatggccactctccattggatgaggatcacc

SEQ ID NO: 671 - DNA, 1042 bp, Glycine max
  Predicted polypeptide sequence is orthologous to G409
cggtccggaattccccggtcgacccacgccgcacaaacacatacaaacatagtatccgcttctctctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaaatggccccttaaagatcgaacttggtcggagtaaacatggcgggtagtggaagtgccttttccaacatcactagctttcttcgcacccaacaaccctcttctcaacctctcgattcttctctcttcctctctgcaccttcctctgctcctttcctcggttcgagatccatgatgagttttgaaggagaaggagggaaggggtgtaacggctccttcttccgcgcgtttgacatggacgacaatggggatgagtgcatggacgagtactttcatcaacccgagaagaagcgacgtctctctgcgagccaggttcagtttctagagaagagcttcgaggaggagaacaagcttgaacccgagagaaagaccaaactggccaaagacccttggtttgcggccacggcaagttgctatttggttccagaaccgtcgagctcgctgggagaccaagccgctggagagggattacgaggctctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagttcttgtaattttggattttctgaggaagatcacgccctttggacctgggcatactaagttttcttccatgttcatgtgtgtttttgtgtcatatgtttttttagtaattagtatttagtatttgcactttttgtccaggctt

SEQ ID NO: 672 - DNA, 1772 bp, Glycine max
  Predicted polypeptide sequence is orthologous to G409
tacggctgcgagaagacgacagaagggggaagaatctctctttatttctttcactctctcagaaccaaaattttccaaactcctcaactctcatcagatatcaaccttctctctctccaaactctcgcacctttctgctctgcccttcaatttattcatctctgacaccctcttaattctgcttccagttcctctgagtgatgggttcaaaacccgtggttgattttgagaatgtaagtgggagcaggatgacggataggcctttttttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaggtccaacttgcaaaagagcttggcttgcagccaaggcaagttgctatatggttccaaaaccgaagggcaaggttcaagaccaagcagctagaaaaagactatggcgtgttgaaagctagttatgacaggctcaaaggtgactatgaaagtcttgttcaagagaatgacaagttaaaagcagaggtgaattctctggagagcaaattgattctttgttaaaagcagaggtgaattctctggagagcaaattgattcttagagataaagagaaggaggagaattcggatgacaagtcatctcctgatgatgctgtcaattcttcaccccacaacaacaaggagcctattatggatttattaatttcaaaaaatgcaacaacatctgaaaatggaaccgaagtgtcaacactcccactccctattatggtaacatgcaagcaagaagatgccaattcagccaaaagtgatgtgcttgattcggatagcccacattgcactgattatgggaaccacccttcctcattcgtggagcctgctgattcctctcatgcctttgaaccagaagaccactcagaagacttctcacaagatgaagaggataaccttagtgaaaactttttgaccctcccttcttcttgttgcttacctaaggttgaagaaccctgctatgatgaccctccagaaaactcttgtaattttggcttccatgttgaggatcaaaccttctgtttctggccctactgaaccaaccaaccaaccaaccgcttccaatgttataaaaacttcgcagttgtaaccatgtactagaaatcaataaaaatggtattgttacttctactaaggaataaaaatcagaaggctaatgcaatgcatcatgctatcatcactggtggtgttaatagttagcagtgaaagtgtaacacaatgttactactagctaaaattcaaaaacttggttcaggtgtgcgcgtaggtatcccaaaatttcaggtggggtacagcaaccaatcgttgttttactttcggatgtggaaaatggaaaccctgttttctctttctctctgcactcctctggatcacaccgttgttttactcatgtattaggaagaccctttcatcatgattcacctgtcctcactgctcagcataaagttacagttttatatgcgtcccagtaatcattagagtcatcatagcaaccagagtttgagtagattaaataagatctcacattcaaattttcctgttgttattggacactgagaaaaacttgtgtctaagttgatgatgattatgtaagaaatatttggcatattttaatgaaattgaaaaactaaataaaaaaaaaaaaaaaagg

SEQ ID NO: 673 - DNA, 1625 bp, Glycine max
  Predicted polypeptide sequence is orthologous to G409
ttaagagggtttctctctctttatttctttcactctctcagaaccaaaattttccaaactcctcaactctcatcagatatcaaccatctctctctctccaaactcaaatacctttctgttctgctcttcaatttattcatctctgacaccctcttaattctgcttccagttcctctgagtgatgggtatgatctctcctcactcccacaattcccacattatagtaatcctcatcacctgcttctttcgtcataaattctagatcaaactccactccctgatcctcccttttacttcttatgtagcatgtatgaactcaaatcatcaaatgaatatgaccctttaatctaagaagaagaaaaaaacacacacatacacacacacactttaaagtccaaagtctaaaccaacccaccaaaagtcttgttcccatggcgagtggcaagctttatgcgggttcaaacatgtcacttctcctccaaaacgaaaggctcccttgctcctctgaagtccttgagtctctttgggctcagacctctaaccctgcttccttccaaggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgttttaaaaaactttgcagttgtaaccatgtactagaaagcaataaaaatggtattgttacttctactaaggaataaaaaaaaaaaaaaaaaaaaaggacgaccgctaagggggacccctgtatagg

SEQ ID NO: 674 - DNA, 1240 bp, Glycine max
  Predicted polypeptide sequence is orthologous to G409
cttcaatttattcatctctgacaccctcttaattctgcttccagttcctctgagtgatgggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtaaaagaaattaagaagaaaaaagagagagacacacacaacacatacttacactcaattttgcttttgtgctttatgctactagtactacttgctttaataaagtgcaatctttattatttatcccactaatgggttaatgattggattggcacaaaatttttgttactgacaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgtttttaaaaactttgcagttgtaaccatgtactagaaagcaataaaaatggtattgttacttct

SEQ ID NO: 675 - DNA, 1296 bp, Glycine max
  Predicted polypeptide sequence is orthologous to G409
  misc_feature (1172)..(1172): n is a, c, g, or t
  misc_feature (1179)..(1179): n is a, c, g, or t
cgtaagccccgcgtttgcgcccacgaaagcactcacaaagacacagagtgcgttcgttgacgacaaacacacacaaacacacaacaaaagctcgccggaaaatctttctccggcgacctggaattccgacgaaggtagttgcggctccttcgtcccgaaactgaggccctcaaagtataaactttggtggtggtgggtaggatctggcggtgtatgatgggatcttgcatatgcccgttggagactccggcgaggttgctttggaccacaagcttcttccgtcataagcttatgatcttctaataattaataattcacgcacacaaacaaacaaacaaacaaacaaaaaacacttcataacaacaacaacaacccttctgaaattctcaacacaagtttcaaaaaacagagtaaaagaaacagagcaaaaacacacacacaaaaacacaaacacagacaccttttaagtattaaggtgtctctttctctccccggaaagtttctccgtcggcggtggtgattgaccggagtgccatggagtctggacggattttctttggtgcctctgcttcaagcggcaacaacatgctctttctcggcaacactgaacttgcttttcgagggagatcgattatgagcatggaggaagcctcgaagaggcgacctttcttcacctcaccggatgaactgtatgatgaagagtattatgagaagcagtcgccggagaagaagcaccgcctcagttccgaacaggtccatctgttggagaagagctttgaggaagagaacaaattggagcctgagaggaagacccagttggctaagaagctgggattgcagcccaggcaggtggctgtgtggtttcagaaccgcagggctcgatggaagaccaagcaacttgaaagggattatgatgttctcaagtcttcatacgataccctactttcatcctatgattcaattatgaaggagaatgagaaactcaaatctgaggtggtatccttaaatgaaaagcttcaagttcaagctaaagaggtgcctgaggaaccattatgtgacaagaaagttgatccaattccagtagatgaagatatggctccgattttcggcacaagggtggaggaccacctgagtagtgggagtgttggaagtgcggtggtggatgaaggtantccacangtagttattaacaatatgtattcatacattctatctaacaactattataaatatataaacccgtatcgagagattcaatcggatgagaatgatagcagtaatgattatcagacgtgc

SEQ ID NO: 676 - DNA, 1033 bp, Glycine max
  Predicted polypeptide sequence is orthologous to G409
aagacccagttggctaagaagctgggattgcagcccaggcaggtggctgtgtggtttcagaaccgcagggctcgatggaagaccaagcaacttgaaagggattatgatgttctcaagtcttcatacgataccctactttcatcctatgattcaattatgaaggagaatgagaaactcaaatctgaggtggtatccttaaatgaaaagcttcaagttcaagctaaagaggtgcctgaggaaccattatgtgacaagaaagttgatccaattccagtagatgaagatatggctccgattttcggcacaagggtggaggaccacctgagtagtgggagtgttggaagtgcggtggtggatgagggtagtccacaggtggttgttgacagtgttgattcatacattctagctgacaactatggtggatgtgtgggcccggtcgagagggttcagtcggaggaggaggatgggagtgatgatgggaggagttacttggatgtgtttgtggtatctgaaactgagcaccaaaaccatgaggaaggagagacattgggttggtggactaatatgtattatgttggataaaatggtaatgcagcagtgctttcgaaattagatgcttaattaagaaaacgtaataatattgtataatgtatcatgtgggcgagggaggaaaaagtaaacgcctggattgggtggcttggacccctaggaggagttgaagtgtccttaacccgagtttaataaataaagtctagtagtaatttggtcaatggtgtcttgtgttggttaatggttgtactgccaaaattaaagtaagtatatttcttgttcaagtattaaaacatggttaattagtactatacaaaatttgggcggtttcttttttttttttgaatccaattttcgaaaaccattttgccaacttaatcaaaataaaatcgggggtaaggcccccaaaaaaggcaaagccctccccattgtcttgtaacccgtttcgaatagggcctattagcaaaaattattttccccccct

SEQ ID NO: 677 - DNA, 1740 bp, Glycine max
  Predicted polypeptide sequence is orthologous to G409
ggctcgagatcatccccgtattataaacccaggattgcctcttcttccaggaaccccctcaacaaaaggaaactctcattcaccttcttctctctccctcactccctctctttcttaatacaccaccttcccaaccctcttccattctccttctccaactccaacccctgcttcccttttttcattttctcactccccatcttctgagagtgatgggtgtttgctaccgctgttcccacacctcccacatcaccgccatcatcatcaccagcttcttccgccacaagccttagaattatactattcccaccctccctctttcttcaacaacaaccgttgacttcactacagtcacgtggtctttctctgaggatccaaccatggcggctggaactgtcttctgcgctgctgctactgctgcttctaatttgacaacaaccacttttcttcacaaccaaacacctccttccacctcctctcagcctcctctcgattctcttttcctctctgcctcttcccctttcctcggttcaagatctatagtgagttttggagatgttcaaggagggaaggggtgcaatgattcattcttccgcccctatgatgagaatggggatgaggacatggacgagtacttccaccagcctgagaagaagcgcaggctctccgtggagcaagtgaagtttcttgagaagagctttgatgaggagaacaagctcgagcccgagaggaagatttggctagccaaggaactcggcttgcagcctaggcaggtggcgatttggtttcagaaccgccgcgcgcgctggaagaccaagcagatggaaaaggactatgattccctgcaggctagttacaatgatctcaaggctaactatgacaaccttctcagggaaaaggataaactcaaagctgaggtggcaaggctcactgagaaggtgcttggaagagagaaaaatgagagtcacttggaacaggctgaaaccaacggattgcaggagccgctgcacaagtctttggttgattcagcttctgagggtgaagggtccaaagtgacctttgaggcttgtaaacaggaggacattagctcagccaagagtgacatatttgattcatcagaaagcccacaatacactgatggagttcactctgcacttctagagactggtgattcttcttatgtgttcgaacctgatcgatctgatgtgtctcaggatgaagaagataacttgagcaagacccttctgcctcattacatttttcccaagcttgaagatgttgattactccgacccacctcatggttcatgtaattttggaattccggaggaagatcaagccatttggtcttggccttactgaattttctctatagcatatagagcatgtctctaccttctactctcaagttcttctgtttaaacttgagatcatgtggtagaaaagggtgagttaataataagccaaagaaaaaatggcactctactggtttgttcccaatggtggtttcttgccagctttttttttttttttttttactttgcaatgtaacttttggttcaaatgtaaataaataatatcttcttgttgaggatgtagctctgaatatcacttcaaggatgaatttacatagcaaattagatgagaaaaatgggaagataaaaaaaggttatgttttcaaaaaaaaaaaaaaaaaaaaaaaaaaaaaaaaaaaaaaaaaaaaaaaaaaaaaaaaaaaatt

SEQ ID NO: 678 - DNA, 1858 bp, Oryza sativa
  Predicted polypeptide sequence is orthologous to G409
ttgacgcctgggcggacgcccataaaaatcccaaaaacaaaaaataataaaaaaaaagaaagagagagacatttcgcatctgctgccctgcctcctctcccatcacctgcccattttttcacattgaggcccctctgaaaatattatatttacaactaggtccctggccgggccggccggccaccggaaggagcacctcgccggagaaggctttgtctcttctttttcttctcctcctcctcctccatcggcggcggcatggggttctcgctgtaccccatgaagacgtcgacgcgcatgctgtggagcaccagcttcttccgccataaggtcgcctcctccttctaagcccacgccctctcgggcggcggcggcgagccggcggcggagcgcgcggttggtaggtgcgcgtgcgtgcgtgaacgggagagcagcttcgagatcgggttttcttgggttcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggcgtgccggcggcggtgctggggatggatgaatcgcggtcgtcgtcgtcggcggcgggggcgggggcgaagcggccgttcttcacgacgcacgaggagctcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccggccaccatgccctcctctccgacaacgaccgcctccgcgcgcaggtatctcattaaccgagaagctgcaagacaaggagacgtcgccgtcgtcggcgaccatcaccaccgcggcgcaggaggtcgaccagccggacgaacacacggaggccgcgtcaaccaccggcttcgccaccgtcgacggcgcattggcggcgccaccgcccggccaccagcagccgccgcataaagatgatcttgtgagcagcggcggcaccaacgacgacggcgatggcggcggcgcggccgtggtggtcttcgacgtcaccgagggcgccaacgaccgcctcagctgcgagtcggcgtacttcgccgacgccgcggaggcgtacgagcgcgactgcgccgggcactacgccctctcgtcggaggaggaggacggcggcgcggtcagcgacgagggctgcagcttcgacctccccgacgccgccgccgccgccgccgccatgttcggcgccgccggagttgtgcaccacgacgccgcggacgacgaggaggcgcagctcggcagctggaccgcctggttctggagctgatcgatggaagcatggagcattggagccatgctatcaatgaatgaatgaatcaaatgaccttgagaccctcctctccgtcctttcttttgccctatttttaatcgctgttatatgttaattatgtgcaattaaagtgtacgtgttttgtcgtaagttgtgtttgttcaaattgtatgttttgaaggtgtcatgtattcatacacgatatgatatatagacgggatcatgaatgatactcggaaagattggaataaaaaaaaaaaaaaaaaaaaaaaaaaaaacattttcctccggggggcctcgtgcaaaaaaa

SEQ ID NO: 679 - DNA, 1926 bp, Oryza sativa
  Predicted polypeptide sequence is orthologous to G409
gtccggccccccgcgtccgcccacgcgaaaaaaatattataggaaataaaaaataatttcctggttagaataaacacatttttaaaaaaaccaagaaaagattttcctcttctgttacattccttcttccttctccggccaccggagccgtagccgaattgtgcctcttctccggcgaggggagagggagagagggggtgtgagttttgctccttccggcgagtggtctcctccccgcgcggctgaggagatctctcgggacatcggggttggggcggcgtgcatgatggggttctcgctcacgccgatgaagatctccacgaggcttctgtggagcaccagcttcttccgccacaagatcgccgccaccatcgcgtcctcctcctccttcttataagatcatcttctccgccacagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccggcacgaggctcctcgaagaggagtactacgacgagcagctcccggagaagaagcggcgcctcacgccggagcaggtagatactccagctagctagctaagctgtaaagatcggcggcgcgcggtgctctgttcccgagttgtgacgtgacgactggatcgatcggcgtcggcgtgtgtgtatgtatgtgcatctgctggagaggagcttcgaggaggagaaacaagctggagccggagcggaagacggagctggcgcggaagctatggctgcagccgcggcaggtcgccgtgtggttccagaaccgccgcgcgcgctggaagaccaagcagctcgagcgcgacttcgaccgcctcaaggcgtcgttcgacgccctccgcgccgaacacgaagccctcctccaggaaaaccaccgcctccactctcaggtgagctagctacgcccgccgcccgcgccaccgcccaaccgcgcgttatcctcgatccgatttggccgggctccttgattctgactgaattcgtggtgatcttgtgccgtcaggtcatgttctttgaccgagaagctgccagagaaggagacgacgaccgagggcacccccggcgccggccgttgacgtccccgggctgccctgcggccgccgacgtgaaggtccccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtccttttcgccgaccccggcccccccccccccccccaacacgcggacgacgacgaggagggcgggccccccgatcagctgctggtggatgtggaactagatttctcgcgcgcgcgcgtcgtcgggccttcaattctcgtgttaaaaaaaatcgttctctttttcctttttcaaaaaaaaggggggcccggcacccaatccctcccctcccccccc

SEQ ID NO: 680 - DNA, 1500 bp, Oryza sativa
  Predicted polypeptide sequence is orthologous to G409
cagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccgacgagctcctcgaagaggagtactacgacgagcagctcccggagaagaagcggcgcctcacgccggagcaggtgcatctgctggagaggagcttcgaggaggagaacaagctggagccggagcggaagacggagctggcgcggaagctagggctgcagccgcggcaggtcgccgtgtggttccagaaccgccgcgcgcgctggaagaccaagcagctcgagcgcgacttcgaccgcctcaaggcgtcgttcgacgccctccgcgccgaccacgacgccctcctccaggacaaccaccgcctccactctcaggtcatgtcgttgaccgagaagctgcaagagaaggagacgacgaccgagggcagcgccggcgcggccgttgacgtcccgggcttgcctgcggcggccgacgtgaaggtcgccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtcctcttcgccgaccacggccaccaccaccaccaccaacacgcggacgacgacgaggaggacggccagcagatcagctgctggtggatgtggaactagatttctcgcgcgcgcgcgtcgtcgtgcattcaattctcgtgttaaaaaaatcgttctctttttcatttttccgcttctttgtctgtaatgttgagtttcgatcggctatgagaaggaaggaggtgtatgcatgtgcatggtatggtagggtaacacatcggtgaatcaaatctgtcatggtgatgtacgagaattgaagaacatgggggtagcaataagtgcatggaggcaagtactcttttcaatggcacataccaaatcatgtcgtcgaattgagatttttattagtcttgaattcttcttgaaaaaaaaaaaaaaggggcctcgtgcgggaggg

SEQ ID NO: 681 - DNA, 691 bp, Zea mays
  Predicted polypeptide sequence is orthologous to G409
  misc_feature (6)..(7): n is a, c, g, or t
  misc_feature (646)..(646): n is a, c, g, or t
  misc_feature (649)..(650): n is a, c, g, or t
  misc_feature (654)..(657): n is a, c, g, or t
  misc_feature (662)..(665): n is a, c, g, or t
  misc_feature (680)..(682): n is a, c, g, or t
ggttgnngttgttctcatacatcgcacatcaccgccatcataatcaccagcttctttcgccataagccatagatctttcgatggttgcttgataatatcgtctgaagtctaaggaggaggagaagaagaagaagaagaagggttcctgatatggcggcgggtgggaatgtttcttcaaatttatgtactttgcttaagaatcaaactgttccttgcacttctcagcctcttgattctcttttcctttcttcctcttatcattttctcggttcaagatctatagtgagttttgaagatgttcaaggagggaaggggtgtaatggctctttcttccgtcattatgatcttgatgaaaatgtggatgaagacatggacgaatacttacatcgacctgggaagaaacgtaggctctcggtggaacaagttcatttccttgagaagagctttgaggaagagaacaagcttgaacccgaaaggaaaactagactagccaaggaacttggtttgcaacctcggcaagtggcgatttggtttcaaaatcgtagagctcgatggaaggcaaaacaattggagaaggattatgattccttgctagctagctataacgatcttaaagccaattatgacaatcttttgagggagaagnatnnattnnnnagcgnnnngtcaagactcactgnnnagatgcttg

SEQ ID NO: 682 - DNA, 810 bp, Zea mays
  Predicted polypeptide sequence is orthologous to G409
  misc_feature (34)..(34): n is a, c, g, or t
ggccggccgggggagtgatttctgaccacgcctnttgagacttcaagtgggcaacgtttctcgcctctcagcgcaaaaagatagatcctctgctctaccggcctaccacgttcgtctcccgcgccggccacccaccgctgccaccgaggtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaaggcctccttcgacgctctccgagcggaccacgacgccctcctccaggacaacaaccgcctccgctcacaggttgtgtcgttgaccgagaagctgcaagagaaggaggatgcgacggagggcggcgccaccgctgacaccgccgcgcccggcggtggacgtcgaggcttccctggccgacgacgtcgaggagccagcaagccctgcggcgacgttcgaggtgtgccaggaagtgaagtccgaggacaggctg

SEQ ID NO: 683 - DNA, 1671 bp, Zea mays
  Predicted polypeptide sequence is orthologous to G409
catcggggcctccgggccggccgggcctttagcagcgaaattcacccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcgcgcggcggggcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatccccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagtttttgtatgttcatatatataataatgtgcttcgaacatgacactcgaaaagttgaataattggacatgtcgacctgctgtgcactagcagctggcatgttttgtttaaaaaaaaaaaaaaaaaaaaatcgagaagggaattcatatttttcaaagggaaatgaactaattttacttaggaa

SEQ ID NO: 684 - DNA, 1697 bp, Zea mays
  Predicted polypeptide sequence is orthologous to G409
cattgggtacctcgacgccggccgggcttttgtgtatatatatttcttgttattttcaaaggattaaaaaaaaaaaaaaaaaagccattggggaccgcgaccccggccggggccggtagccacaaatttcacccaaaaccaaaaaaaatcccaaattaaagaaaacgaggagaagaaaaacaactttcatcgccgtccgccaccggagctcccttcgtcggccttccttcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcgggcggcgcggtggcgcgcagatgctgctcttcggcggcggaggcagcgccaacagcaacggcttcttccgaggtgttccgatggcagtcctggccatggacgacgcgacgcgcgtgggcaagcggcccttcttcacgacacacgacgagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatggctacccaagaggtcgaccagccagacgaacacaccacaggcactgagaaattgctggcgcagcagctcaaggacgacctgcacagcagctgcggttgcactggacatggtgccctgtcttcggaggaagaggatggtggcgtggtcagcgatgagggctgcagctttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgccctagccgccaaaaaaaaaaaaaaaaaaaaaaaaaaaaaaaaaaaaaaa

SEQ ID NO: 685 - DNA, 1950 bp, Zea mays
  Predicted polypeptide sequence is orthologous to G409
  misc_feature (12)..(13): n is a, c, g, or t
  misc_feature (16)..(18): n is a, c, g, or t
ccggccaaaaannaannnaacaaaaaaaaaaaaaaaaaaaaaaaaaaaaaaaaaaaaaaaaaaccttacctggacggggtcgacgggcgatcaccaaggctcggggcctaggccaatggcccacattgcacttggggggggcgttggtttaccatctccccaagggggagaggggacgtcataatttggggtaaagggggtacgcgttcgcgcggcccctgccttaaaaaaagaaaaaaaaaaaaaaaaaaaaaaaaaaaaaaaaattttttagccacaaatttcacccaaaaccaaaaaaaatcccaaattaaagaaaacgaggaaaaaaaaaacaattttcatcgccgtcctccaccggagctcccttcgtcggccttccttcagggtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggtgggtgccgtggtctagcggtgagggccgcacagactttgatgtctccccgacgccatgtttgctgttggggtcaccataccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatgggcgtcgcggccgcaaaaaaaaaaaaaaaaaaaa

SEQ ID NO: 686 - DNA, 1240 bp, Zea mays
  Predicted polypeptide sequence is orthologous to G409
  misc_feature (680)..(680): n is a, c, g, or t
cctcgaggcggcgggcggttttcaggaattctccaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcggnccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtcatcgtctgaagttcgatgtcatggtgcgatgaaaagactgcaagtgcaagcatatccgtaggaaactaggaactagagttaaaactggggaataatgtaaatgagttcatgatcatcgttgtttggatgttttggaatgccatgtatgtccaatttggggcctccatgttatcaacattcctgaaacgtgggctttaagatgagcaaaaaaaaaaaaaaaaaaaaaaa

SEQ ID NO: 687 - DNA, 1673 bp, Zea mays
  Predicted polypeptide sequence is orthologous to G409
ggggcgcacacggatagggggggacccaccagtcgcgggggaataattcgcggcggagaggggggagcgccccagagagggggggcccgactcgggggggggcggtggcaacaggggggggaaggggggaaacggaccccctggggctcctgaaaagatgaaaaaagggggcttaggaggagaggggcggcgcaatgcgcttccacaaacgggagggaggggacaaaggctctccgcggtgcggcaagagggcaaaaggcgcgtcccgccgccacccggtgtgcggtttgccggaaaccacaaaagggggcccccggggggtctccccaattgaaagtcgggccgagaggattagtccccacatagttgggggcaaatacgttttccggcggcggacccgggtggggaaccgtgatgggcccggggggtttagggggggcggacagggggggaggaggggaaatcgtcccccggggaaaggcgcgaaataaaaaaggtcggggtggggaggcccccagggggggggccggggaaaaagtggccgggttgccgggggccggtagtgtggtgtctgcccggggtttttttttttttttttttttttttttttttttttttttttttttttttttttttttttttttttttttttttttttttttttttcactttcactcacagctattacacatggcgaaaatgcatacagtaatttttttttggcacgagatttggcggtcggtccccgcgggaagattgctctgctagttccacatccaccaccagctgacctggccggcgtcctcgtcgtcgccgtccgcgtggtgggtgtgttcggagaggaacgcggcggcggcttcttcgtcggcgtagtagctgcatccctcgtcgctgccggcgccgtcgtcgtcgtccgactggatgcctccagcgccgtgggttactggacccatcgtcccgcagccgtggtactggtcctggacctcggcgccggggaagtacgactcgacgctgctatcgacggccgcgccgccgatcctgccgttgtacaacagcgcgtccgccgggtccaccaccgcgctcccgccgttgcccgtgctcatcagcctgtcctcggacttcacctgccgctcctcgaacgccgccgcctctgcctccggctccggctccggctccggttcctcgacgtcatcggccacggaagccctgacaacgcccaccgccggcaacgccgccgcggcgccgttggcgtcgccctccgtcgcctccttctctcgcagcttctcggtcaacgacaccacctgtgagcggaggcggtggttgtcctggagaagggcgtcgtggtccgcgcggagggcgtcgaaggaggccttgaggcggtcgaagtcgcgctccagctgcttggtcttccaccgggcgcgccggttctggaaccacacggccacctgccggggctgcaggcccagcttgcgcgccagctccgtcttgcgctccggctccagcttgttctcctcctcgaagctcctctccagcaggtgcacctgctccggcgtcaggcggcgcttcttctccggcagctgctcgtcgtagtactcctcctcgaggagctcgtcgggcgaggtgtagaagggcgttttacgccgcgccttcttcaaggccaagcatcgcccggg

SEQ ID NO: 688 - DNA, 1370 bp, Glycine max
  Predicted polypeptide sequence is orthologous to G427
tccacgcgtccgcttcaccctctcacaacaataccgctgcagtagagaagtcccttaaataaatctgaatttccctgctttgcttcaccaccccccttgcttgcgtgggtagaaatgcaagaagcagggctgggaatgggaatgggaatgatgagcggagaagtatccgccgccggggaccaccaccgtcaagtgaaggcggagatagccaaccacccactctatgaacagcttctatctgcacacgtgtcatgcctccgcgtcgccacacctatcgatcagttgccgctcatcgacggacagttatcgcagtcccaccatctcctccgctcttatgcctcacaccattcccattccctctcgccccatgaccgacaagaacttgacaacttcatggcacaatatttgattgtgttatgtacgttcaaagagcagcttcagcaacatgtgagggtgcatgccgtggaggctgtgatggcctgccgtgatattgaaagtaccttgcaagctctgacaggagtcagtttgggagaaggaacaggtgcaacaatgtcagatgatgaagatgatttgcagatggatggctctttagatcagtctagcgctgacgggcatgacatgatgggatttggtccattgcttcctacagaatctgaaaggtccctgatggaaagagttcgtcaggagcttaagattgagctcaagcagggttttaagtcaagaattgaagatgttagggaggaaatattaaggaagcggagagctgggaaattaccaggtgacacaacatcggttttaaaggcctggtggcagcaacatgctaagtggccctacccaactgaagatgacaaggcaaaacttgtggaggagacagggttgcagctgaagcaaatcaataattggttcatcaatcaaaggaaacgcaactggcacagcaactctcaatcggttaactctctgaagtccaagcgcaagagagagtatgcccactaaggattccagtctggtgcagaagataacaggtgatgcactacaacataagatggcttacaatagtgatggttgtaaattcttggaatacataacggatacaaactattcttgttgtgcacggtcgcctccatttctttcaagtgtttttttatttgtaaatttgtttgctatgatttgactggctgaagaagtatttttagcagctgaaagcctgaaagtgtttcctatacttgatatgcttgcatgtactattatgtatattttgtgttgtgcttgatatcagttaaatttacaagtactaacatctccatcctttggaggagataactgtaatttgtaaggatgcaaaaaggaatttaaggacgaattggctaatg

SEQ ID NO: 689 - DNA, 1306 bp, Glycine max
  Predicted polypeptide sequence is orthologous to G427
gaattcggctcgagctcgagccgaatcggctcgagacggctgcgagaagacgacagaaggggggtccggaatcccggccttggacgaaaagaaaggaagagatgcaagaagcaggcttgggaatgatgggtgaggtctccggcgatcagcaccgtcagctgaaggcggagatagcgactcatccgctgtacgagcagcttctggcagcacacgtggcatgcctccgtgtggcgactcccatcgatcagcttccactcattgatgctcaattatctcagtctcaccatcttctacgctcttatgtctcacacaacactctttctctctcccctcatcaccgccaagaacttgacaacttcctggcacaatatttgatagttttgtgtacatttaaagaacagcttcagcaacatgtcagagtccacgccgtcgaggctgtcatggcctgccgtgatatcgaaaataccttacaagctctcactggagtgagtttgggagaaggaactggtgcaacaatgtcagatgacgaagatgatttacagatggatttttctttagatcaatctagcgctgaagggcatgacatgatgggatttggtcttcctacagaatctgaaaggtcattgatggaaagagttcgccaggaactaaagattgagctgaaacagggtttcaagtcaagaattgaagatgtcagggaagaaatattaaggaaacgtagagctgggaaattgccaggtgacacaacttctgtgttgaagaactggtggcagcaacatgcaaagtggccttacccaactgaagatgacaaggcaaaacttgtggaggagacagggttgcagctgaagcaaattaataattggttcatcaaccaaaggaaacgtaactggcacagcaactctcaatcggttacttctttaaagtccaaacgcaagaggtagacattatattattttgtccctaactatgtggaacagctagcaagcaacacaactatatataaggacatgcttattgctgataaagtgtagtcccactaaggattcagaagatagtagatggggttactgtaatattgtaagatagctgaaacaaattcgaggctggctgtaaatttgtggaacttaacgtatgcaaacttttcttttaggtgtggttaagttgcctctctttttaactgtctttgtaaattgttttgctacttttctgaccggcggaagaattattattactactacacagatgattgaaagattcgctggtctattaaagattctcggttctttatatatatgctctttggtcc

SEQ ID NO: 690 - DNA, 1169 bp, Glycine max
  Predicted polypeptide sequence is orthologous to G427
attcggctcgagggtgttgtgtgagacataagagcgtagaagatggtgagactgagataattgagcatcaatgagtggaagctgatcgatgggagtcgccacacggaggcatgccacgtgtgctgccagaagctgctcgtacagcggatgagtcgctatctccgccttcagcttccactcattgatgctcaattatctcagtctcaccatcttctacgctcttatgtctcacacaacactctttctctctcccctcatcaccgccaagaacttgacaacttcctggcacaatatttgatagttttgtgtacatttaaagaacagcttcagcaacatgtcagagtccacgccgtcgaggctgtcatggcctgccgtgatatcgaaaataccttacaagctctcactggagtgagtttgggagaaggaactggtgcaacaatgtcagatgacgaagatgatttacagatggatttttctttagatcaatctagcgctgaagggcatgacatgatgggatttggtcttcctacagaatctgaaaggtcattgatggaaagagttcgccaggaactaaagattgagctgaaacagggtttcaagtcaagaattgaagatgtcagggaagaaatattaaggaaacgtagagctgggaaattgccaggtgacacaacttctgtgttgaagaactggtggcagcaacatgcaaagtggccttacccaactgaagatgacaaggcaaaacttgtggaggagacagggttgcagctgaagcaaattaataattggttcatcaaccaaaggaaacgtaactggcacagcaactctcaatcggttacttctttaaagtccaaacgcaagaggtagacattatattattttgtccctaactatgtggaacagctagcaagcaacacaactatatataaggacatgcttattgctgataaagtgtagtcccactaaggattcagaagatagtagatgggttactgtaatattgtaagatagctgaaacaaattcgaggctggctgtaaatttgtggaacttaacgtatgcaaacttttcttttaggtgtggttaagttgcctctctttttaactgtctttgtaaattgttttgctacttttctgaccggcggaagaattattattactactacacagatgat

SEQ ID NO: 691 - DNA, 1239 bp, Glycine max
  Predicted polypeptide sequence is orthologous to G427
  misc_feature (500)..(500): n is a, c, g, or t
aaaaaaataaaagagaaaagaaatgaagttgtcaggtgacagaagcagctttatcttctttttctgacccctttcatagtaatgattccgcagcttgttactctcttctctctcaaaacaaaacttgaatccatccatactctacataccccttgcccttgctttgcttctttctttctcacaagcaccagcagcactcaaatcaatcaatcgtttttaatgcccttgcttctccctctttccgtgtgtatgtaaaatctttgtttttatcagaggtggtgcagaaagttgtatctcagatccctatatacaccgaaaacgatacaactgtgtgctgtgtacactgtgcactgtgcttctccctctctctctctctctctctcacaaaatcataatcattttacatattacacctattaccgaatagagtggtcctcaacctcaacctaaaagcctcactttttttgttttccccgataaccctattcaacccaatcctnctttccttttcctttgccaatgtgcttcaccaccccccttgcttgcgtgagggaaggtagaaatgcaagaaccagggctgggaatgggaatgggaatgatgagcggagatagccaaccacccactctatgaacagcttctatctgcacacgtgtcatgcctccgcgtcgccacacctatcgatcagttgccgctcatcgacggacagttatcgcagtcccaccatctcctccgctcttatgcctcacaccattcccattccctctcgccccatgaccgacaagaacttgacaacttcatggcacaatatttgattgtgttatgtacgttcaaagagcagcttcagcaacatgtgagggtgcatgccgtggaggctgtgatggcctgccgtgatattgaaagtaccttgcaagctctgacaggagtcagtttgggagaaggaacaggtgcaacaatgtcagatgatgaagatgatttgcagatggatggctctttagatcagtctagcgctgacgggcatgacatgatgggatttggtccattgcttcctacagaatctgaaaggtccctgatggaaagagttcgtcaggagcttaagattgagctcaagcagggttttaagtcaagaattgaagatgttagggaggaaatattaaggaagcggagagctgggaaattaccaggtgacacaacatcggttttaaaggccctggtggcagcaacatgctaagtggccctac

SEQ ID NO: 692 - DNA, 1089 bp, Glycine max
  Predicted polypeptide sequence is orthologous to G427
ccacgcgtccggtccgggtccatgcaatggaagcagtaatggcttgttgggagttagagcaatcattgcagagtctaacaggagtttcacctggagaaggtacaggggcaacaatgtctgatgatgagaatgaccaagtagatagtgatgccaatctcttcgattgtagttttgatggggcagatagcatggggtttggtcctcttgttcctacagagagcgagaggtccctcatggagcgagtaagacaagaattaaagcatgaactgaaacagggttataaggagaaaattgttgacataagagaggaaattttgcgcaagagaagagcagggaaacttcctggtgacacaacttctgttcttaaagcttggtggcaatcacattccaagtggccttaccctaccgaagaggataaggcaaggttggtgcaagaaactgggttgcaattaaagcagattaataactggtttatcaatcaaaggaagaggaattggcacagcaatccttcaacttctactgccttgaagagcaagcgcaaaagaagcaatgcaggtgataactgatgatcgttgcatgaaattcaactctttgtcctttggtcaatcatggaaagacaatgagaaagaaccacattttgtttctgatgggccagggttaaagcagatcaaggagctaatattggtgaaccagtttacttatgcttaaaggccagcaaatagttcatatagtacttgtgatgctacataattaggaagttcaattaagaatcatataccaacagagaattatgatttttgttcatgttttattgctttgtgaaatatagtatatggtagcgaagggggttatgggtgtacagtaataagctgtgcattttttttcccttacaatcatactcttgtttttgttcttggtctttcaattggtatttggtaatgtagagagtaatttgttgtttaaatatggtataagtttttccattttatatatattatgttatcggtatggagtattcattgccttttctgataactaatatagtgtggagttgttaaaagatccaccatatagtgtggtgggttcttt

SEQ ID NO: 693 - DNA, 1331 bp, Glycine max
  Predicted polypeptide sequence is orthologous to G427
aggtcatcgatgacgtggccggcgcaggcgccgaatccggagatttgaagggagagacggcgccggtggacggcctcttgaactggcagaatgcgagattgaaggcggagattttaacgcatcctctgtacgaacagcttctgtcggcacacgtggcgtgcttgcggatcgccacgccggtcgaccagttgcccaggatcgacgctcagctcgcacagtcccagaatgtggtcgccaagtactctgccttcggacaagccatcgttggcgacgataaagaactcgatcagttcttgtcccactatgttctgttgctctgttctttcaaagaacaacttcaacagcatgtccgggtccatgcaatggaagcagtcatggcttgttgggagatcgagcaatccttacaaagtttaacaggagtttcacccggggaaggtacgggagcaacaatgtctgatgacgaagatgagcaagtagatagtgatgccaatctgtttgatggtgctttggatggtcctgatagcatgggattcggtcctcttattcccacagagaatgagaggtccctcatggaacgtgtaagacatgaattgaagcacgaattgaaacagggttataaagataaaatcgtggacataagagaggaaattttacgtaagagaccagctgggaaactttctggtgacacgacctctgtccttaaagcttggtggcaatcacattccaagtggccttatcctacggaggaggataaggcacggttggtgcaggaaacgggtttgcagttaaagcagatcaataattggtttatcaatcaaaggaagaggaactggcatagcagtccctcaacttctactgttttgaagagcaagcgcaaaaggtcatagtggtgctgatcatcacatgtaaatggaggaaaactcaagaaccaatccctgactctgtactctgttagtttgtctctgcggtcaatcatgggtgcatggcaagggattcaagtaaagtcaatgataaaaaaaaaggttcagattttgtttttgctcaaggaacaggcctaaaacacagatgtggaggattaaaagcctgcagtacggtgatgcatcaaaattagggagttcaattaggaattatataccgatatcaaaatgggtacctccatgggagcatgatttttagtgatatatatatatatatatatacattaatgtttgtgaaatatatataatagtgaggggttgtgggtgtatagtaataatcagagcatttttccttcaataatgctaaatttgtttttgtgcttgaattcttggcctcgagggccaaattcccta

SEQ ID NO: 694 - DNA, 1428 bp, Glycine max
  Predicted polypeptide sequence is orthologous to G427
gaattcggctcgagcggcgccggggagtccatggtggagcacgccgatttgaaggacggcggcggagacgccgtgagctggcagattgggcggtgtaagacggagattctgcagcacccgctgtacgagcagctgctgtcggcgcacgtggcgtgcctccggatcgccacgccggtggaccagctgccgaggatcgacgcgcagctggcgcagtcgcagaatgtggtcgcgaaatacgcagtgttcggacacaacaacatcgtcgccgatgacaaagaactcgaccagttcatgtcgcactatgttttgttgctctgttccttcaaagaacaattgcaacagcatgtccgggtccatgcaatggaagcagtaatggcttgttgggagttagagcaatcattgcagagtctaacaggagtttcacctggagaaggtacaggggcaacaatgtctgatgatgaagatgaccaagtagatagtgatgccaatctctttgatagtagtttcgatggggcagatggcatggggtttggccctcttgttcctacagagagcgagaggtccctcatggagcgagtaagacaagaattaaagcatgaactgaaacagggttataaggagaaaattgtagatataagagaggaaatcttgcgcaagagaagagctgggaaacttcctggtgacacaacttctgttcttaaagcttggtggcaatcacattccaagtggccttaccctaccgaagaggataaggcaaggttggtgcaagaaactgggttgcaattaaagcagattaataactggtttatcaatcaaaggaagaggaattggcacagcaatccttcaacttctactgccttgaagagcaagcgcaaaaggtgataactgatgatcgttgcatgaaattcaactctttgtcctttggtcaatcatggaaagacaatgagaaagaaccacattttgtttctgatgggccagggttaaagcagatcaaggagctaatattggtttacttatgcttaaaggccagcaaatagttcatatagtatttgtgatgctacataattaggaagttcaattaagaatcatataccaacagagaattatgatttttgttcatgttttattgctttgtgaaatatagtatatggtagcgaagggggttatgggtgtacagtaataagctgtgcattttttttcccttacaatcatactcttgtttttgttcttggtctttcaattggtatttggtaatgtagagagtaatttgttgtagaaatatggtataagtttttacttgttatataatttaaatgctcgttgtcatggtgctacaaatcgtaaacacttttaactgttgtctgttggaaggtataataatagtgtggtgggttcttgtgatttgacatgtagatggatgtgcagtgt

SEQ ID NO: 695 - DNA, 1628 bp, Glycine max
  Predicted polypeptide sequence is orthologous to G427
cttcttccttcctccttctctctctcaccctttctcccccactccctagtcagctagctcctgcaacaacaaccactcctcttctttttctcacccaaatccacgcttcccttacaccgcgtttggatctccgttatacaaactcattaaaatgttgcgagagaaaaacaaaacagaaaaaaaattcagttaatttattaaattttgttatggctttccacgaccatctccagcacgagatagcgttccagcgtttcacggaggagcaagagttgaacgagaacagagacatgcagcagaggctcccacctccgacatggctcaacaacgttaacgcgcgtcaacagaatttcctcgacaccgagaagagcgtggatcggaacaaccgaagcgagagcaattgcgaatccgaggatttgagggaatacaaagcggacattctaggtcaccctctctacgatcaactgttgtcggcgcacgtctcgtgcctcagaatcgccacgcccgtggaccagcttcctaggatcgacgcgcagcttcagcagtcgcagcgcgtggttgaaaagtactctgcacttgcacacaacggggtcgtcgatgagaaggagcttgatcagttcatgacccattatgttctgttgctctgtgcctttaaagaacaactgcagcagcatgtccgtgttcatgccatggaggcagtgatggcttgttgggatctggagcaatctctgcaaagcttgacaggtgtatctcctggtgaaggaacgggtgcaacaatgtcagacgatgaagatgaccaggcagagagcaatgccaacttatacgaaggaagccttgatggcggcgaaactcttggatttggtcctcttgtccccactgaaagtgaaagatctttgatggaaagagtcaggcatgagttgaagcatgaactaaaacagggttacaaggagaagattgtggacataagagaagaaattctaagaaagagacgagcggggaagcttccaggggacaccacatcccttttgaaagcttggtggcaatcacattctaaatggccttaccccactgaggaagacaaggctagattggtgcaggaaacagggttgcaattaaagcagataaataattggttcataaatcaaaggaaaaggaactggcatacaaataacccctcatcctctagcaactccaaaagcaagcgcaagagtagtgcaggagaagccagtaaccagagcttcatgtgaacggtcgcatattttgaacaaaaattattggtattgttctcccttttaatgcatgctcgtgggattcatagatcttacggtccagcgtgaacgtgatggattctggatgaaaaagggaaattcatgatatataaaaccactgtattggttgaattacagaaaattatccctggtattgttgtatatgaggctgctgcatgccgcttgatatctgatattgatgcagtcgcattctattcgatttaatgggtagcatgctgatattattctgcttatttaaaaatattatggatccatctggtgtagttcaattttttttattaacaaatttaattgttagtttgttaatttttgttagtaggtaattgaatccaatccttt

SEQ ID NO: 696 - DNA, 1742 bp, Glycine max
  Predicted polypeptide sequence is orthologous to G427
atcctcttcaccctccctccctccctcgatcttcgtgtcaacacttcaaaaagtcttcccttatagaacaaagtgtttttccaaatcccttcccttcttccaaatccctttactgtcacgtgaaatctaacaccgagcgtgtagatagtctatgaaatccaattaaatgttcttctgagaacaaagaacataagataacaaacagaaagcgcttataaatggctttccacgaccatctaccgcacgaaatcacgttccagccgtttaccgaggagcagcagttaggtcagagcagggacatgcagcggctgctcccgctctccggcggggcgccgacgtggctgaacaacagcaccgcggcgacgctccgccagcagaatttcctccacctgcagccggaatccgccgcaacgacgcagcaaaacgacgacgttcgcggcggcggcggcagcggcatggatcggaaccggaccgagagcaactctgaaccggatgatttggcagaatacaaagcggacattttaggtcaccctctctacgaccagctcctatcggcgcatgtctcatgcctgagaatcgccacccccgttgaccagcttccaaggatcgacgcgcagcttcagcagtcgcagcgcgtcgtcgacaagtactccggcatcggaaacggaaacggcgtcgtcgacgacaaagagcttgatcaattcatgacgcattatgttatactgctctgtgctttcaaagaacaattgcaacaacatgtacgtgttcatgctatggaagctgttatggcttgttgggagctggaacaatctctacaaagcttgactggtgtatctcccggcgaaggaacgggtgcaacaatgtccgacgatgaagatgatcacgcagagagtaatgccaacttgttcgaaggaggcatggatggagctgatagtctcagctttggtcctcttgttcccacagaaactgaaagatctttgatggagcgtgtgaggcaggagctgaagcatgagttaaaacagggttacaaggacaagattgtggacataagagaagaaattttacgaaagagaagagcgggaaagctaccaggcgacaccacttcccttttaaaagcttggtggcagtcacattctaaatggccatatccagcagaagaggacaaggcaaggttggtgcaggaaacagggctgcaattaaagcagataaataactggttcataaatcaaagaaaaaggaattggcatactaatccgtcgtcttctagtggctccaaaagcaaacgcaagagtagtggtgcaggtgaaacaagtaaccagagcttcatgtgaatgaacacctgatttgaactgaaaaaaaaaatagatatatctctattcttcattttatgcaacaatggtgagattcatatatgaccggagcttagagggaaaaacatgaacggaaatggtggaatatggatgatgaaggagtaatttgtgataccaacatttacttggggggattaattaattacttggttcaattacagaaaaacctagtattgttgtatatgaggctgctgagttgatacctgatactgttgcaggcactatctatttggttcaatgggtatctatgtattactattacagttcaaaggtttttgataaaaaagaaaaaaacaacatagaatccttgaatgcggtgcaaattaacgatcagttttatttgttacacacataagtgtcctacatctgata

SEQ ID NO: 697 - DNA, 772 bp, Glycine max
  Predicted polypeptide sequence is orthologous to G427
ccggtccggattccccgtcgacccacgcgtccgccctattcaacccaatcctcctttcccttttcctttgacaaaaggaaaggaagaaatgcaagaaccaagcttgggattgatgggtgaggtctccggcgatcaccaccgtcagctgaaggcggagataacgactcatccgctgtacgagcagcttctggcagcacacgtggcatgcctccgtgtggccaccccgatcgaccagcttccactcatcgatgctcagttatctcagtctcaccatcttctacgctcttatgtctcacacaacactcattctctctcccctcatcaccgccaagaacttgacaacttcctggcacaatatttgatagttctgtgtactttcaaagaacagcttcagcaacatgtaagagtccacgccgtcgaggctgtcatggcctgccgtgatatcgaaaatgccttacaagctctaactggagtgagtttgggagaaggaactggtgcaacaatgtcagatgatgaagatgatttacaaatggatatttctttagatcaatctagcgcggaagggcatgacatgatgggatttggtccattacttcctacagaatctgaaaggtcattgatggaaagagttcgccaggaactaaagattgagctgaaacagggtttcaagtcaagaattgaagatgtcagggaagaaatattaaggaaacgtagagctgggaaataccaggtgacacaacttctgtgttaaagaactggtggcagcaacatg

SEQ ID NO: 698 - DNA, 1371 bp, Oryza sativa
  Predicted polypeptide sequence is orthologous to G427
tttttttttttttttttatataagtgattaactgattaagcacacagagtgcagcagaacacaatagataagctaaataaacccacagcaatacatgcatatatacgtgtgaaaaaaatcgtctgaagcggacggttcaaccgcttgtctacgacgcatggagaacaaaaacatcaacaccagtgctatgagcagtattacccagtggtatctagaaactgaaatataaatttcgccattttatacaacccctttggaaaaatttccccttttcttcaaatcaagcgcttacagaactatatatgtttacttgcaattagttttgtctataaaatataactggttctctaatatacggctcctgatcctgatcttgcagaacatttcctgatctaagcaattgtcctcctattgctttggatgaattcctcctgccctgtaacccagcatagtgttcagccctcggcgatcatctgctacgaattgttatcacctcttgcgtttggttttgacgctggtggaggaagatgggttactgtgccagtttcttttcctttggttgatgaaccagttgttgatctgctttagctgtagccctgtttcttggactagccgtgccttgtcttcctctgttggatatggccactttgcatgagactgccaccaagcttttaacgtagaagtcgtgtctcccggtagctttcccgctcttcgcttgcgaagaatttcttctcttatgtcaatcagcttctctttgtaaccctgctttagttcatgctttagctcttgacggacacgctccattagggatcgctcgctttctgtgggaaggccgaaacccatgttatccgctccatccaagcttggatcatacatgtttgcctcgctatctgcctgatcatcttcaccatctgacatggttgctcccgtgccttcaccgggcgaggcacctgtcaaactctgaaggttttgttcaagttcccagcatgccattactgcttccatggcatgaacacggacacgctgctgtagctgctctttaaacgaacataatagcaagacgtagtgcgtcatgaactggtcgagctcgcggccgtcgtccccggcggcggcggcggcgagggcggagtacttggcgacgaccccccgccccggcgcgtcctccgcgtcgatgcgggggagctggtcgaccggggtggcgatgcggaggcacgccacgtgcgccgacagcagctgctcgtacagcgggtgcgccagtatctccgccttgcaccgcgccgcgtccgcctcgccgccgccgcccatcgcggccgctctagaggatccaagctacgtacgcgtgcatgcgacgtcatagctcttcatagtgtc

SEQ ID NO: 699 - DNA, 599 bp, Zea mays
  Predicted polypeptide sequence is orthologous to G427
  misc_feature (70)..(70): n is a, c, g, or t
acacgtacctaaacttgttttctctagcccggccggctaccctagctttgtatccggtagcggaatgggncggaggcgcccggctgggagagggagaaggatggcatcgctggcagcacccaatcatcgagcgtatagtccaggcgcacgtcagctgcctccgcatcaacaccccaggggaacagctcccgatcatcgacgcgtcacatagatgatgaggccactcacccatggaggccgccgctgcgactgcatgtggtgggcggagcacactaggcaggcaaggagctcgacctcttgatgacacattatgtgttgctactctgttcattcaaagaacaactacagcaatatgtgcgtgctgatgcaaaggaagcagtcatggcttgttgggagctataacaaactttacaaagccttacaggagcatctcctgccgagggcactggctcaactatatatgacgatgaagacaaacaggtggacagtgagagcaacatgtttgatggaaatgaggggtcatgatagaatgcaatttgccccattaatgttgactgatggtgagagatccttagttgagcgtgtccgtgactagctaa

SEQ ID NO: 700 - DNA, 330 bp, Zea mays
  Predicted polypeptide sequence is orthologous to G427
  misc_feature (61)..(61): n is a, c, g, or t
  misc_feature (64)..(66): n is a, c, g, or t
  misc_feature (69)..(69): n is a, c, g, or t
  misc_feature (79)..(79): n is a, c, g, or t
gatcatacggtatgggctttggcccccggacgtgacataggaagatcgggggttaaaaaancannnacngaaggagctnaagaacgagcttaagcagggttacaaggaaaagctgggcgatatcaaggaagagatcatgcgcaaacacaagactgggaagcttcctggaaaaaccgcatatgtactgaaagcttggtggcaagctcattccaagtggccgtacccaactgaagacaacaaggccagactggtgcaggaaacagggttccatctaaagcaaatcaacaaccggttaattaaccaacacaagcggaactggcaaagaaaccc

SEQ ID NO: 701 - DNA, 1214 bp, Zea mays
  Predicted polypeptide sequence is orthologous to G427
gtcgtaagctgatccttagagcggcgcgcggaggggtgatagcggcagctgctcaagggggagatcgcggtgcacccgctgtgcgagcagctagtggcggcgcacgtggggtgcctgcgcgtggccacgcccatcgaccacctccccctcatcgacgcccagctcgcgcagtccagcggcctcctccactcctacgccgcccaccaccgccccttcctctccccgcacggcaagcacgacctcgactcgtccctcgcgcagtacctgatgctgctgtgctcgttccgggagcagctgcagcagcacgtccgggtgcacgccgtggaggccgtcatggcgtgccgcgagatcgagcagtccctgcaggacctaaccggggcgacacttgaggaagggacgggggcgaccatgtcagaggacgaggacgaggcgccgatgctggaggtgggcctggatatgggctccgacgggcacgacatgatgggcttcggcccgctcatgcccaccgactcggagcgctcgctcatggagagggtcaggcaggagctcaagatggagctcaagcagggtttcaagtcgagaatagaggatgtgcgggaggagatcctgaggaaaaggagggccgggaagctgcctggggacaccaccagcatcctcaagcaatggtggcaggagcactccaagtggccataccccacggaagacgataaggctaagctcgtcgaagagaccggcctgcagctgaagcaaatcaacaactggttcatcaaccagaggaagaggaactggcacaacaactcccagacgtcaaccctcaaatcgaagcgtaaaaggtgatggaggagagctagctgcaccgtatataccgtgtatgtaacgcacacctgctgacacacatgtacacatgtataccataccaacacgctaatcaaacggagctctgcatggcgactgtactcacggaaataaagaggaccatatcgaccggttcaactgtatatctagccattagtctgaccactggcatatttgtttgctgcggctgatactttgagctgatgatgtgtggctcacagcatactttattcttgttcttattgtgttgacatagtttgtcccccataatcttgaggattatcatcttgaggatgaaactgggagggggggccgggacccagttgggcctatgggggaggggattacgcgcgctgact

SEQ ID NO: 702 - DNA, 676 bp, Zea mays
  Predicted polypeptide sequence is orthologous to G427
  misc_feature (17)..(17): n is a, c, g, or t
cccgggcaagatagagntgtgagggaggagattctgaggaaaggagggccgggaagctgcctggggacaccaccagcatcctcaagcaatggtggcagcagcactccaagtggccataccccacggaggacgataaggcgaggctcgttgaagagaccggcctgcagctgaaacaaatcaacaactggttcatcaaccagaggaagaggaactggcacaacaactcccagacgtcaaccctcaaatcaaagcgtaaaaggtgatggagagctgcgccaccatgtactgcacacctgacacgtataccaattaccaacacgctaatcaaacgacgtacggccatgcatggcgactcacaagaaataaagaggatcgatcgattcaactgtatatttctagtcattagtcactagtcagagaggtgacaggttcatgacacacacaaacacacgtacactagtctgaccactggcatatttgcttgctgctgtgattaatatattttgagccgatcatgtgctcggaccatactttattcttgttattattgtatagccatagtttgtccaccccaccccctgtgcacatatatacagtgacctgatctgaccatctcatctgctggcaggaagagatcgaagaacagagaggttaattgcattcatctttgtaccat

SEQ ID NO: 703 - DNA, 1076 bp, Zea mays
  Predicted polypeptide sequence is orthologous to G427
gacacattatccgcgcctccgcccccgcgtccgcccacgcgtccggcagcatgtacgtgttcatgcaatggaagcagtgatgggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgttgatatcagggaagagattatgcgcaagcgcagagctgggaaacttcctggagatactgcatctgtgctgaaagcttggtggcaagctcattccaagtggccatacccaactgaagacgacaaggcacgactggtgcaggaaacgggattgcagctaaagcagattaacaactggttcatcaaccaacgcaaacggaactggcacagcaacccaacatcctcgggtgaaaagactaagaagaaaaggtgatattgatccagagcaatcttgacgatgctaaacgtccactgtgtactttatggcgaagtacattaccctccctccgtagccaggagcggagatgtgcatcttgggtggcccagtggtcacttaatgccccaagtttgaccacgttgtgggactggtgctagtagtgacctctgcagtatagtaatattcactaatgttgtgggaatcatgtggtgtataaccggcgaacgggagggagtaatttatgttttattgtaattgtctatctttaccttgtaatgatattttagggagaatcccaagatctcagaatggccgttcactgtattgtcggtggtaaaagtggtgggcaatcatcgtgttcagattacctccagaagggtatgcaatggctcgaatgttccatgtcgtgtttagctggttgtcgtttgtcttacttcctgctgagttggatacttgattccttcgaagatgtaaagcacccatcgatgcc

SEQ ID NO: 704 - DNA, 1463 bp, Zea mays
  Predicted polypeptide sequence is orthologous to G427
attcggctcgaggctcccgctcccgctgctttttatcttctcgcgccgcggcccccagcctttgcccgccgctacctctctctaattgggcggcggcctgccggtccgatggcgttcaactaccacgaccacgcgctggcgatggaccccgcgaaccctagctttgtctccggaggtggcatggccggggggcccggctgggagagggagaaggcggccatcgcggcgcacccgctgtacgagcgtcttctcgaggcgcacgtcgcctgcctccgcgtcgccacccccgtcgaccagctcccgcgcatcgacgcgcagatagcggcgaggcccccgcccatggaggccgcggctgcggctgctgcggcgggcggagcacactcgggaggcgaggagctcgacctcttcatgacacattatgtgttgctcctctgttcattcaaggaacaactccagcagcatgtgcgtgttcatgcaatggaagcagtcatggcttgttgggagctcgaacaaactttacaaagccttacaggtgcatctcctggtgagggcactggggcaactatgtctgacgatgaagacaatcaggtggacagtgagagcaacatgtttgatggaaatgaggggtcagatggaatgggatttggcccattaatgttgactgagggtgagagatccttagttgagcgcgtccggcaggagctaaagcatgagcttaagcaggggtacagagacaaacttgtggatattcgggaagagatattgcggaagcgaagagctgggaaactccctggcgacactgcttctaccttaaaagcatggtggcaggctcattctaagtggccgtacccaaccgaggaagacaaggctcgactggtgcaggaaacagggctacaactgaagcagatcaataactggtttatcaaccagcgtaagcggaactggcacaacaattcggcgtcatcctcgtcggacaaaagcaagagaaaaaggaacactgcaggtgatgggaacgcagaaccagcctggtagggcatggtcggggaacgaagtttatgtaaataatgcttctactgtgaagagttccatcatatttgttgctccagaaaagaccctcagaccggtgtttcctgaacccatattcatacaaagacatcaggcgatgaataatgttgcgagtagtcaaataaaataaataacttgtatagtgaataactagaaactagcattcatcgttttggtattgtatagcgctagagtgtaattgtttggtcggactgtcttgtataatggtgtaaggttcaaatgcattttgacctagcattcgatattgtattttgtgatgttaaaaaccattggattcgttttgtgttttatccgtggaatagggacactgttagtgttgccctcaaaaaaaaaaaaaaaaaaaaaaagggcggcagcgcgcccctcgcgcctggaac

SEQ ID NO: 705 - DNA, 780 bp, Zea mays
  Predicted polypeptide sequence is orthologous to G427
  misc_feature (763)..(763): n is a, c, g, or t
agcagtggtaacaacgcagagtacgcggggatggaaatgatggatcagacggtatgggctttggccccctaatactgacagagggtgaacggtccttagttgagcgtgtacggaaggagctgaagaacgagcttaagcagggttacaaggaaaagcttgtcgatatcagggaagagatcatgcgcaagcgcagggctgggaaaccgcccgcggcgaccgcatctgtactgaaagcttggtggcaagctcattcgaagtggccgtacccaactgaagacgacaaggccaggctggtgcaggaaacggggttgcagctaaagcagatcaacaactggttcattaaccaacgcaagcggaactggcacagcaacccaacatcctcggctgaaaagaccaagaagaaaaggtgatgatggcccagagcaatcttggcaaaagctagagatgtccactatactttattatggcgaagtacattctccctcacttcgtaggcaagagggaaaggtatcttgggtgacttgagtggccacctaatgcgcaagtttgaccacgtgtggggctggggttggtagtgacctcagcagtatagcattcgctaacgtgatgtgggtgaatcacgtgttgcagtagaaccggcgagcgggaggggggtaatttatgttgtattgtaattgtgttttttattaccttgtaatgatattttagggagaatcccaagattcatattcgcaaaaaaaaaaaaaaaaaaaaacaacccctntcgctgttaccactgct

SEQ ID NO: 706 - DNA, 1341 bp, Zea mays
  Predicted polypeptide sequence is orthologous to G427
  misc_feature (607)..(607): n is a, c, g, or t
gccgccgcccccgcgtcgcgccgaaccctagcggcttctcccccggcgtcggcggggagagggagaaggcggccattgcggcgcacccgctgtacgagcgccttttggaggcgcacgtcgcctgcctccgcgtcgccacccccgtcgaccagctccctcgcatcgacgcgcagatcgccgcgcgccccccgccactagccgccgccgccggggccgcggcagcgggagggccgtccggcggcgaggagctcgacctcttcatgacgcactatgtattgctcctttgctcattcaaggaacaactccagcagcatgtacgtgttcatgcaatggaagcagtgatgggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgtcgatatcagggnaagagatcatgcgcaagcgcagggctgggaaacttcctggagataccgcatctgtactgaaagcttggtggcaagctcattccaagtggccgtacccaactgaagacgacaaggccagactggtgcaggaaacggggttgcagctaaagcagatcaacaactggttcattaaccaacgcaaacggaactggcacagcaacccaacatcctcggctgaaaagaccaagaagaaaaggtgatgatggcccagagcaatcttgggaaaagctagagatgtccactatactttattatggcgaagtacattctccctcacttcgtaggcaagagggaaaagtatcttgggtgacttgagtggccacctaaggctttgtttgggtactctagcattgaccccaatccacatgtgttgaggtggattggggtgtaaattagtttaagttacacctcaatccacctcaatacaagtggattgaggtcaataccagagtacccaaactaagcctaatgtgcaagtttgacaacgtggttgggctggagttggtagtgacctcagcagtatagcattcgctaacgtgatgtgggtgaatcacgtgttgcagtagaaccggcgagcgggaggggggtaatttatgttgtattgtaattgtgttttttattaccttgtaatgatattttagggtgaatcccaagattcatattcgccaaaaaaaaaaaaaaagcgggcgcttggg

SEQ ID NO: 707 - DNA, 496 bp, Zea mays
  Predicted polypeptide sequence is orthologous to G427
gggagggccgtccggcggggaggagctcgacctcttcatgacgcactatgtattgctcctttgctcattcaaggagcagttgcagcagcatgtacgtgttcatgcaatggaagcagtgatgggttgctgggagcttgaacaatctttacaaagcctaacaggggcatctccgggtgaaggcactggaggaaccatgtctgacgatgaagataaccaggtggatagtgaagccaacatgttcgatggaaatgatggatcagacggtatgggctttggccccctgatactaacagagggtgaacggtccttagttgagcgtgtacggaaggagctgaagaacgagcttaagcagggttacaaggaaaagcttgtcgatatcagggaagagatcatgcgcaaacgcagggctgggaaacttcctggagataccgcatctgtactgaaagcttggtggcaagctcattccaagtggccgtacccaactgaagacgacaag

SEQ ID NO: 708 - protein, 202 aa, Oryza sativa
  Orthologous to G427
MDKYYEEDWTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTKVSHYETEGLFAFTGGRQGTASPRNRATAKADQQLVHQPKEKKLAQ

SEQ ID NO: 709 - protein, 143 aa, Oryza sativa
  Orthologous to G427
MSEDEDETAPMLEGPMDMGSDGHDLMGFGPLMPTDSERSLMERVRQELKIELKQGFKSRIEDVREEILRKRRAGKLPGDTTTILKQWWQQHSKWPYPTEDDKAKLVEETGLQLKQINNWFINQRKRNWHNNSQTSTLKSKRKR

SEQ ID NO: 710 - protein, 331 aa, Oryza sativa
  Orthologous to G427
MAFHYQDHALAMDAAAAAAETGGHHHPGFVGAGGVVGGGGGGGWEREKAAIAAHPLYERLLEAHVACLRVATPVDQLPRIDAQIAARPPPLAAATAAAAAAAAGGAPSGGEELDLFMTHYVLLLCSFKEQLQQHVRVHAMEAVMACWELEQTLQSLTVVTLTAGASPREGSGATMSDDEDNQVDSESNMFDGNDGSDGMGFGPLMLTEGERSLVERVRQELKHELKQGYREKLVDIREEILRKRRAGKLPGDTASTLKAWWQAHSKWPYPTEEDKARLVQETGLQLKQINNWFINQRKRNWHSNPASSSSDKSKRKRKRSNAGDGKAEQSW

SEQ ID NO: 711 - protein, 427 aa, Malus x domestica
  Orthologous to G427
MAYHNHLSQDLPLHHFTDQTHHQHQQYQSDQPDPNSKPPEPHHSFQPAPNWLNSALLRNFTNTDTNPTNSNNANNNGGGVSNFLNLHVTASDSAASQASNQWLSQSHRPILHRNHSDVNDDVTVAGDSMIAAALSHDSADLKPDSILNKNEGGGGDGGVMNWQNARHKAEILAHPLYEPLLSAHVACLRIATPVDQLPRIDAQLAQSQNVVAKYSALGNGMVGDDKELDQFMRNYVLLLCSFKEQLQQHVRVHAMEAVMACWEIEQSLQSLTGVSPGEGTSATMSDDEDDQVDSDANLFDEGMEGHDSMGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKR

SEQ ID NO: 712 - protein, 422 aa, nicotiana tabacum
  Orthologous to G427
MAYNPNHMSQEMDMHHFSDENSAVLRSILPEQLAQSSPDVKPLDHQQPPTWLNSAILRQESHYTGTGGRGVGENFLNLHSNSESSAAASQASNQWLSRSILRRNVSDVQTSNNSSAVIAAADLKNDDGNNNNDNGNNNAGGQLTDSEVVGGGGTDGILNWQNAGYKAEILAHPLFEQLLSAHVACLRIATPVDQLPRIDAQLAQSQQVVAKYSTLGQNIGDDKELDQFLTHYVLLLCPFKEQLQQHVRVHAMEAVMACWEIEQSLQSLTGVSPGEGTGATMSDDEDDQVDSEANLFDGSLDGHDGMAFGLPTESERSLMERVRQELKHDLKQGYKEKLVDIREEILRKRRAGKLPGDTTSVLKAWWQSHAKWPYPTEEDKAKLVQETGLQLKQINNWFINQRKRDWHSNASSSTTSKSKRKR

SEQ ID NO: 713 - protein, 426 aa, Lycopersicon esculentum
  Orthologous to G427
MEFQDHFSQEMVLHQQQQQQQQQQNAVLRSMLPESPHHDARKSPPTWLNTSLLRQQHSQFGNASSPSSAAAAAAVAGGNNFLHLQTSNSDSSNSNQWLSPTAAAGGGSNGGGSGHNDELSESMNFAKKMSQQHSGGGEENNNNNNNNNNNNNEEENSWEREKCKADILNHPLYDQLLSAHVSCLRIATPVDQLPRIDAQLAQSQNVVAKYSVLGQGQPPLDDKDLDQFMTHYVLLLSSFKEQLQQHVRVHAMEAVMACWELEQSLQSLTGVAPGEGTGATMSDDDDDQADSDTNFLDGGFDGPDSMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSSSQKSQTQECR

SEQ ID NO: 714 - DNA, 1045 bp, Glycine max
  Predicted polypeptide sequence is orthologous to G438
  misc_feature (103)..(103): n is a, c, g, or t
ctacctaagctcttttttcggctcgagctttgctgagggtgggcggctgtttaccttctggatttcgcatcattcctcttgaatctggaaaggaagcttccanccccaatcgcacccttgaccttgcatcttcccttgacgttggtcccagtggaaaccgagcttcatatgaatgtgctggaaattccagctgggggggatctgtgatgacaatagcatttgaatttgcatttgaaagccatatgcaagatcatgtagcagctatggcacgtcaatatgttcggagcattatatcatcggttcaaagggtaggattagcactttctccttctcatttgagttcacatgcagggcttaagtcaccattgggtactcctgaagcacaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttggagaaaatatttgatgatcatggacgaaaaattctcttttcagagtttccccagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtttgacatcttgttctgagtacacttgggcttattgtatccaagtgttagataaagttttactctaagactaaaaaaaaaaatgttggttggtgttttactgtatttgcactaaatacttggattgcactttaaatgactatttgtgttattattagcttatgtaacttgtttccttattcaacctccagctaatatttaatgcaatcttaagaagtgttgcccctttt

SEQ ID NO: 715 - DNA, 1129 bp, Oryza sativa
  Predicted polypeptide sequence is orthologous to G438
gtaaaagatggctgcagtgcatgcagcagtgtaaaaaaaaaaaaaaaaaaaaaaaaaaaaaaaaaaaaaaaaaaaaaaaaaaaaaaaaaagggggggggggcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctgtccggcatttagaccagtttgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcggtgcaaagacaagctgaaaggaggatcccacagacttctcgtctattccagtgcagagctgaagcaggtggatatcccttgaaagaagagcttcatcatgagtaagaggttgaccctcaaggcgaacaacttcaagaatctcctcattctcaactgtgtgagcaagtggaatgatgatttggctcccagaaaatctcatgggtcgcaacccaggaagtgaacatgcacttgttttcagagttgaagccaaatatgcatcaatattgtaatcggcccattcagatctatgctccctcagaaatcgaaccagtactgctggaggaacactctgcagtaacattgatgccttagcacatataatacctccgggggctccaaaggcgatgccagcattgctgttactcctaattttcttagttgagttgcaagcaatcactacatcttcaacaccgtctccgcccattatagaccacccat

SEQ ID NO: 716 - DNA, 1154 bp, Oryza sativa
  Predicted polypeptide sequence is orthologous to G438
gtggatcccccgggctgaggaatcggcacgaggctaaatttggtctgcatttcgaagaatctcgccaatgccaatgcagttttcgacgccctacaggatccgattttacattgctggaaggaacccaagtacccaaccgtcaggattgctccgatccccctacaactaaaaccacttggccactgccttgtacttgggtacttgatggaatgggagcgagattacatttacataagcgagaaatttcgcaaatactactagattctcaggtctagatctagtgcaaaacagtcttgaacaagcaaaaatgaatcttcacttcgcagtggatgtgggatggtcacacaaaggaccagttgacgaaacagaaggccaggcagtgaacattgctatcctcggcaagcactttccaagccacggcctgatcgaaagaaacatgccgacccattcctgacatgcacacgcctgatggcaggtagacatggccctgctccatcaatttgggaatgtttgagaacaatgcttcttttccaggctcatcaaagatcctgtccaatgtgaggtcctgtaaggcgacaagggaagtttctagcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctcccccgccccggggcccctctgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcagtgcagagctg

SEQ ID NO: 717 - DNA, 666 bp, Oryza sativa
  Predicted polypeptide sequence is orthologous to G438
gcacgagggttggtattgtggccatttcacatggttgccgtggtgttgctgcccgtgcctgtggttgggtgaacctagaaccaacaaaagtggtagagatattgaaagatcgtccatcttggttccgtgattgtcgaaacctggaagtctttacaatgattccagcaggaaatggaggaacggttgaacttgtctacacacagttgtatgctccggcaactttagttcctgcacgagatttttggacgttacggtacacaaccacaatggaagatggcagtcttgtggtctgtgagagatctttaagtggttcagggggcggtccaagtgctgcctctgctcagcaatatgtgagagcggaaatgcttccaagtggatacctggttcgcccatgtgaacgtgggggatcaattgtgcacatagtggaccatctggatcttgaggcatggagtgttcctgaggtgcttcggccactctatgaatcttccagggtagtcgctcagaaaatgactactgcggcactccggcacatcagacaaattgctcaagaaacaagtggggaagtggtgtatgccttggggaggcaaccagcagtgctacggacttttagtcaaaggctgagcagaggctttaacgatgccattagtggtttcaatgatgatgggt

SEQ ID NO: 718 - DNA, 712 bp, Oryza sativa
  Predicted polypeptide sequence is orthologous to G438
tgcaggaatcggcacgaggctagtgcgcccatgcgagggtggtggctccatcgtgcatattgtggaccatctggatcttgaggcttggagtgttccagaagtgcttcggccactctacgagtcatctagggtagttgctcagaaaatgactactgcagcactacggcacatcagacaaattgctcaagagacaagcggggaggttgtatacgctttggggaggcaacctgctgttttgcggacatttagtcagaggttgagtagaggcttcaatgatgctataagtggtttcaatgatgatggttggtctgtcatgggtggggatggcattgaagatgtgatcattgcttgcaatgcaaagaaggttaggaatactagcacttcggccaatgcttttgtaactccaggaggtgttatatgtgctaaggcatccatgctactgcagagttgtcccacctgcagctttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggagattttagaagttgtccctcttgaaagacaaagtggtcacacatgattgatgtacttaagtgttaagatattgaccct

SEQ ID NO: 719 - DNA, 348 bp, Zea mays
  Predicted polypeptide sequence is orthologous to G438
ggttttcttgaaagatcgtccatcttggtttcgtgattgtcggagtcttgaagtctatacagtgttaccagctggaaatggcggaaccattgaacttgtttacatgcagatgtatgctcctactactttagttcctgcacgtgacttttggacactgagatacacatccactatggaggacggctgtcttgtggtctgtgagagatccttaagtggttcaggagatggacaaagtgctgccacaacacaacaatttgtaagagctgagatgctttctagaggctatttaattcgccaatgtgagggtgggggctcgattgtgcgaatagtggaccatctggatcttga

SEQ ID NO: 720 - protein, 880 aa, Physcomitrella patens; identical to SEQ ID NO: 669
  Orthologous to G438

SEQ ID NO: 721 - protein, 840 aa, Oryza sativa
  Orthologous to G438
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 722 - DNA, 1195 bp, Glycine max
  Predicted polypeptide sequence is orthologous to G450
gagattccccattattattattatgacagaatctctaacacgtgggatcatatccaccgccggatgtcccttcaacccaccacactcccaacatatatcaccaaaaccttattcccaattctaaaagaacacacctgagtgagtcccgacatcaacttataataattcctaatcagtgacaagtgttatggaggcagagccagacaagtacaagatgatcaactttgaagaaaccgagttgcgactcggcctgccactcagtggaaacgagacgacgctcaaaaacacttgcagtactgggaagagggttttttcggatactagcgtggatttgaagcttaacctttcctcaacctcaaataacgcccctcctcctggcaaagccacccgcaaaggcacaagtggtggggtggccaccagtgaggtcattcagaaagaacattgtaaacaacgttcaaaggagtaacaacaacgatggcgaaaaagccgccacaagtagtagcaacaatgtgaacatgggagcagctttcgtgaaggtgagcatggatggtgctccctatttacgcaaggtggatttgaagatgtacaagagccaccaagagctgttggatgcactggctaaaatgtgcagttcattcaccatcgacaagtgtagttcccaaggcatgacagacttcatgaacgagggcaaattgattgatcttctcaacggctctgattacgtaccaacctgtgaagacaaagatggtgattggatgctcgtgggtgacgtaccttgggaaatactcgtggaatcatgcaagcgcctgcgtataatgaaaggatctgcggcaatcgggctagcaccaagagcagtgcaaaagtgcaagaacagaagctagaggcaaatttgtaagttccagtttcgaccacaatctcctcgatctgttgctcttgggcgtccatgggaagcattaatgctaatataggagccaagttatataatatgtcggtaccattttttggaaataattttcttgtatatggattgtgtattatatatatatatgagaaaatagttggaaattagggacaagaaataatggagtatgtttatatgaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaa

SEQ ID NO: 723 - DNA, 1220 bp, Glycine max
  Predicted polypeptide sequence is orthologous to G450
tacggctgcgagaagacgacagaaggggacacctctttctccttctccccagttctcaaaccttacctagtattttcgtttctgaacccaattaattaagcacacaaggaccataacatacctatacctcaatatcacaagtcttatggaggcagagcgagacaagtacaagatgatcaactttgaagaaaccgagttacgactcggcctcccactcagtggaaacgagacgctcaaaaccacttgcagcactgggaagagggtttttttcggatactgccgtggatttgaagcttaacctttcctcaacctcaaacagtgcttcttctgacctgactaaagagaagaacatcactgctgctgcacctcctgctaacgacccagcaaagccacctgcaaaggcacaagtggtggggtggccaccagtgaggtctttcagaaagaacattgttcaaaggagtaacaacaatgagggcgaaaaagccgccacaagtagtagcaacaatgtgaacacgggagcagctttcgtgaaggtgagcatggatggtgctccttatttacgcaaggtggatttgaagttgtacaagagctaccaagagttgttggatgcgctggctaaaatgttcagttcattcaccattgacaagtgtggatcccaaggcatgaaagacttcatgaacgagagcaaattgattgatcttctcaacggctctgattacgtaccaacctatgaagacaaagatgctgactggatgctcgttggtgacgtaccgtgggaaatgttcgtggaatcatgcaagcgcctgcgtataatgaaaggatctgaggcaatcgggctagcaccaagagcagtggaaaagtgcaagaacagaagctagagtcaaatttgtaaattccactttcgacaacaatctgctctatctgttgctcttgggcgtccacggaaagcattaatgctaatttctcgagcaaggggtagtctaatataggagccaagttgttacataatgtgtcggtaccatttcttagaaataattttcttgtatatgtattgtgtattttatatatgtgagaaaatatataatttggaaattagggacaagaaataatgaagtatgttttatatatgtgagcccgtttttgtttctaagtacaaaacgttacgttgtctatcgttggtgtgcttgtctaataagaataatgtctacgtttatagctgt

SEQ ID NO: 724 - DNA, 1192 bp, Glycine max
  Predicted polypeptide sequence is orthologous to G450
tttctcgcgtccgcggacgcgggccaaacaaaccaagcagtattataatagaaagaggacacaaagtgaaagagaagggagctatagccataaggagaaaaactttcaaagaggtgaaagcaaaagagttcttcttttccttttttatatatacttgggtgctaagctgtgtgagttcattgacaagcctgaaatggcaactatgctgacaaaggagcatggtctgaacctcaaggagaccgagctttgcctcggtttgcctggtgggggaggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgaggtcatacaggaagaacatgatggcagtacaaaaggttagcactgaggatgtggcagagaagacaacaagcagcactgctaattctggggcatttgtcaaggtttccatggatggagcaccttacctgcgcaaggtggacctcacaatgtacaaaagctacaaagagttatctgatgccttggccaaaatgttcagctccttcaccatgggtaactatggggcccaaggaatgatagacttcatgaatgagagcaagttgatggatcttcttaacagctctgagtatgtgccaagctatgaagataaggatggtgactggatgctcgtgggtgatgtcccatgggagatgtttgttgagtcatgcaagcgtctgcgaataatgaagggatcagaagcgattgggcttgcgccaagagcaatggaaaaatgcaaaagcagaagctgaagcgggcctaatacaatgttcaatgaaatcccgtaccaaagtggacctatatatatatatatatatatgaagcacttcagcgagactatggagcggagtgttgttagcttgaatgtgtctggtgttttttgttttgttcgtatatagattcaacttttaattttaaggagccgatcgatgggccgcgtgtaggggccaagagccgcgcgccttaacctatatagtctggcttgtttaaaaaaaaaaaaaaaaaaaaaaaagggcggccgc

SEQ ID NO: 725 - DNA, 1127 bp, Glycine max
  Predicted polypeptide sequence is orthologous to G450
ccacgcgtccagccaaacaaaccaagcaacattataatagaaagaggacacaagagaaagaagggggagctatagccataaggagaaaaactttcaaagaagtgaaagcaaaaaagagttgttcttttcctttctgctgataagctgtgtgagtgagttcattgacaagcctgaaatgacaactatgctgacaaatgagcatggtctgagtttgaacctcaaggagactgagctttgcctcggtttgcctggcgggggctctgaagtggaaactccaagggccactgggaagagagggttctctgagaccgttgatctgaagcttaatcttcagaccaaggaagatctgaatgagaatctgaagaatgtctcaaaggagaagactctccttaaagatcctgctaagccgccggctaaggctcaagtggttggttggccaccagtgagatcatacaggaagaacatgatggcagtacagaaggttagcaatgaggaagtagctgagaagacaacaagcagcactattgctaattctggggcgtttgtcaaggtttccatggatggagcaccttaccttcgcaaggtggacctcacaatgtacaaaagctacaaagacttatctgatgccttggccaaaatgttcagctccttcaccatgggtaactatggggcccaaggaatgatagacttcatgaatgagagcaagttgatggatcttcttaacagctctgagtatgtgccaacctatgaagataaggatggtgactggatgctcgtgggtgatgtcccatgggagatgtttgttgggtcatgcaagcgcctgcgaataatgaagggatcagaagcgattggccttgcgccaagagcaatggaaaaatgcaaaagcagaagctgaagctggcctaatacaatgttctatgagagatcccgtaccaaagtggacctataaaagaaattatatgaagcacttcagcgagactatggagcggagtgttgttggtttgaatgtgtctggtgtttggcgttttgttcgtatatagattgtgcagcgtttaactacggtgccttaacctatacggtctggcgtgtttaggatgtgatcgtccaggctgtccggatggtatttg

SEQ ID NO: 726 - DNA, 1801 bp, Glycine max
  Predicted polypeptide sequence is orthologous to G450
gaaaggttgaagaattatttagaatgataaaagccatgaaaacagtgagttacttaccctcttgtgtgtgaaatgacgaaaccctaggagaaggagagtaataaagaaagaaatatgtggtgtaagcaagcaacatggagtgtccacttccgcttcttccactgaacaatcataggaagatagcatcaccttgtcgtcagcaagggcagcatgcacagaaaagtccagctcacacattcctccacgtgtcacaaacccatttccctctaaaaagacaggacgcaccatgcgtccttgtattatacgtccccttgtcctgcccctgcccctataccatagaacattagtacccccacacacaccccgcctcgagctttcacttcggctcgagcacaaatcaattaactgaatgcttagagagagaaagaggagaaggagtagtgataaggtgatcatagagcatattataagagagtgaaaactaatggaggttggcctcaagaaggagaacatggggtttgaggaaactgagttaaggcttggactgcctggaaacggaggcactgaagaagtgctcatcaggaagaggggtttctctgagactgaaactggtcatgaagatgagtctgccaccactgtggatttgatgcttaatctttcttctaaggaggccgcaaccactgctgctgctgctgcagatccaactgataagcacaagactttgcctaaggagaagacccttctgccagcagatcctgctaagcctccagccaagacgcaggtggtgggttggccacctgtgcggtccttccggaagaacatgttagctgtgcaaaagagcgtcggagaagagaacgagaagaacagcagcagccctaatgcaagctttgtcaaagttagcatggatggagcaccttaccttcgcaaagtggacttgaagatgtacaagagttaccgagagctctctgattctttaggcaaaatgttcagctccttcaccattggcaattgtgaatcccaaggaatgaaggatttcatgaatgagagcaagctgaatgatcttttgaacagctctgattatgtcccaacctatgaggacaaggatggtgactggatgcttgtcggtgatgtcccatgggagatgtttgttgaatcatgcaagcgtttacgcatcatgaaaggaaaggaggccattggtcttggtcttgcaccaagagccatggcaaaatccaagaacaggagctagactagtcgcacaattcatgacctgccccatcctttgtaattgcggtgcccagttggcttagttactaaagtaaggataattaagctgcagcagacacggatggacattgctaaggggttgaattatagttaatttgtgtcattatggtttgttataatatttcatcaaacaaaacaatgagatgcatgtctaattaagtactaatcatgaacaggaacataatgactctcaatcatgttgttagacttggctttcttatatatcgatctttgcttgttttgtgtgagtgcttcttaatacgagtataattttaagatgtgtttgtctgttgtagttgtagcgacatgttatcatgctttacatttaaaattgtcttgtaaaggttttccttatcattatgagattccttggtattaatcatttttcatataataacaaaattgtatttattacatttacgttagtttttgttgtgatcatcaagagccgaatatatagtactggaaatgttccctgaacatggtggatgggaaacaagaacatgtgcgtgttcat

SEQ ID NO: 727 - DNA, 1302 bp, Glycine max
  Predicted polypeptide sequence is orthologous to G450
gagaagacgacagaaggggtccccacaacgctcgaacgtgcctgcccctatacctcaccccacttactattattattgtacaacacaaccaggtccctgaatgctttttagagagagaaagagtaataataataaagtggaagaaaaagaattaggagagtgaaacaagaagaagaagaagaagaagaagaagaagaagaattgagaagatggtgtttgaggaaactgagctgaggctgggactgggactatgtctccctggaaatggaaccacggcaacaactgaagctgctgctgcggaattaggagtgaggaagagagggttctctgagactgaaactgatgaaacagccaccgttgatttgatgcttaacctctcacccaaggaagctgctgctgctgatggtgcagatccacgtgagaagccaaagacttcgccgaaggagaagacccttctgcttcccgatcccgccaagcctcctgccaaggcgcaagtggtgggatggccacccgtgaggtctttccggaagaacatgttcgcagcccaaaagagcagcggcggagaggaaagcgaaaagagcagccctaatgcaagctttgtcaaagttagcatggatggagcaccttacctccgcaaagttgacttgaagatgtacaagagttacccagagctctctgatgccttgggcaaaatgtttagctccttcaccattggaaattgtgaatcccaaggcttcaaggatttcatgaatgagagcaagttgatggatcttttgaacagctccgactatgtcccgacctatgaagacagggatggcgactggatgcttgtcggtgatgtgccatgggagatgtttgttgaatcatgcaagcgtttacgtatcatgaaaggaaaggaagctattggactggcaccaagagccgtggagaaatgcaagaacaggagctagactagtagttaccagtccaaaatctgctccatcatcattagcggtgcctagttgacttagtaactgaagcaaggttaagctgcagcagacacagagggagagagcagggtgttaaaaaatatagttaagtaaatctgtgtatcattatggtttgttatataatatatatttcaaacaaagttgtgagatgtcgtaagtataaattatgaacacaaacgataatgactctaaattatgttgcaagactttcttatttctttacttgtgtgcttgcataataataagtttattaatatgcttgtcaaaaaaaaaaaaaaaaaagcggccggttttttttttttttttaaaaaca

SEQ ID NO: 728 - DNA, 1224 bp, Glycine max
  Predicted polypeptide sequence is orthologous to G450
attgcggcgacgtgagcggttcgctgcccgcgacgttgtgagaagtccactgaaccttatcatttagaagaaggagaacatggggtttgaggaaactgagttaaggcttggactgcctggaaacggaggcactgaagaagtgctcatcaggaagaggggtttctctgagactgaaactggtcatgaagatgagtctgccaccactgtggatttgatgcttaatctttcttctaaggaggccgcaaccactgctgctgctgctgcagatccaactgataagcacaagactttgcctaaggagaagacccttctgccagcagatcctgctaagcctccagccaagacgcaggtggtgggttggccacctgtgcggtccttccggaagaacatgttggctgtgcaaaagagcgttggagaagagagcgagaagaacagcagccctaatgcaagctttgtcaaagttagcatggatggagcaccttaccttcgcaaagtggacttgaagatgtacaagagttaccgagagctctctgattctttaggcaaaatgttcagctccttcacctttggcaattgtgaatcccaaggaatgaaggatttcatgaatgagagcaagctgaatgatctcttgaacagctctgattatgtcccaacctatgaggacaaggatggtgactggatgcttgtcggtgatgtcccatgggagatgtttgttgaatcatgcaagcgtttacgcatcatgaaaggaaaggaggctattggtcttggtcttgcaccaagagccatggcaaaatgcaagaacaggagctagactagtcgcacaattcatgacctgccccatcctttgtaattgtggtgcccagttggcttagtaactaaagtaaggataagctgcagcagacacggatggacattgcagggtgttgaattatagttaatttgtgtatcattatggtttgttataatatttcaaacaaaacaatgagatgcatgtctaattaagtactaattatgaacaggaacataatgactctcaatcatgttgttagacttggctttcttataaaaccttgcctggtccgggggggggcctgctttattattattataagatgtgtttgtctgttgtctacagagccaagttcgacgacgagaacttttgaagaatcacacttgtccaaggggcgtgtgaatcggaaaaaaaaaaaaaaaagggggggccgc

SEQ ID NO: 729 - DNA, 1237 bp, Glycine max
  Predicted polypeptide sequence is orthologous to G450
tccaccacctcctcctccaaagaagaaaccatactactatcactccccaccacctcctcaccctatacctcacccccacccactattattattgtactacaacacaatcaagtccctgaatgctttttagagagagaaagagtcataataaagtgaaagaaaaagaaaaaggagagtagtgaaacaagaagaaaggagaagaagatggtgtttgaggaaactgagctgaggcttggactgagactaggactccctggaaatggagccgcgccaacaactgaagctgctgcggaattaggagtgaggaagagagggttctctgaaactgaaaccgatgaaacaacctccgttgatttgatgcttaacctctctcccaaggaagcttctgctgctgctactactgatggagcagatccacgtgagaatccaaagacttcgccgaaggagaagaatcttcctcttctcgatcccgcaaagcctcctgccaaggcgcaagtggtgggatggccacctgtaaggtctttccggaagaacatgtttgcagcccaaaagagcagcggcggagaggaaagcgagaagaacagccctaatgcaagctttgtcaaagttagcatggatggagcaccttacctccgcaaagttgacttgaagatgtacaagagttaccctgagctctctgatgccttgggcaaaatgttcagctccttccccattggcaattgtgaatcccaaggcttcaaggatttcatgaatgagagcaagctgatggatcttctgaacagctccgactatgtcccgacctatgaggacagggatggcgactggatgcttgtcggtgatgtcccatgggagatgtttgttgaatcatgcaagcgtttacgcatcatgaaaggaaaggaggcctttggtctgggttttgccccaagagccggggcaaaatccaagaacaggagctagactagtcgcccaattcatgacctgccccatcctttgtaattgcggtgcccagttggcttagtttctaaagtaaggataattaagctgcagcagacccggatggacattgctaagtggttgaattaaagttaatttgggtcattaaggtttgttataatatttcatcaaacaaaacaatgagatgcatgtttaattaagtactaatcatgaacaggaacataatgactttcaaaaaaaaaaaaaaaaaaaaaaaaaagaaaagagaagagaagaggaaagg

SEQ ID NO: 730 - DNA, 1019 bp, Glycine max
  Predicted polypeptide sequence is orthologous to G450
  misc_feature (773)..(773): n is a, c, g, or t
  misc_feature (775)..(775): n is a, c, g, or t
  misc_feature (806)..(807): n is a, c, g, or t
  misc_feature (811)..(813): n is a, c, g, or t
  misc_feature (815)..(821): n is a, c, g, or t
  misc_feature (823)..(829): n is a, c, g, or t
  misc_feature (831)..(832): n is a, c, g, or t
  misc_feature (834)..(836): n is a, c, g, or t
  misc_feature (862)..(862): n is a, c, g, or t
ggcgtttgaggcatctgttctttcgctcgcactgcctgaaaacctaggacgcactgtctctgacaacacgctgactaggaacagaggtgcccatactactgaaactgatactgaagaggatgagactgctaccgctgtggatttgatgcttaagctttcttctaatagaactgatgttgatcgaaatgcaactgataatcacaatactttgcctaaagagaagacactcatgcctgcatatcctgctaagcctccaaccaaggcacaagacgtatgatggccacctgtgcagtccttccagaagaacatgttaactgtacaaaagagcgtgagtgcatagaacgagaagaacagcgtcatccctaatgcaagctttatcaaaactagcatggatggatcaccttacctccgctaagtggtcttgaagatgtacaagagttaccgagagctctctgattctttaggcaaaatgttcagctccttcaccataggcaattgtgaatcccaaggaatcaaggatttcatgaatgagagcaagctgatggatcttttgaacagctccgactatgtcccgacctatgaggacagggatggcgactggatgcttgtcggtgatgtcccatgggagatgtttggtgaatcatgcaagcgtttacgtatcatgaaaggaaaggaagctattggactggcaccaagagccgtggagaaatgcaagaacaggagctagactagtagttaccagtccaaaatctgctccatcatcatgagagganantatttaaattattatttttttaatttttaanntttnnnannnnnnnannnnnnnannannntgttaaaaaatatagttaagtaaatntgtgtatcattatggtttgttatataatatatatttcaaacaaagttgtgagatgtcgtaagtataaattatgaacacaaacgataatgactctaaattatgttgcaagactttcttatttctttacttgtgtgcttgcataataataagtttattt

SEQ ID NO: 731 - DNA, 1346 bp, Oryza sativa
  Predicted polypeptide sequence is orthologous to G450
actagtggatcccccgggctgcgggctagtctctttttttttttttttttttttggtggacaatacatttgcaagcttcattgaacatttatgtagcgaacaaacagttcattgacaacattttgcaaagtaggtaggggtgctcaatcatagcagtagcacatggtgtccaaaccatttacacgaatagcattaacacacgtacaaagacttgggcacaatcaaatagagtttatgtccctaggagatttggcgaagctaacataacaagacacctttttttttaactttcacaatagcaaaccatgtagtacagaccataaggcagactccatcttaaaactgttagacttcttggttttcagaaaattccctacagtcatttgatctccatcttgcttttgactgtggggcagaaaccattctagttgcggtttttggacttatcaactgcccttggagcaagtccaattgcatctgaacctttcatgatcctgagtctgcgacaagagttggcaaacatctcccatggaacatcgccaacaagcatccagtctccatccttgtcttcataagtcagcacatattcaccatccttgcggctctcagataagccatccttgccagttgtgaagccaatgaacatcttctcaagcgcagttgacaggtccttgtagttcttgtaggtcttgaggtccaccttcctgaggtagggggcaccatccatgctgaccttgacgtacaggaacccctggccctgcttcgcttcagcatcctccttgctgctcttcagctggttagtagccatcgtgttcttgcggtagctgcgaattggtggccatccaaccacctgagccttggcagcaggcgcctgcggcgcggcggcgaccttcttgtcctcctcctccgcatcctcatcctcctcgccggccgccgccttcttgcccttcccggcggcggcggcggcggcggcggacgccggcagcggacgcgcctcgtcggagaacccgcgcttggcgcccttggcagcggggagaaggtcgagcgtggcggcgggcggggagcggtccggcgagtgggagccgggcaggccgaggcggagctcggtgcccttcaggtcgttgtcggcggcggcatcggcggcggcgggcaccggcggcgagaggcctatgtagtcgagctcgagtgggggcgacatggggagcagcaggacatgaaccggagagagagtgggggagtgggtgtgggtgtgtgttgtgtccagcgagccacagcgagacaagagaagagagtgtgtgtgtgtgtgtggacccgccgctgaggtggtgaagctgcttcttcttctt

SEQ ID NO: 732 - DNA, 1327 bp, Oryza sativa
  Predicted polypeptide sequence is orthologous to G450
ctctcctctcctcttctcttccctctctctatatatatactcagctccaagctgttcttggctcctccctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgagggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagatgtttgtcgagtcatgcaaacgcttgaggatcatgaagggttccgaagccattggtcttgcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggtaaaaaataaattaacatgtttgttaaaaaaaagcaaaaaaaattttgtaaaaaaaaaaaaaaaaaaaactcgagactagttctctctctcc

SEQ ID NO: 733 - DNA, 1318 bp, Zea mays
  Predicted polypeptide sequence is orthologous to G450
attgggtacctcgaggccttgggtacctcgaggccggccgggcggcctctctgccttttccttttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctccaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatacaatctttaatcgtgttttgttgagctttattatatggttttgtttgagagttcatggctctgcatcctgttcctacgggatgctggtcagcttttccctaaaaaaaaaaaaaaaaaaaaaaaaaaaaaaaaaaaaaaaaaaaaaaaaaaaaaaaaaaaaaaaaaaag

SEQ ID NO: 734 - DNA, 1080 bp, Zea mays
  Predicted polypeptide sequence is orthologous to G450
gatttattgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtcccggtcgttccggaagaacatcatgtccgtgcagtccgacaagggcgccggcaaagacgccgccgccgccaacggcgacaagtcctcggcggcggcaggcgggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagtgagcactgcatgcatgcgcttcttcctgcactatactccttattatattattgcctaatcggaaaataataataatttccatttcattttcaggatgttcgtcgaatcatgcaagcgccttcggatcatgaaaggatcagaagccattggcctggcgccaagggccat

SEQ ID NO: 735 - DNA, 1598 bp, Zea mays
  Predicted polypeptide sequence is orthologous to G450
caacccttgtgacgttattgccccctcttcccttcccaacccaacccattgcatttgcaagcccttttacattgcagagcgccagagcctcgctcgctctcggaacagagctaggcagctaacagacgaagaagaagcaagccaagcagcaagcgaagcgagagagaggcgaggacgtggcgacgacggcagccgcgatggcgacaacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaggaccacggcgttgctgttgcccttgagaaggaggaggaggccgggaagatgaagcggtccccgagccagagcagcgtcgccgccgccgccgccgccgtgcgtggctgaccccgccgagaagccgcgcgccgccaaggctcaggtggtggggatggccaccggtcccggtcgttccggaagaacatcatgtccgtgcagtccgacaaggggcgccggcaaagacgccgccgccgccaacggcgacaagtcctcggcggcggcaggcgggcggtgcccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaaggggcccatggagaaatgcaagaacagaagctgaggagaagacggacggacggaaggcttgcatctcagcaccacccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagccttgtcagtgaaagagtcagtcagtgtccatcaagtctcatcttgtcctatacagaagcacagaagccatgcatgaacatgtacctgtcctataacaatgtctttttttgctacctgttttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaaagttgtattgtaatatgatcacctctcttccttgttgttttcattgtctttggtattagctgttccatggaacaggattatatatataagctcagtgatg

SEQ ID NO: 736 - protein, 193 aa, Oryza sativa
  Orthologous to G450
MSTSSGADSSPPVSGLDYDDTALTLALPGSSSSSSSTADPERKRAAHADHADAKPPSPKARAVGWPPVRAYRRNALREDSARAKLVKVAVDGAPYLRKVDLAAHAGYAPLLRALHGMFASCLAVRGGGGGDGEGTKLVDLVTGAEYVPTYEDKDGDWMLVGDVPWKMFVESCKRIRLMKSSEAVNLSPRRSSR

SEQ ID NO: 737 - protein, 219 aa, Oryza sativa
  Orthologous to G450
MAGLGFDETELRLGLPGAGELAARSSGKRGFAETIDLKLKLQPAAPAAVSGEEGAQEDKEDADAAAAAADEKMSMKRSASQSSVVTAEPDPDKPRAPKAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWDTKGSGEMQELKLIKEN

SEQ ID NO: 738 - protein, 207 aa, Oryza sativa
  Orthologous to G450
MSVETERSSTESSAASGLDFEDTALTLRLPGSLAAAAAPDPDRKRSSPSSSDAADAADNSSPLAAAADAPPAPKARVVGWPPVRSFRKNALAAKFVKVAVDGAPYLRKVDLEAYSGYDQLLRALQDKFFSHFTIPIDGRKVAGKFADDERKLVDAVNGTEYVPTYEDKDGDWMLVGDVPWKMFVETCQRLRLMKSSEAVNLAPRAAQ

SEQ ID NO: 739 - protein, 236 aa, Oryza sativa
  Orthologous to G450
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQMFVESCKRLRIMKGSEAIGLAPRAKDKYKNKS

SEQ ID NO: 740 - DNA, 1320 bp, Oryza sativa
  Predicted polypeptide sequence is orthologous to G464
ctccttgcccccctctcgaggcccaggtgttcgtccgtgtcctcttctccactccacacacgcacacgcacaagccaagcagcaagcagcggcgccgatgagaggaggagtagctgggcccaccgccggcgagccgccggggacggaggcggaggcggaggaggtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcggcgggggggaagagggctgagggccccaccgccaccacctcgcctgggacggttgcttccggccatccacacagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggtggatctcaatgcgcaccgctcatacaagacccttgcattagcccttgaactcatgttcacgaagccgtccattggcctttgcgcttctcataatacaaagtcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctgagagcgtgtgacaaggaaaagagctataccgctggtgaagcttggagcgtgcttgatggttaattacttgtccagttaaaatagcagaaggctagtaagaaagagccacagggctcacccggttctgttatatttttgcctttgtggtgcctgtttttgtttgcactgtcgatctgcaagagcatatggtcgccttgctctgcttgcatgtacaagtatgtctttctagtagtttttatggtgtttgatgatgatccttgtgcctacctgattactactgactcttgcacagcctcacaaatctctatgaattagccctggagtttcattgattaatccacctccaaaattcctaatatgtgtgatggactagttctctcc

SEQ ID NO: 741 - DNA, 1475 bp, Zea mays
  Predicted polypeptide sequence is orthologous to G464
ccttttttttttccttttttttttttttgaaacagcagagcagatacttctgccatatcaaacacaaggataaaaaccaacactttgggcgaccattcctcacaggtaaacagcgtggacagaagagctgggggcgatgatgctcgtatagcccataagaaaagctcaacgagggcaccacagggaagaagcaaaaaaaaaaacttctactatttccactagacacaatgaagttgcctaagtttagtcgttcgaattgaagaactaaacttagacataaaagttagccatgttgtggcgccttagacagtaaaccaaacagccccgtaatctcacaactatgccagcgatatgggctgctgttactgttacgtgatatcaaatacagttcaagcttcaccagcggtgttagcaccaaacgcacatcggtggtttcacgtcctgcctctcgtgcaagctgctgtgggtctgtgagacccttggaatcgtggaccgagacctttggcgtctgaggttctcatgatcttgagcctcttcactgaacctacaaacatctcccagggaacatctccaacaagcatccagtccccgtccctgtcctcataggtgagctgatactccgatgagctgtctaatagctttagagtctttgaactgctagaagtgcaaagaccaatggacggcttcatgaacatgagctcaagtgctgaggcaagggtcttgtaagagcgatgggcattgagatcgaccttccttccaatgatatctccttccatgttcaccttcacccaaccgacggtccggcctttcttgctctcctccttgtcttcctgcatgtcaggttcgacgatgggcttcttggcgccagcctccgatgcattctctttggcctggttaaataggctgttcatcctgaaagttcttatgggtggccatcccaccactccaaagctctgtgggtggccagacgcgaccgtccctggcgagttgggcgccgcatccgccttggccctcttgcttggcgccgcggtacctgcacctgccgcgggggaggaagaggacacggaggaatccggtgacagggacctcggctgcaggtcccgggccgtgaggatccggcacggcggcggatgctgctgctgctgttgcttggagccgaggcagagccccagctccagctcgtcgtcgtcctgctccaccaccgtctcctcgtcctcctcctcggcgccggagttctcctccacctcttccgcgtcggctggaggcggctcgtcggacatgaacgccgcagtgggccccgctcctcctcctctcatcgcggcgctgctctctgccttcctgttctgcgactgtgctgtgcgttctgggagagacacctcgagggagaggaaaggaggtgtcgctattatctgagcacagcagacagagagagagggaggagctctccggcccggccggcctcgaggtacccaatg

SEQ ID NO: 742 - protein, 281 aa, Oryza sativa
  Orthologous to G464
MRGGVAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWESAIPGNSQNHCFNKRQILRACDKEKSYTAGEAWSVLDG

SEQ ID NO: 743 - DNA, 1434 bp, Glycine max
  Predicted polypeptide sequence is orthologous to G470
  misc_feature (718)..(718): n is a, c, g, or t
ccctctcccccacacaacacaccacaaccttcttcttcttcttcttcaacttctggttcaaaacctcaacagtttgttgaattgcgcgttgaaatacgactcaatattctttcgcgagctctgttctcacttcaaaggttaggttcttcgacagtttctttgtttccactccgtcgcttgctgagaaggcgtgagcgagagttgtagaattacgcaacgagtgtcgcggatgagagatctgtggtgaggtctctggaaatgacatcattggaggtgacgatgaagggaaattgcttgaaccacaacgacggcggagccacggagcctcattccccgtccacggccaaagacgcagaagctgcacttttcagggagctatggcatgcttgtgcaggtcctctagtcacggctccgcgagaaagagagcgcgtgttttatgttccctcagggacatactgagcaggtggaggcgtcggcgaaccagggggcgggcccagcacttgccgggtttacgatctcccacccaagatcctttgtcgggtcatcaacgtgcagctgaaggccgagcccgacacggatgaggtgtttgctcaggtgactttgcttccggagccaaacgtgagtttcctctcctcgttagtgtgtgttttttagagagagacagagtaattgggtgaaaaagtggtgatgcttatgatttttttttaatgtgggtggnggatgatgatatagcaagatgagaatgccgtggagaaagagccaccaccacctccgccaccacggtttcatgttcattctttctgtaagactctgacggcgtccgatacgagtacccatggtgggttttctgtgctgagacgacatgctgatgaatgtcttcctcctctggatatgtcgaagcagccacccacactggaattggtggctaaggatcttcatgcaaatgaatggcgatttaaacatatcttccgaggtcaaccccgtagacacttgcttcagagtggttggagtgttttggccagctccaaaaggcttgtcgctggggatgcatttatatttcttagaggtgagaatggggaacttcgtgttggtgtccgacgagcaatgagacagcagggtaatgttccatcctcagttatctccagccacagcatgcatctcggtgtccttgcaactgcttggcatgccatctcgaccgggaccatcttcactgtttattacaagcccaggaccagtcctgctgaatttattgttccgtatgatcaatatatggagtctctcaaaaataattatagcatcgggatgcgggtcaaaatgaggtttgaaggtgaagaggctccagagcagaggtatgggcaaatgatcctgcagtgctttattattattaaatgttcgattctagtgggaaatatcccttgattggcttgtaaaata

SEQ ID NO: 744 - DNA, 887 bp, Oryza sativa
  Predicted polypeptide sequence is orthologous to G470
gggggatgtgaagatctggtggggtgatggcgacggcggaggtcggcggcggcggcggtgagggggatgctgctgccgcggcggtggcgcgagcaggcggcggcggcggcggaggaggaggaggaggggaggacgcgctgttcacggagctgtggagcgcgtgcgcggggccgctggtgacggtgccgagggttggggagaaggtgttctacttcccgcaggggcacatcgagcaggtggaggcctcgaccaaccaggtaggcgagcagcggatgcagttgtacaatctcccatggaagatcctgtgtgaggttatgaacgttgagctgaaggccgagccagacaccgacgaggtttatgctcagctcactctgcttcctgaattgaagcaacaagaagataacggctctactgaggaggaggtgccttctgctccagcagctgggcatgttaggccacgggtgcactcattctgcaagacattgaccgcctcggacacgagcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacaggaaccatgttcactgtc

SEQ ID NO: 745 - DNA, 560 bp, Oryza sativa
  Predicted polypeptide sequence is orthologous to G470
  misc_feature (78)..(78): n is a, c, g, or t
tagtggatccccgggctgcaggaatcggcagagggttggtctgttgtgtagcaacaagaagataacggctctactganggaggaggtgccttctgctccagcagctgggcatgttaggccacgggtgcactcattctgcaagacattgaccgcctcggacacgagcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacagggaccatgttcactgtctactacaagc

SEQ ID NO: 746 - DNA, 1131 bp, Glycine max
  Predicted polypeptide sequence is orthologous to G481, G482
attcggctcgagataatccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcgcaataatgtatgaaaaaggctcgagcttctttttaaaaaaaaaaaaaaaggaacaaaaaaaaaaaaggggggg

SEQ ID NO: 747 - DNA, 993 bp, Glycine max
  Predicted polypeptide sequence is orthologous to G481, G482
attcggctcgggaggaacgtgaaagtaaaacggacggtggcgatagaagcgtctctcatctccatcgtctcctcactcctctcttctccagcgttcattttttctcgcgcccaaatacaaaatcacatcacaacagggttccggcgaccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttagccccaggctcaacatatgatagttccgatgcaaggccaagagtagatattgatcctctccttcagtgtttgacatgtgtgatctaaatgccagtggaacttttatgtcaatatgtgcccttggtatattgaatgcattttatgttatgtaaacactacatgcggggatgttggttcttgtgaccagatattatttattaagacttacatttatctttggaaaagaatcattattcataagttatattgtaaattctggaacaatgcttgtctgattccatcaatcgtcctggtaacgattttatgtacctgattggaagcataaattggtatattctttcccttcgttgtctgtt

SEQ ID NO: 748 - DNA, 1000 bp, Glycine max
  Predicted polypeptide sequence is orthologous to G481, G482
taataaggttgtatatggtttggtgggatggctcgagagtctttagaaaagatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagcaccagcaccagggacacgtgtatggatctggatcagcatcttctgcaagaactagataacatgtgtcatctgtttaagcttaattgattttattatgaggatgatatgatataagatttatattcgtatatgtttggttttagaaatacaccagctccagcttgtaattgcttgaaacttccttgttgagagaatatagacattattgtggatggtgatgtggcatatgtggcatacacagaatttttgtattcttctttctctctatggatttttgtgtaagggcaggactatggctttgtttgctgatcgtatagctagtatggtgctatctaggttcggatttttttctttttcatgtataatgaaaaattaacggaggaaattactcttacgttactttgaaattaattaactaaatcccgcttctgcctttttttttttctcctttctgag

SEQ ID NO: 749 - DNA, 620 bp, Glycine max
  Predicted polypeptide sequence is orthologous to G481, G482
  misc_feature (560)..(560): n is a, c, g, or t
tgaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttntatattatattatttaattaaactctcttctccactcaacctttgcaagatcactgggtt

SEQ ID NO: 750 - DNA, 1872 bp, Glycine max
  Predicted polypeptide sequence is orthologous to G481, G482
aacataaataataaaatatttctttgaacatttcttaaaaagtatgaacataaatttaaattattattttatatttaatgtatttacattaatttatttgtcttacatacacttgtaatgttctccttatatttattaaactataatatagtatatataaagaaaagattttgagaatttgaataaaataagagtgtccaagtcagaggcgagcacgtgccagataccaaagcaacggtccagatcatggagcactcaccaaatccaagggctcctatttgtccgtgcaaactcacacttatcgcccaacaacggtccacaaagcgccacgtgttctcaagataaagcgttattaacccttctgatccaacggatcctgctcattacctcccaaacaagcccttccgttccgtttcacctttcctcttcccgccggagccgccgtcacccgccgccggcaatcgtatcagaccctcccaatacaccgtctccgacttccacgcagaattgcacgattcattgatttcaattttcaagtcttgaggatttcgtttcaacagcgcttcaatttgacgcagaaaaactgagtcaaaccaattctcccagagttcgtgacttggattctcaatttatcgttcattccgaatagaatttgaaactccgaagaaaactgcaccgaacactgaatctcagttaccgaggagcttcttctacgaaccgtgcttaattccacacagaaacaccgagtcaaactggttcgtgctgtgttcgtggttcagattctcaatcgaaatttgaaattcagaagaaaaccgcaccgaacacagaatttcagaatctgaacaagtttcttccgttaacagcacttcaacttcacgtggaacaagaatcaaaccgtttcgtggttcggattctcaattcctcgtccattcgcaatcgattttcaaattccgaagaaaaccgctccgaacactgaatttcagactctgaacagcgaacagtacttcaagttcacgtggaacgagtcaaagcgattccaatcaatttcgcgaactcctccacggtgaactccgatattttcctgcactgacttagtgattcgtttcatatttctcagcttcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagaccgtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttattattattattattattcttattcgtaagttaaaagaaatgtgagattcaaagtggtgattaagtgaattagtaacaaaaaagtgcgactcagttgattaaaaatatatataaattattataagtcttttaatatgtttttgattctcacacat

SEQ ID NO: 751 - DNA, 521 bp, Glycine max
  Predicted polypeptide sequence is orthologous to G481, G482
agactttagctttacacaacatattattgtaaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctggggttcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatc

SEQ ID NO: 752 - DNA, 1156 bp, Glycine max
  Predicted polypeptide sequence is orthologous to G481, G482
gaagttaggtaaaaatagtggaaatgagtatcttctttgttccatgtcttgcattgtctgcttagatttgtttttgtaaatcgattccaccaatcatcgctgtccttgtcgcgccaaatacaaaaaccaccacttctacctctctccttctgactctctcactctcaccgggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatcttatttatttccctttaatgcttgtacgcatggcatgggtggaaacaattgtctggtgatttaatatttaggttctcgtgtagaagggtgtcagaattttgttacggtactaatgtagatttttattaatacatgtcttatttagctttgtaatacctactcaagggagagatgtgtttagggttatgctagtgattcgccatgtagcttgtcagggtgagaagcacttgcttttagagttttctttagattattatataatatataatatttgcagacactgcatttgttagtttatttagtttaggccatacagtttgcttctctcttaatgatgtaaaaaatattcacttgtcattcatctagaaaattcgtaatagtgtaatagaatctttaaagacttgctaaaaaaaaaaaaaaaaagggcggccgcc

SEQ ID NO: 753 - DNA, 939 bp, Glycine max
  Predicted polypeptide sequence is orthologous to G481, G482
  misc_feature (596)..(596): n is a, c, g, or t
  misc_feature (762)..(762): n is a, c, g, or t
  misc_feature (767)..(767): n is a, c, g, or t
  misc_feature (769)..(769): n is a, c, g, or t
  misc_feature (775)..(775): n is a, c, g, or t
  misc_feature (786)..(786): n is a, c, g, or t
taatatagtgcggctcgagctctgctttctgtgttattgtctggcttttggagccgatccaaccaatcatcgctggcgccaaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcaggtgcaaccacaacantctggttatgccttcaatgcaaggccatgaatagtttagatgcttctacgcatcttatttatttcccttgaatgcttgtacgcatggcatgggtggaaccaattgtctggtaaaaaaatgggggggctctcgtccccccgggtgggggggttttgtttcggtactngtgtngntttttnttaaaacacgncttgtagcgggtgtttctcttctcaagggagagatgtgtttagggttatgctagtgattcgaaatgtagcttgtcagggtgagaagcacttgcttttagagttttctttagattattatataagagagaatatttgcagacaaaaagacttac

SEQ ID NO: 754 - DNA, 715 bp, Glycine max
  Predicted polypeptide sequence is orthologous to G481
ttccggctcgaccccgcgtccgaatttttctcctcttctgtaaacttggtccatccatgtcaatgttttttggatctcagtcaccaccgttccctttccatcgccaattaatccccccctcaatttttacttccctctcatctgccatacatacacgtctctataagcatctccccgcgaggggggccttgcctcgattgttttctttatcgaatatatatatatatatatatatatatatatatatatatatatttgcattgtaatttgtagggtttgtgagatgtcggatgcgccaccgagcccgactcatgagagtgggggcgagcagagcccgcgcggttcgtcgtccggcgcgaggcagcaggaccgggacctcccgattgccaacatcagccgcattatgaagaaggctctgcctcccaacggcgggattgcggaggatgccagagacaccgtgcaggaatgcgtttctgagttcatcagcttcattaccagcgaggcgagtgagaaatgccagaaggagaagagatagacaatcaatggagacgatttgctatgggccatggccactttatgatttgaatactacatagagccgcttaaagtgtacctggctaggtacagagaggcggagggtgacactaaacgatctgttagaagcggtgatggatctgctacatctgatcatgtgcgtgttgcaggtgcaaacgct

SEQ ID NO: 755 - DNA, 738 bp, Glycine max
  Predicted polypeptide sequence is orthologous to G481
  misc_feature (298)..(299): n is a, c, g, or t
  misc_feature (302)..(302): n is a, c, g, or t
  misc_feature (316)..(316): n is a, c, g, or t
  misc_feature (340)..(340): n is a, c, g, or t
ttcggctcgtgggacgtgaagtaaaaggtcggtggctatagaagcgttttttcatcttcttcgtttcctcactcctctctttttcagcgttcattttttctcgcgcccatattcaaaatcacatcacaacatggttccttgttactctatgttctattgctctctgttagtccattgctgtggcggtgtgttgtgcagctcattatagcggttagcacagtccccgctccaattttcttctagcatgatccttttcctttcccattgtcaacatctgccgcatcaggaagaaagcgcnnccncccaacgggaaaancgccaaggacgccaaggaaaccgngcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaaaggtggagatgcatctgctaagagagatgtttatcagagtcctaatggccaggttgctcatcaaggttctttctcacaaggtgttaattatacgaattcttagccccaggctcaacatatgatagttccgatgcaaggccaagagtagatattgatcctctccttcagggtttgacatgtgtgatctaaatgccagg

SEQ ID NO: 756 - DNA, 1231 bp, Oryza sativa
  Predicted polypeptide sequence is orthologous to G481
ttttttttttttttttttttttttttttgggaatcagagtaaaattgctaccattacagagagcatctatttctcaatagtacaacacgctagttcaggacgaaatacaacatgaatatttatgcctcccaatacagattatatggaaccgaatgacagccaaagaccaattgttaaattatcctgaatatacatacaacaacagagctagaccacgaaccgaaactatcctcacggggagtaatttacatctgagaagcagccttggctcgacgcttccaagcagcatcagttcctggttgacaaacatgggacctagaggtggtagcaagttacttccttcactgctcaccatgaggtgtaggtatatatattagctaacgactgcagcaccaaataaaatccacctagcaacagttgcatgaaaaggtcctatcttcagtttgagacatccccattatggtactgaggttgcatataacccattccttgattgtatgctgcttgttggcccatcccttgggcacttgaactgcttcctccatgagaaccaagtacatcctttttcacagagccatcaccagcctttgcagttaatttactatcaccctccatctctctgtacttctgcaggtagaccttgaggggctcgatgtagtcctcgaagcccagcgtggccatcgcccacagcaagtcgtcgccgttgatggtcttgcgcttctccctctggcatttatcgctcgcctcgctggtgatgaaggagatgaactcggagacgcactcctgcacggtctccttggcgtccttggcgatcttcccgttggccgggatggccttcttcatgatgcggctgatgttggcgatggggaggaacctgtcctgccggacgagtgggccccccccacccccacctccccctcctccccctccccccctcgggctcccgctctcgtggctcccccctcctccccccgggctccccggcccatccgccatcccacctcccccctccttatatagaagcgcgggcgcgcgcggagagggcgcgacgtggagaggagagagaggggggttgggcgcgaggtggtgaagcgaggaggagagagagagagagagagagagagagagggggggggagaggagagagagaggaagcgggggtgggaagcggagcggaggtgaggcggagaggcgagagggggagatcggacgctggagaagagaagcggcc

SEQ ID NO: 757 - DNA, 693 bp, Oryza sativa
  Predicted polypeptide sequence is orthologous to G481, G482
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 758 - DNA, 420 bp, Zea mays
  Predicted polypeptide sequence is orthologous to G481
ctcccgcccccttctctcccctcctcgcctccccgcgcgcgcgtttttataagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggc

SEQ ID NO: 759 - DNA, 523 bp, Zea mays
  Predicted polypeptide sequence is orthologous to G481, G482
cccagcgtccgaggaaggctacgggcaccagggccacctgttgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccactcaagtcctacctcaaccgctaccgcgaggccgagggcgagaaggccgccgtgctaggcggcggcgcgcgccacggcgacggcggcggcgcggcggacgacgccggcccactcgccggg

SEQ ID NO: 760 - DNA, 1199 bp, Zea mays
  Predicted polypeptide sequence is orthologous to G481, G482
cccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattatgccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaaaaaaaaaaaaaaaaaaaaaaag

SEQ ID NO: 761 - DNA, 564 bp, Zea mays
  Predicted polypeptide sequence is orthologous to G481, G482
gccttctcttctccagcgtccgatctctcccactcgccttcctcaccgcagctctcccggctcggtcgcttcgccacctccgtcctccccccgcgctcggtcgctcgccacctgctctcccctccctccacgttgctcgcgcccgcgcttatataagtgcacgaggaggagctcatggcggacgctccggcgagccctgggggcggaggcgggagccccacgcagagcgggagcccccagggccggcggaggtggaggcggtggcagccgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagt

SEQ ID NO: 762 - DNA, 1053 bp, Zea mays
  Predicted polypeptide sequence is orthologous to G481, G482
cattgggtacctcgaggccggccggcatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctggaacaggattcatgcttagctttccctcctgtctgaatgtgatggttgcctgaatcctaatttgcc

SEQ ID NO: 763 - DNA, 1178 bp, Zea mays
  Predicted polypeptide sequence is orthologous to G481, G482
gtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcaacaaggaacatacaaccaaggaatgggttatatgcaaccccagtaccataacggagatatctcgaactaatgaagacatggaccttttctgcgacagctgctcttccctgaggcgattttttggtctcagttatttactaagtaagacaccttgcggtgaccattaaagagtaaccaatcaccctcggtaggtccgtttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaggaggaaaaaaaaagggcggccgc

SEQ ID NO: 764 - DNA, 2109 bp, Zea mays
  Predicted polypeptide sequence is orthologous to G481, G482
ccacgcgtccgcccacgcgtccgggcttgctgagctggagctgatggatctagggtttgggttgcggtgatggtcctgcagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacagaagtacagagaggtgcgtacggtgtttgggaatttgggggtcaggtcgtgcaatcgccaatctgtcacctggccgatcgtacctctgattgaacttaaataatcctgttgggcatcagcacgctaataagtgataagtgagctatccacttcccttccaatgcttcggccacatatttatacttctttagttgaggacataaagagaccccctgttcctgtgtactactccagtaaatacagctagtaaacacattatttttataaggtgaaccaattcgaaagcacttttatccatttaatactgaacagtgatcgaaacctctatttgatgttcttacatgggattgagttagcactcgtgcttggtaagatattataactactcacagccctatgtggctgtgtctgttctatgatgaaaagtagatgtaatgcaaatggataagagcggaaagagctcctacagtagtgtaattagagcatgttgtagtgcaagcttttggttgtttacacaaaagatacatgaaaccattccactgtaggtcatatacaatcttgcttagggtcctgaacatatctggtgcacatggttcacatattaaattatcaccatccattctagatctaacgtctttagttgtccattctagatctaacatctttagttgctctgtataattgtatattttgcaaagaaccccttccaccactactctctaccacttctaccctgctccgagggtgttctctgcaaaaatatatagaacacccatagatgttagatataggatgaatgatggtgatctaatatgtacaccatgtgcaccaaactcagtgcaccagatatattctcgagtttatttagctgtatttttctatacgctcttcgtattggttgaataatctgtctaatgaggtttctcttttggtcttatgtctggtggatgacatcacggattgcagatggagggtgatagcaagttaactgctaaatctagcgatggctcgattaaaaaggatgctcttggtcatgtgggagcaagtagctcagctgcagaagggatgggccaacagggagcatacaaccaaggaatgggttatatgcaacctcagtaccataacggggatatctcaaactaatgaaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattatatgtatttgtatcgggaggcataaatattgtgtaatttgtgttaaagactagtgtaattgaactatgggaagagctgctttggttgtaaccatattttgatgcccgtatattaggcaaaaacagaaggctgtgggcgtgcacaacatatttactgttcaccgaaatacttgtattgatgtatttccgcatcaattatagtcatcgtcagcttgtaactacggcaatgaataaataaaaattcactgagtaaaaaaaaaaaaaaag

SEQ ID NO: 765 - DNA, 1255 bp, Zea mays
  Predicted polypeptide sequence is orthologous to G481, G482
aattcggcacgaggcaccctcccgggccgcccgcgcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatgaaggcatggaccttttctgcgacagctgctcttccccgaggcgggtttttgtgtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatcagaagagctgctttagttgtaagatcacacaaaacagcctggaaagtataacaagattaaaactgaaccaaaaatgggcaataaataaattatcacatttacagtgaataaaaaaatccctgaacatggggcgttcattctaaagaatccaaatttacttgcactgcctggcaacttttttactcttttatgctgaaccctaagtttaat

SEQ ID NO: 766 - DNA, 1173 bp, Zea mays
  Predicted polypeptide sequence is orthologous to G481, G482
cattgggtacctcgaggccggccgggattccccatctcccttcattgctcgctcgctcgctcgttgctcttctccagcagcagctccttcaaatgcaaatctctttgctgccgacgcagagactcgccaaatttccctccctcctcctagccttctcgtcgctcctgttcttctcgcatccccagcccaggtggtgtcccctgtcgcgttgatgcatgctccctcggcggtggccttgagctgaggcggcggagcgatgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattattgctgcctgtatgtaaatcaaaatctgaggctcccatttcgaaaaaaaaaaaaaaaaaagcggccggtgaactactcttcccgtttcgtttcatacgagaatcgaactcgttttcaattaaaaa

SEQ ID NO: 767 - DNA, 1064 bp, Zea mays
  Predicted polypeptide sequence is orthologous to G481, G482
ctcagtctcaaactccccgctctcccccgcccgtccagctcgtgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggctcggctcccgccgccggcttcttgcttggtgtcggtaattagcgctggtggcctgcgctggttaagttaaccttcggtttttcccccttttcttttcgtggtaagtaatgttgtgctgaatggagacagtgatatggttaagatagctccataacctctcggtaattaatcctgtgatttgtactcccaagctgctgctaaactgagctatgacacaatacaaatgctgccattaac

SEQ ID NO: 768 - DNA, 686 bp, Gossypium arboreum
  Predicted polypeptide sequence is orthologous to G481, G482
cttcaacgacaaagagaaaagggtctctctcaaattttcattttttttctatcattcctttcttctccatcgtcagatctctctttcattccttgcaccaaataaaacaaataatttaaccaatcaaatcctctcgcgccaaataagagagaaatcccattttttttcttctctatttcctttcccttcagttgtgatttaggttttctggggacatggcggatggtatgggaggagggccaacgagtccggcaggagggagccatgagagtggaggagagcacagcagtcctcagtcaactgtgagggaacaagatcgttacctcccaattgctaatataagtagaatcatgaagaaagcattgccttctaatgggaaaattgctaaggatgctaaagatactgttcaagaatgtgtttccgagttcatcagcttcatcactagcgaggctagtgataaatgtcaaaaagagaaaaggaagacaattaatggagatgacttgttgtgggcaatggcaacattaggattcgaagactatatcgagccacttaaaatataccttgccagatacagggagttggagggtgacaccaagggatcagcccgtggtggtgatggatcttttaaaagagacgcagccggagctcttcctgcccaaaatccacaggtttcagtccaggggtca

SEQ ID NO: 769 - DNA, 542 bp, Glycine max
  Predicted polypeptide sequence is orthologous to G481, G482
aatagtggagtatcttctctgctttctgtgttattgtctggcttttggagccgatccaaccaatcatcgctggcgccaaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctaga

SEQ ID NO: 770 - DNA, 616 bp, Gossypium hirsutum
  Predicted polypeptide sequence is orthologous to G481, G482
gaaaaaatctctctcaaattttcatttttttttctatcattcctttcttctccatcgtcagatctctctttcattccttgcaccaaataaaacaaataatttaaccaatcaaatcccctcgcgccaaataagagagaaatcccttttttcttcttctctatttcctttcccttcagttgtgatttaggttttctggggacatggcggatggtatgggaggagggccaacgagtccggcaggagggagccatgagagtggaggagagcacagcagtcctcagtcaactgtgagggaacaagatcgttacctcccaattgctaatataagtagaatcatgaagaaagcattgccttctaatgggaaaattgctaaggatgctaaagataccgttcaagaatgtgtttccgagttcatcagcttcctcactagcgaggctagtgataaatgtcaaaaagagaaaaggaagacgattaatggagatgacttgttgtgggcaatggcaacattaggattcgaagaatatatcgagccacttaaaatataccttgccaaatacaggtagttggagggtgacaccaatggatcagcccgtggtggtgatggatctttttaaat

SEQ ID NO: 771 - DNA, 520 bp, Lycopersicon esculentum
  Predicted polypeptide sequence is orthologous to G481, G482
ttttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgca

SEQ ID NO: 772 - DNA, 501 bp, Lycopersicon esculentum
  Predicted polypeptide sequence is orthologous to G481, G482
cttaaagcttgtgtactatcataggcgaatacaagactgcgtatacatcaatgtcttcggactttactcgtataattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttgcttcccatagcaaatgtaagcagaatcatgaagaaagctttaccagctaacgcgaaaatctcaaaagatgctgaggaggtagatcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgca

SEQ ID NO: 773 - DNA, 512 bp, Medicago truncatula
  Predicted polypeptide sequence is orthologous to G481, G482
gtggtgataggtctcattctgtaatctcaatcgtcctcctccttcctttcttctccagcgtccgattctctctccattcttaccgatctacgctcgcgccaaatacaaacataatattcagggttccgacgatatgtccgaaactccggcgagtcctggcggcggcagccacgaaagcggcgaacacagtcctcgttccaacatccgtgaacaagaccgtttccttcctatcgccaacatcagccgcatcatgaaaaaagctcttcctgctaatggtaaaatcgctaaagatgctaaggaaaccgttcaggaatgcgtctccgagttcatcagcttcatcaccagcgaggcctctgataagtgtcagagagagaagaggaagacgattaacggtgatgatttgctttgggcgatggctactttagggtttgaggattatattgatcctcttaagatttaccttacaagatacagagagatggagggtgatactaaaggctctgccaaaggtg

SEQ ID NO: 774 - DNA, 611 bp, Lycopersicon esculentum
  Predicted polypeptide sequence is orthologous to G481, G482
ccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgacgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatgg

SEQ ID NO: 775 - DNA, 768 bp, Solanum tuberosum
  Predicted polypeptide sequence is orthologous to G481, G482
gggcagtcgctgccgttggatctatgtgtatagcgcagaaaagctcagcatccattttccgccaaattcctttctcaaacaaaaactaacaaaatattctcttggatcaacctctacctacgatcatccataaagttagggttccggtacactgagaatggcggagccggcaagtccaggaggcggcggcggaagccatgagagtggcggtgacccgagtcctcagtccaacttgcgagaacaggataggtacctaccgatcgctaatattggacgcataatgaaaaaggcattgcctgctaatggaaagatcgcaaaggattctaaggacactgttcaggaatgtgtatctgagttcatcagttttattactagcgaagctagtgacaagtgtcagaaagagaagagaaagacgatcaacggagatgatttactatcagccctggctaccttgggatttgaggactacattgaaccactgaaggtctatttgactcgatacagagagatggagggagatgccaagggatctgcaagggttggtgatgcatctgttagaaaagatgtagttggaagtcagcttgggtccaatacgcagttcatgtatgaaggttcttttgcacaaggcttagactatggaaactcccaattatgaattttaagatgaacaaagaactttggatgcataccaaaaaaaagctgaatacatagaacagtgggttagtctttttgctggtacaagatgccagccagggtttctcttcttgc

SEQ ID NO: 776 - DNA, 720 bp, Triticum aestivum
  Predicted polypeptide sequence is orthologous to G481, G482
  misc_feature (2)..(2): n is a, c, g, or t
  misc_feature (10)..(10): n is a, c, g, or t
  misc_feature (13)..(14): n is a, c, g, or t
  misc_feature (690)..(690): n is a, c, g, or t
cnccccccanaannagtttgattacccctgctcgaaattaaccctcactaaagggaacaaaagctggagctccaccgcggtggcggccgctctagaactagtggatcccccgggctgcaggaattcggcaccagccaccaccttccctccctccacgcgcccgtctatataaggaggagggccggatgtcggacgcgccggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggcgacgctgggcttcgaggagtacatcgagcccctcaaggtttatctgcagaagtacagagagacggagggtgatagtaagctagctggaaagtctggtgaagtctctgttaaaaaggatgcacttggtcctcatggaggagcaagtggcacaagtgcgcaagggatgggccaacaagtacatacaatccaagaatggnttatatgcaacctcagtaccataatggggg

SEQ ID NO: 777 - DNA, 837 bp, Hordeum vulgare
  Predicted polypeptide sequence is orthologous to G481, G482
cgcgcgcgcgcgcgttttttataagggtttcgcggcgccggatggccgacgacgacagcggcagcccccggggcggcggcggcggcggggtccgggagcaggaccgcttcctccccatcgccaacatcagccgcatcatgaagaaggccgtgccggccaacggcaagatcgccaaggacgccaaggagaccctccaggagtgcgtctccgagttcatctccttcgtcaccagcgaggccagcgacaagtgccagaaggagaagcgcaagaccatcaacggggacgatctgctctgggccatggccacgctcgggttcgaggagtacgtagaccccctcaagatctacctgcaaaagtacagagatatggagggtgatagtaaattgacctcaaaatctggtgatggatccgtgaagaaagatataattggtgctcatggtggtgcgactagctcaaacgcccaagtgatggttcagcatggtgcttacgcccaaggcatgggttatatgcaaccccagtaccataatggggatacctgaaactgaagactgcggcaattttcggaaatgggtattgctccatgagtggttatctatctgttaaagaagccgccccaacattaggttcatgatgatcattggctggaaactaaagcacctggaagggtgcttaacagttggttgtgatggctgcctccaagatgtaaattgcttccgagagaatagattcacctattatggtttagtgccttggttttatctggtacattcggaataaattcaacccgtggtaggttggcaaatactttggttttcaggatttttgtatttagggacg

SEQ ID NO: 778 - DNA, 638 bp, Triticum monococcum
  Predicted polypeptide sequence is orthologous to G481, G482
gcacccgcctgcgccgccttctcttctccgcgtcggatccccccccactcgccgccctcaccgcacctccattcccctccaccaccttccctccctccacgcgctcctctatataaggaggagggccggatgtcggacgcggcggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggccacgctgggcttcgaggagtacatcgagcccctcaaggtttatctgcagaagtacagagagacggagggtgatagtaagctagctgggaagtctggcgatgtttctgttaaaaaggatgcactgggtcctcatggaggagcaagtggcacaagtgcgcaagggatgggccaacaagtagcatacaatccaggaatggttta

SEQ ID NO: 779 - DNA, 1818 bp, Glycine max
  Predicted polypeptide sequence is orthologous to G482
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 780 - protein, 229 aa, Oryza sativa
  Orthologous to G481, G482
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPQPPHHHHHQMVMGGKGKVEEVQSKGKIRDFLQLQASMLELIQGEN

SEQ ID NO: 781 - protein, 241 aa, Oryza sativa
  Orthologous to G481, G482
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYREGDTKGSRASELPVKKDVVLNGDPGSSLVNYGAQRADANANHLDLFFLLRKNPESTTANCMREDEAKPVTVKIIETVYVEADTADDFKSVVQRLTGKDAVAGDAPELNSAQRFGSGREASRHGDHKVRIYE

SEQ ID NO: 782 - protein, 297 aa, Oryza sativa
  Orthologous to G481, G482
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 783 - protein, 137 aa, Oryza sativa
  Orthologous to G481, G482
MKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQDIFTGHVVRLV

SEQ ID NO: 784 - protein, 285 aa, Oryza sativa
  Orthologous to G481, G482
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCNKYEVSREQIWDTPQIMELSPWIPYTINRIWKETHGSQDIRIQGRPREAANSALDWQWPSKHSSLASNFYGTRVVGGHHEYQRSTKKDTTHVNFASGLGDLG

SEQ ID NO: 785 - protein, 178 aa, Zea mays
  Orthologous to G481, G482
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISN

SEQ ID NO: 786 - protein, 179 aa, Zea mays
  Orthologous to G481, G482
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISNV

SEQ ID NO: 787 - protein, 189 aa, Oryza sativa
  Orthologous to G481, G482
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCKYPSIE

SEQ ID NO: 788 - protein, 185 aa, Oryza sativa
  Orthologous to G481, G482
MQGLPRASSSSTSASRDRDGGDGDGGGGGVTMTNGQDNLLPIANVGRIMKDGLPPQAKISKRAKETIQECATEFISFVTGEASERCRRERRKTVNGDDVCHAMRSLGLDHYADAMHRYLQRYREGEELAASLNSSSSAAAAAAAAGSRGGGAIQIDVRAELSIFRSGNNQGKKGVNSLFVEVKLN

SEQ ID NO: 789 - protein, 177 aa, Oryza sativa
  Orthologous to G481, G482
MADHHGGHHADGHRRQQQLQGEAADQAAAEIIKEQDRLLPIANVGRIMKQILPPNAKISKEAKETMQECVSEFISFVTGEASDKCHKEKRKTVNGDDVCWAFGALGFDDYVDPMRRYLNKYRELEGDRAAAAATSRSGAGAAAGPDHPSSSSSAAAATAGHFMFNAMDRSTDSSRQF

SEQ ID NO: 790 - protein, 164 aa, Oryza sativa
  Orthologous to G481, G482
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 791 - protein, 215 aa, Oryza sativa
  Orthologous to G481, G482
MADGPGSPGGGGGSHESGSPRGGGGGGGGGGGGGGVREQDRFLPIANISRIMKKAIPANGKIAKDAKETVQECVSEFISFITSEASDKCQREKRKTINGDDLLWAMATLGFEDYIEPLKVYLQKYREVRGDSKLTAKAGDGSVKKDVLGSHGGSSSSAQGQAAYNQGMGYMQPQVIYLQLFGITGSMHIHMVDRCQSILLNIPSCLGSIQDNIVV

SEQ ID NO: 792 - protein, 185 aa, Oryza sativa
  Orthologous to G481, G482
  misc_feature (136)..(136): Xaa can be any naturally occurring amino acid
  misc_feature (154)..(154): Xaa can be any naturally occurring amino acid
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTXKAGDGSVKKDVLGSHGGXSSSAQGMGQQAAYNQGMGYMQPQYHNGDVSN

SEQ ID NO: 793 - protein, 124 aa, Oryza sativa
  Orthologous to G481, G482
MSEGFDGTENGGGGGGGGVGKEQDRFLPIANIGRIMRRAVPENGKIAKDSKESVQECVSEFISFITSESASDKCLKEKRKTINGDDLIWSMGTLGFEDYVEPLKLYLRLYREVLFLSSLFQSVS

SEQ ID NO: 794 - protein, 219 aa, Oryza sativa
  Orthologous to G481, G482
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 795 - protein, 254 aa, Oryza sativa
  Orthologous to G481, G482
MEAGYPGTAANGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRVQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 796 - protein, 224 aa, Oryza sativa
  Orthologous to G481, G482
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 797 - protein, 191 aa, Glycine max
  Orthologous to G481, G482
MARESLEKISMAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQHQHQGHVYGSGSASSARTR

SEQ ID NO: 798 - protein, 165 aa, Glycine max
  Orthologous to G481, G482
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 799 - protein, 170 aa, Glycine max
  Orthologous to G481, G482
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 800 - protein, 188 aa, Glycine max
  Orthologous to G481, G482
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 801 - protein, 171 aa, Glycine max
  Orthologous to G481, G482
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 802 - protein, 160 aa, Glycine max
  Orthologous to G481, G482
  misc_feature (151)..(151): Xaa can be any naturally occurring amino acid
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQVQPQXSGYAFNARP

SEQ ID NO: 803 - protein, 144 aa, Glycine max
  Orthologous to G481, G482
MSDAPPSPTHESGGEQSPRGSSSGARQQDRDLPIANISRIMKKALPPNGGIAEDARDTVQECVSEFISFITSEASEKCQKEKRKTINGDDLLWAMATLGFEYYIEPLKVYLARYREAEGDTKRSVRSGDGSATSDHVRVAGANA

SEQ ID NO: 804 - protein, 223 aa, Zea mays
  Orthologous to G481, G482
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 805 - protein, 212 aa, Zea mays
  Orthologous to G481, G482
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 806 - protein, 164 aa, Zea mays
  Orthologous to G481, G482
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 807 - protein, 174 aa, Zea mays
  Orthologous to G481, G482
PASEEGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGGGAADDAGPLAG

SEQ ID NO: 808 - DNA, 364 bp, Glycine max
  Predicted polypeptide sequence is orthologous to G484
  misc_feature (17)..(17): n is a, c, g, or t
  misc_feature (317)..(317): n is a, c, g, or t
  misc_feature (352)..(352): n is a, c, g, or t
gaagcccatagacatcnttggaaaagccaaagaagacgcttctcttcctaaagcaacaataacgaaaattattaaagaaatattacccccaaacatacatatcaccagagatacacaggatttattaatcaagtattatatcaaatttataaaccttatctcgtcagaatccaataaagtctataacaaagaagaaaaaagaacgattacaccgaagcacatatgaagaactgttaaaattctgaaatttagcgagtacattagagaaggggatacagcatatgaacaacacaaagtgaaaacaatgcaacattctntaaaagatgcagagaagaacaacagacctgagatnactgaagaagag

SEQ ID NO: 809 - DNA, 756 bp, Glycine max
  Predicted polypeptide sequence is orthologous to G484
  misc_feature (436)..(436): n is a, c, g, or t
  misc_feature (474)..(474): n is a, c, g, or t
  misc_feature (525)..(525): n is a, c, g, or t
  misc_feature (529)..(529): n is a, c, g, or t
  misc_feature (532)..(532): n is a, c, g, or t
  misc_feature (563)..(563): n is a, c, g, or t
  misc_feature (622)..(622): n is a, c, g, or t
  misc_feature (642)..(642): n is a, c, g, or t
  misc_feature (650)..(650): n is a, c, g, or t
  misc_feature (654)..(654): n is a, c, g, or t
  misc_feature (671)..(671): n is a, c, g, or t
  misc_feature (678)..(678): n is a, c, g, or t
  misc_feature (738)..(738): n is a, c, g, or t
  misc_feature (740)..(740): n is a, c, g, or t
acaactacgatcttcgatagtgctttctcagattcttccttcgtggtaaccggtcgaatcatggagcccatggacattgttggcaagtcaaaggaagacgcttcgcttcctaaagcaacaatgacaaaaattattaaagagatgttacccccagatgtacgtgttgcaagagatgcccaagatctattgattgagtgttgtgtagagtttataaaccttgtctcgtcagaatccaatgaagtttgtaacagagaggataaacggacaattgcacctgagcatgtattgaaggctctacaggttcttggatttggtgagtatgttgaagaagtttatgcagcatatgaacagcacaagctggagaccatgcaggactctttaaggggtggtggtaaatggagcaatggagctgagatgactgaggaagaagcattancagagcagcaaaggatgtttgcagaagcgcgtgctaangatgaacggtggagccattgctttcaagccagcccagatgctgaccaaagnttanatnagctaactttaggatcttcatttgaagcatngacaaaagcaccacccttgacttcctgcctgtgcttttccaatgaagcctccgatgggnggtacaaaaaaacccatttnacctaagntttncttggggcccaatggtnggaatgnggcctcaattttgggatttctttttccgaaaaaaaatcccattattttttttaaagtccnantgttaattttagtggg

SEQ ID NO: 810 - DNA, 1063 bp, Glycine max
  Predicted polypeptide sequence is orthologous to G484
ccacgcgtccgcccacgcgtccgcccacgcgtgaaccgtcatcataaattcatatatcatcagcctcagccatgtcttcttcgctcttgcacctcctcttccttccacaactacgatcttcgatagtgctttctcagattcttccttcgtggtaaccggtcgaatcatggagcccatggacattgttggcaagtcaaaggaagacgcttcgcttcctaaagcaacaatgacaaaaattattaaagagatgttacccccagatgtacgtgttgcaagagatgcccaagatctattgattgagtgttgtgtagagtttataaaccttgtctcgtcagaatccaatgaagtttgtaacagagaggataaacggacaattgcacctgagcatgtattgaaggctctacaggttcttggatttggtgagtatgttgaagaagtttatgcagcatatgaacagcacaagctggagaccatgcaggactctttaaggggtggtggtaaatggagcaatggagctgagatgactgaggaagaagcattagcagagcagcaaaggatgtttgcagaggcgcgtgctaggatgaacggtggagccattgcttccaagcagccagatgctgaccaaagtttagatagctaactttaggatcttcattgaagcatagacaaagcaccaccctgactcctgtctgtgcttccaatgagctcgatggtgtacaaaaaccattcactagtttgctggcccatgtggatgtgctcatttgtattctttcgataaatccatatttgtaagtcaatgtaattagtgagagatcatgaaaaccctcccgtttagcatttacttgtaattatttaatttacgtttttgtatcttctacatactaacaactcctagcttgattctgacagtagctactatgttagattgtaacaaattattaaatatgtagaagcaatagtgctctgtttatttgttaaaaaaataaaaacaaaatgggcagagcatggaaggaacatatattccacaaatgactatatgtatggactagttgaaagatatagg

SEQ ID NO: 811 - DNA, 708 bp, Glycine max
  Predicted polypeptide sequence is orthologous to G484
  misc_feature (582)..(582): n is a, c, g, or t
  misc_feature (598)..(598): n is a, c, g, or t
ccacgcgtccgctgcaacaacatgttcaccaccacctccttgttcttcacatcatcctcatcatcttcttcaatcagttgactcttcgttcctccctctattctttcggatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcagagtccaatgaagtctgtaacaaagaagaaagaaggacgattgcaccggagcacgtgttaaaggctttagggcaagattctttaaaaggtgcaaagtggagcaacagagctgagatgactgaggaagaagcattggctgaacagcaaaggatgtttgcagaggcacgtgcaagaatgaatggaggagccattcaatccaaggagccagaggctgaccaaagtttagagagctaactttataggacacttttattttcttttgaagcataggcaagcagcatctcttactcttccctatgcgttgntaatttagctcgattntgcacatacccccattcactagtttgctggcctacgtgaatgtactcgccatttgtgttcttttagtaatccatatttgtaaggttatgtaattattggagttcatctaa

SEQ ID NO: 812 - DNA, 1034 bp, Glycine max
  Predicted polypeptide sequence is orthologous to G484
  misc_feature (924)..(924): n is a, c, g, or t
cataaatatgcgtctctgcgacatgttcaccaccacctccttgttcacatcatcatcatcatcatcatcatcatcttcttcttcttcaatcagatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcggagtccaacgaagtctgtaacaaagaagaaagaaggacgattgcaccggagcacgtgctgaaggctttaggggttcttggatttggcgagtacattgaggaagtttatgcagcatatgaacaacacaagttggagacaatggtgattatgttaatgaccaatgtgcatgatatatattacaacttaacagcataattgtttttgtcttgtataatattcatccatcaattgtttattgggtgattagttttataagaatccatgaattttttgggagcatggcctgtgtggtttgaccgagccagtctgggctcccatataatttgttgagggacccattaaaatggtattctgtaggaaaaagcactggaaaggccctaatgggctgataacctgaccatggtcccctcttctgttttcattaagtgttttaaatatatgatgtctgagagctcagcctataacttttctggctggtgaaattgaaattaccaatgatttatgaatctccacttatgtgtatggtccattctatagttgttgagtatcccatttgtaaattactgagtgctctgtaattgtgatttgtgattcataatgtaaggtttggtcatgcaaagtgatataatctatttggctatatttagttgatgaatggcctgnatattttttcgtggtaaagttctatagttttaaatatgctgtttcaaagcacaatcatggtatatgaattgtgaatcattaaattactactatcatttatagatttgact

SEQ ID NO: 813 - DNA, 639 bp, Glycine max
  Predicted polypeptide sequence is orthologous to G484
gcacgagtctctctctttcttgttcttatccatcgcattgaaaagcagcaccatcaccaccccctcgtcttccccccttctttcataaatatgcgtctctgcgacatgttcaccaccacctccttgttcacatcatcatcatcttcttcttcttcaatcagttgactcttcgttcctccctctattcatctgatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcggagtccaacgaagtctgtaacaaagaagaaagaaggacgattgcaccggagcacgtgctgaaggctttaggggttcttggatttggcgagtacattgaggaagtttatgcagcatatgaacaacacaagttggagacaatgcaagactctttaaaaggtgccaagtggagcaacagagctgagatgactgaggaagaagcattggctgaacagcaaaggatgtttgcagaggcacgtgcaagaatgaatggaggagccattacttccaagcagccagac

SEQ ID NO: 814 - DNA, 997 bp, Glycine max
  Predicted polypeptide sequence is orthologous to G484
atcgcattgaaaagcagcaccatcaccaccccctcgtcttccttccttctttcataaatatgcgtctctgcgacatgttcaccaccacctccttgttcacatcatcatcatcatcatcatcatcatcttcttcttcttcaatcagttgactcttcgttcctccctctattcatctgatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcggagtccaacgaagtctgtaacaaagaagaaagaaggacgattgcaccggagcacgtgctgaaggctttaggggttcttggatttggcgagtacattgaggaagtttatgcagcatatgaacaacacaagttggagacaatgcaagactctttaaaaggtgccaagtggagcaacagagctgagatgactgaggaagaagcattggctgaacagcaaaggatgtttgcagaggcacgtgcaagaatgaatggaggagccattacttccaagcagccagacgctcaccaaagtttagagagctaactttaggacacctttattttcttttgaaggcataggcaagcacatctcttctcttactcttccctatgcgatgttaatttagctcgattttgcacaaatccccattcactagtttgctggcctatgtgaatgtgctcgccatttgtgttcttttagtaatccatatttgtaagttaatgtaattattggagttcttctaaatcctcgtctatttagaatacatgtatattatttcatttacctgttgtatcgcctacaccaactactattggcttaattttgacaatatagtggctatacaacgatcccttataatttgttatataaaaagtcctgaaggttttcccccc

SEQ ID NO: 815 - DNA, 1008 bp, Glycine max
  Predicted polypeptide sequence is orthologous to G484
attcggctcgaggcatgacggaagagctctctctctctcttgttcttatccatcgcattgaaaagcagcaccatcaccacccccacctcttaccccttctttcataaatatgcgtgctctgcaacaacatgttcaccaccacctccttgttcttcacatcatcctcatcatcttcttcaatcagttgactcttcgttcctccctctattctttcggatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcagagtccaatgaagtctgtaacaaagaagaaagaaggacgattgcaccggagcacgtgttaaagggctttaggggttcttggatttggcgagtacatcgaggaagtttatgcagcatatgaacaacacaagttggaaacaatgcaagattctttaaaaggtgcaaagtggagcaacagagctgagatgactgaggaagaagcattggctgaacagcaaaggatgtttgcagaggcacgtgcaagaatgaatggaggagccattcaatccaaggagccagaggctgaccaaagtttagagagctaactttataggacacttttattttcttttgaagcataggcaagcagcatctcttactcttccctatgcgttgttaatttagctcgattttgcacatacccccattcactagtttgctggcctacgtgaatgtactcgccatttgtgttcttttagtaatccatatttgtaagttaatgtaattattggagttcatctaaaccctcgtctatttagaattttacatgtagattatttcatttacctgttgtatctcccacaccaacaacagctattgccttgattttgacaatagttgctatattagaatgtaacaatctatt

SEQ ID NO: 816 - DNA, 372 bp, Glycine max
  Predicted polypeptide sequence is orthologous to G484
ggctcgaggcgcacaacatgtgaccaccaccccgcgggggggacaggagcctgagcagcctcacaatcaggggactcttcgttgctccctctactctttcgggtggagcccatggacatcgttgggaaggccaaggaagacgcttctcttcctaaagcgacaatgacaaaaattattaaagagatgttgccccggggggggcgtgtcgacagagatgcacaggatttatagaacgagtgatgtgtcgaggttataaaccttgactggtcagagggcaatgaagtctgtcgcaaagaagaaagacggacaattgctccagaacacctgttaaaggcttcacgggcactggaatttggcgagtacatcagggaa

SEQ ID NO: 817 - DNA, 505 bp, Glycine max
  Predicted polypeptide sequence is orthologous to G484
  misc_feature (141)..(141): n is a, c, g, or t
  misc_feature (159)..(159): n is a, c, g, or t
tacggctgcgagaagacgacagaagggggtgaaaccgtcatcataaattcatatatcatcagcctcagccatgtcttcttcgctcttgcacctcctcttccttccacaactacgatcttcgatagtgctttctcagcctcntccttcggggtaaccggncgaatcatggagcccatggacattgttggcaagtcaaaggaagacgcttcgcttcctaaagcaacaatgacaaaaattattaaagagatgttacccccagatgtacgtgttgcaagagatgcccaagatctattgattgagtgttgtgtagagtttataaaccttgtctcgtcagaatccaatgaagtttgtaacagagaggataaacggacaattgcacctgagcatgtattgaaggctctacaggttcttggatttggtgagtatgttgaagaagtttatgcagcatatgaacagcacaagctggagaccatggtaattatgaatattaatgccccatatgtat

SEQ ID NO: 818 - DNA, 914 bp, Oryza sativa
  Predicted polypeptide sequence is orthologous to G484
ccctcctttattccccgtctcctccgcgtgagctcgccggagcaccgccggccgatcccccccacccccgccacgcgagcagcgccgctcgcgcggcctgctgcccccgcctcaccctcgccggtgaacggcgcatgcccccccgacgttaggtgtcgcgcctggagacgcggagatggatccgatggatatcgtggggaagtccaaggaggacgtctccctccccaaatcaacaatgtttaagattataacgggggggtccccccccggcgggcgagtggcaagagatgcacaagatcttcttgtggaatgctgtgtagagttcatcaacctcctatcttctgaatccaatgaagtttgcagccgagaggacaagaaaactattgctcctgagcatgttcttagagctctgcaggatcttggctttagggagtacattgaagaggttcaagcggcctacgaacaccataagcatgataccctggattctccaaaagcaagcaaattcactggtgtggagatgacagaggaacaagctgtagctgagcaacagaggatgtttgctgaggcccgagcaaggatgaacaatggtgccgccaaaccgaaggagccagaacctgaagcgcagcaacaaacacaacagccaccacagcctcagctgcaccctcaaccacagcaacccctgcagcctcaacttcagctccatcctcaaccacaacaacagccctcacagctacatcctcaacagctgctgcatcctcaattcgcagcaaactccgcagcctcaacctcaggtccaccctcaaccacagcagcctgcacagctgcaaccgcaacctcagcttctccagcaaccgcagcttgcccaacagctgcagccgcaatctcagctcccccacaaccgaagcagcccc

SEQ ID NO: 819 - DNA, 504 bp, Zea mays
  Predicted polypeptide sequence is orthologous to G484
tggctccagccccagccccttctccgcaggccgtgccctccctccctagccgcgcctcggatccatcgatcccggcggtacgcgacgtcggcgccccagactcaagatccatcgcgcgctcgacggcgagggatggatccgatggacatcgtgggcaagtccaaggaggacgtctccctccccaaatcaacaatgaccaagattattaaggagatgctaccgcctgatgttcgagtagcaagagatacacaagatcttcttgttgaatgctgtgtagagttcatcaatcttctttcttcggaatccaatgacgtgtgcagccgggacgacaagaagactattgttttttgaacatgctattagggctctgccggatcttggcttcaaggagtaccgttgaagaagtttatgcagcctacgaacagcacaagtttgaaactctgggctctcccaaagcaacccaagtcactggtatagagatgactgaagaaaaatctgttgcgg

SEQ ID NO: 820 - DNA, 919 bp, Zea mays
  Predicted polypeptide sequence is orthologous to G484
ccggccgggatagctctactcctatatcttagtggtgacaatttccccgtgcggcagccagaaaactgcactcgaatccgagcagccacaattgtttttatgacaaagaaaaggacctcaataccactctgcccgagcaagccgaattgtcgcccgaattcgctcgcggggagcacttgctacctcgcgcccgccttctgtcgcgcggattcgttgccgcgcctggagatggacccgatggacatcgtcggcaagtccaaggaggacgtctccctccccaaatcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtggaatctcaagtgcagttgcattcgccaacacagcattccctccaacctcaagtgcagctgcacccccagccacaacagcttccacaagtgcaggtgcactctcagacgcagctgcaccctcagccacagcagccccaagtgcaggttcatccgcagctgcagcaactcccacattacaggc

SEQ ID NO: 821 - DNA, 1445 bp, Zea mays
  Predicted polypeptide sequence is orthologous to G484
attcggctcgagatttcactctgcccgagcaagccgaattgtcgtccgaattcgctcgcggggagcacttgctacctcgcgcccgccttctgtcgcgcggattcgttgctgcgcctggagatggacccgatggacatcgtcggcaagtccaaggaggacgtctccctccccaaatcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacagactcgagactctggttggtaccacttgttagtcacagggctgcgcatatcattcccttatctaatctgtgtactgtgcttgacaccaatatgtcttgagtaggattctccaaaagctggcaagttcactaggattgcgatgacagaggatgatgctgccgctgagcatcaaaggatgtttgctgtggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactacctccaacctcaactgcagctccactctcagccgcagctgcaacccctcagccgcagttgcccccacaattgcaggtccatcagcagctgcagcaacccccacaagtgcaggtccaccagcagcccgaagtgcagccccaagaagcgcagttgcaatcatcagcccagcaaacctcccaaccgcaacctcaggcacaactacaatcacaggggcactcacaagcgcagctgcaagccggactgctgggtcagttgcagacacaggcgcaaaccggacctgacatggatagttagagactattgtgtagcctgagtataagcaaaaaagggaaaaaaaaccaggcacttttgctgcatctactagaaacctgtatgcctgcttgtgactcattagatcctgatttaggtttccgtgcttcctgtagaatgtaaatgcagtgtgattgcagttgccttgttgctaataatgcgaagccgttagttactgatgatgtcattattgtgtggaatactgaattcgtgacaagtgtcatggcatggttttatgtgacgtgctgaaagatattccgttgccattgtaatagccgaacttcgacatttgtccatggtgatagcgactgatttgaatgagttcttgctgcaaaaaaaaaaaaaaaaaaaaaaaaaaaaaaaaaaaaaaaaaaaaagg

SEQ ID NO: 822 - DNA, 1391 bp, Zea mays
  Predicted polypeptide sequence is orthologous to G484
gtacccgccttaccgcgcgccctaaccctaggccctcaattccactctgcccgagcaagccgaattgtcgcccgaattcgctcgcggggagcacttgctacctcgcgcccgccttctgtcgcgcggattcgttgccgcgcctggagatggacccgatggacatcgtcggcaagtccaaggaggacgtctccctccccaaatagttgtttaaaatcttctactgctgattgaactttctgctttgcactttagcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtgcaatctcaagtgcagttgcattcgccaacacagcattccctccaacctcaagtgcagctgcacccccagccacaacagctcccacaagtgcaggtgcactctcagacgcagctgcaccctcagccacagcagccccaagtgcaggtccatccgcagctgcagcaactcccacaattacagggcccactcgcagccaccgcaaccccaagtgcaaatccacccacagccgcagcagcccccacaagtgcagttgcagtcatcagtccagcagacctcccaaccccaacctcaggtacatctctacaatcacagggggggctcacaagcgcagctgcagccccaactgccaggtcagctgcagacacaggggcaaaccggacctggcattgacagttagagactactgctggcatatactaggaacctgtatgcttgcttgtgactcgttagatcctgatttaggtttctgtgcttcctgtacaatgtaaatccagtgtgattgcagttgccttgttgctaataatgtgaaaccgttagttactgatgatgtccttactgtgtcgaatactgaatgtcatggcgtggcttatgtgccatgctgaatgatgttctgtggtcattgttatagcctaacttgacatctgtccatgatgatagtgattgatttgaatgagctcttggtgc

SEQ ID NO: 823 - DNA, 1424 bp, Zea mays
  Predicted polypeptide sequence is orthologous to G484
ccggccgggccgggccgtatatcaacccctcccctcgtattaggccccacctccccgcgcgccctaaccctagcttctcgattcaactctgcgcgagacgaattctctcccgaattcgctcgccgaaagcacctgctacctcgcgcccgccttccgtcgcgcggattcggtgccgtgcgtggagatggacccgatggacatcgtggggaagtctaaggaggacgtttccctccccaaatcaacaatggttaagataattaaggagatgcttcctcctgatgtacgagtggcaagagatgcacaggatcttcttgttgaatgctgcgtagagttcatcaatctcctttcgtctgaatccaatgaagtgtgcagcagagaagagaagaaaacaattgctcctgagcatgttatcaaggctctaagtgatcttggcttcagagagtacattgaggaggtttatgctgcgtatgaacagcacaaactcgagactctggattctccaaaagctggcaagttcactaggattgagatgacagaggaagaagctgttgctgagcaacaaaggatgtttgctgaggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactccctccaacctcaactgcagctccaccatcagccacaacagctcccacaagtgcagctgcactctcagccgcagctgcaaccccaagtgcatctgcaccctcagccgcagttgccccccacaattgcaggtccatcagcagctgcagcaacccccacaagtgcaggtccaccagcagcccgaagtgcagccccaagaagcgcagttgcaatcatcagcccagcaaacctcccaaccgcaacctcaggcacaactacaatcacaggggcactcacaagcgcagctgcaagccggactgctgggtcagttgcagacacaggcgcaaaccggacctgacatggatagttagagactattgtgtagcctgagtataagcaaaaaagggaaaaaaaaccaggcacttttgctgcatctactagaaacctgtatgcctgcttgtgactcattagatcctgatttaggtttccgtgcttcctgtagaatgtaaatgcagtgtgattgcagttgccttgttgctaataatgcgaagccgttagttactgatgatgtcattattgtgtggaatactgaattcgtgacaagtgtcatggcatggttttatgtgacgtgctgaaagatattccgttgccattgtaatagccgaacttcgacatttgtccatggtgatagcgactgatttgaaatgagtcttgct

SEQ ID NO: 824 - protein, 296 aa, Oryza sativa
  Orthologous to G484
MDPMDIVGKSKEDVSLPKSTMFKIIKEMLPPDVRVARDAQDLLVECCVEFINLLSSESNEVCSREDKKTIAPEHVLRALQDLGFREYIEEVQAAYEHHKHDTLDSPKASKFTGVEMTEEQAVAEQQRMFAEARARMNNGAAKPKEPEPEAQQQTQQPPQPQLHPQPQQPLQPQLQLHPQPQQQPSQLHPQQLLHPQSQQTPQPQPQVHPQPQQPPQLQPQPQLLQQPQLPQQLQPQSQLPPQPQQPPQLQLQSQLHPQPQQPPQLQPQPQLHQQPQPQAELQSQSQPQTEHGLDSS

SEQ ID NO: 825 - DNA, 826 bp, Glycine max
  Predicted polypeptide sequence is orthologous to G489
  misc_feature (793)..(793): n is a, c, g, or t
caaaccaaacctctctttctcagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttgggttgatattatcccaagagatgagttgaaagaaggaaggacttggaataaccaaggctactattccattggtgaaatcttcagctgatatgccatattactatgtcccttcacagcatctgtggaggactctgggatgacatgggcaacccgtggtgtgacaacaacgttgatctcacagagctnactccatgggtatgcatggcctcaaaccagaca

SEQ ID NO: 826 - DNA, 1669 bp, Glycine max
  Predicted polypeptide sequence is orthologous to G489
ttacggctgcgagaagacgacagaaggggcctccctttttaattgaaaccaaaccaaaccaaaccaaaccaaacctctctttctcagtttctctctcttagggttttctcctcccccattgacccaccgtccatcgcaaaggaagtcgcgcccaatttccatggtttgtagattaaatcttaaagcagtaagtcatcatggataaatcagagcagactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgaccatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattgcagaaggtaggttttattcagtatttcattctactgcaatggctgaatttattgctcatccgcttagtactagttgatgttttttcctgtccctcgttacgtgttagagtgcgaagaagaattagtgtgccattcttcacctgtttttgcacactacagccccggaagaacaaattgttccgatcattttcaattttttttcccggtaacatgaaaagtggttgatgttaaatgctgtccctgtaaaaaaaaaaaaaaaagaattgacagcaggaaaaaaaaaataacgagctgttctttttcttgattcaaaaccacataaatatatccagattagttttatagttaataattgattttattcggaag

SEQ ID NO: 827 - DNA, 956 bp, Glycine max
  Predicted polypeptide sequence is orthologous to G489
tcagaaatgcactctctctctttctctctccagaacacaactcaacacactcttcaatttcaaacgcacactcttcaacttcactgtccctccctttttaattgaaacccgagcaaacctcgctttctcagtttctctttcttagggttttctccaccgtccattgcaaagtcttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtcccttcacagcatcctgttgtaggaccacctggggatgatcatgggcaagcccattggcgctgagcaagcacac

SEQ ID NO: 828 - DNA, 1262 bp, Glycine max
  Predicted polypeptide sequence is orthologous to G489
cacgcgtccgcctctctttctagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgacaatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattcccaaaaaaaaaaaaaaaaaaaaaaaaaaaaaaaaaaaaaaaaaaaaaaaaaaaaaaaaaaaaaaaaaaaaaaaaaaa

SEQ ID NO: 829 - DNA, 675 bp, Glycine max
  Predicted polypeptide sequence is orthologous to G489
ctctcttagggtttcctccccccccccggaccctccgtccatcgcaaaggaagtcgcgcccaatttccatggtaagtcatcatggataaatcagagcagactcagcagcaacatcagcatgggatgggcgttgccacaggtgctagccaaatggcctattcttctcactacccgactgctcccttggtggcttctggcacgcctgctgtagctggtccttccccaactcaggctccagctgccttctctagttctgctgaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttgggataaccaaggctactattgcattg

SEQ ID NO: 830 - DNA, 1527 bp, Glycine max
  Predicted polypeptide sequence is orthologous to G489
ccacgcgtccgcttttgttctagcacttcgctgtctgaggttcgttccaaagaaaaacatcgtcaatcctcacgacagctctgctctgctctgcttcttttgttttcttatttttcttctgaaaccctaaattttgtctgctctaaactttgggatctttcacacttgaaaaaaactgcttcttgtgcccgacccagcacaattctcatactatagttcggcggcgcgaagacgactgctggggacattcggtccacagcttttgttctagcacttcgctgtctgaggttctggattctcagtgtttgcggacgcagcatcatcttttagggaagaatggatcatcaagggcatagccagaacccatctatgggggttgttggtagtggagctcaattagcatatggttctaacccatatcagccaggccaaataactgggccaccggggtctgttgtgacatcagttgggaccattcaatccaccggtcaacctgctggagctcagcttggacagcatcaacttgcttatcagcatattcatcagcaacaacagcaccagcttcagcaacagctccaacaattttggtcaagccagtaccaagaaattgagaaggttactgattttaagaaccacagtcttcccctggcaaggatcaagaagattatgaaggctgacgaggatgttaggatgatatcagctgaagcaccagtcatttttgcaagggcatgtgaaatgttcatattagagttaaccctgcgctcttggaatcacactgaagagaacaaaaggcgaacacttcagaaaaatgatattgctgctgctatcacaaggactgacatctttgatttcttggttgacattgtgcctcgtgaggacttgaaagatgaagtgcttgcatcaatcccaagaggaacaatgcctgttgcagggcctgctgatgcccttccatactgctacatgccgcctcagcatccgtcccaagttggagctgctggtgtcataatgggtaagcctgtgatggacccaaacatgtatgctcagcagtctcacccttacatggcaccacaaatgtggccacagccaccagaccaacgacagtcgtctccagaacattagctgatgtgtcgtggaaattaagataaccaggcactggaatcagttgtgaatgtcaaactgaatggttgggaaggtcgatactacatagcgagcagaagctgtagctgatagtttacatgcaatgcagactataaacatatgtagataatgtgctagggaaaacttaaccttatctttgatttagctggaaaaaatggtatttttcattttaattcacaggtcatcagatgataatatttatttactggtgcatagcaggatttttacttgagtttaaacttgtcatgcgcccaaaatatatcccatctttttcattcatcatgcttccttgttatacctacctatctgtggttcgctttgtgggaaaattgagttatcacatgatttgcgcacaagttgtgcaagaac

SEQ ID NO: 831 - DNA, 426 bp, Glycine max
  Predicted polypeptide sequence is orthologous to G489
  misc_feature (328)..(328): n is a, c, g, or t
ggctcgaggaacgcagggttaactctaatatgaacatttcacatgcccttgcaaagatgactggtgcttcggctgatatcatcctaacatcctcgtcagccttcataatcttcttgatccttgccaggggaagactgtggttcttggaatcacactgaagagaacaaaaggcgaacacttcaaaaaaatgatattgctgctgcaatcacaaggactgacatctttgatttcttggttgacattgtgcctcgtgaggacttgaaagatgaagtgcttgcatcaatcccaagaggaacaatgcctgttgcagggcctgctgatgcccttncatattgctacatgccgcctcagcatgcgtccaaagttgagctgttggtgtattatggggtagcctgtgatggacccaacatgtatgctcagcagtct

SEQ ID NO: 832 - DNA, 564 bp, Oryza sativa
  Predicted polypeptide sequence is orthologous to G489
  misc_feature (547)..(547): n is a, c, g, or t
cccacgcgtccgctccttcctaacctagggctccgatttcgccaggtgttgcccatcgcgaccgcgccaccgccgccgccgccgccaccgccaccgccgccgccaccgccaccgccacctgccgatcctacagcagttgcataggagtacatctttagaaatggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaangcctgcgagatgttcat

SEQ ID NO: 833 - DNA, 1296 bp, Oryza sativa
  Predicted polypeptide sequence is orthologous to G489
tttttttttttttctctttcttggtgtctcctcatgccagcacttttgagtattggattagaaactgatgaaaggtaaggtacagttactacattagttgcaaatcacctaccaaatcacaatcttttttttttctactgctgccatagcagagcagaactaacattaggaaagcctaagacctaatcagattacccgtttcagccaacaatcatgggaatagttttgacaagagcactgagttttagaggccctaagttcacaggacaatgtatatcaatgtcacaacttcactgtatcatctttagctactttctggcagagagtgctgctcttcaggggcctcttcctgttgctcttgaggctgctgccacacatacgtcaccgggtgaccttgctgtccaccgtacatcattcctgatccaggcccctgctgcgctggcacgtagtaatatggatatgtgtctgctgcgccccccacattaggcggtaggccaaccctcggaagcccaagcccttcttctttcatttcatccctgggaactatgtccaccaagaagtcatagatatcagtcctggtgatggcagctgcaatgtcattcttctgcaaggtccggcgcttgttctcctccgtgtgcatccacgacctcaatgttaactctaatatgaatacctcgcatgcctttgcgaagacaacgggggcttctgccgagatcatccggacatcctcatcagccttcattatcttctttatccttgcgagtggcaagctgtggttcttgaagtcggttgtttgctcaatctcttccatttggttagcccagaactcacggagttgctgctgttgctgttgctgcagctgctgatgaaattgctgggcttgttggtagactagctggtgctgagcactgagttgagctggattagtggggaatggtgctgatggctgtgagccaggaggaacaacagcaggagctccaggaaccatggcttgaggtggatatgcagcagcaggaggaggatatgcttgtgacccaccagtggcaacacccatcacaggctgaggctgtgaggatggttccatgtcagctcttgtccgtccaaagccaaaggcccgagagacgacgcccggatctcccgcgccggcgggagcgggagcggcggcggcggagagcgctccctccggcgaagggccgcgccgcccacctccctctcgtggagccctcggcgtcggcggcggagagagagagagagagggagacgcggtcgccctcgggccgattcctgcagcccggg

SEQ ID NO: 834 - DNA, 1671 bp, Zea mays
  Predicted polypeptide sequence is orthologous to G489
ttaagaacctagtaggcagacccggccggcgtagagagggggggaggtcgacgagacagagagagaaggccaagaggcttcctctccccattcctcccttccgtgccctagccgagccagccgcgaggaaggaggcatcccgccgtctcgcctggcgcccgcccgtcggccgaccttctgccgcagcttccaattctaaaaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaaccctggtcatatgagtgctcagcaccagattgtctaccaacaagctcaacaattccaccaacagctccagcagcagcaacagcagcagcttcagcagttctgggtcgaacgcatgactgaaattgaggcgacgactgatttcaagaaccacaacttgccacttgcgaggataaagaagatcatgaaggccgatgaagatgttcgcatgatctcagccgaagctcctgtggtcttcgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcagaagctatcacctgattcagagttctcattttaggttgtccaaactgcaggttttcttagtaatatcgttggttatcaaactgaaacaggcgattctaagtagggtgtagcatcatggtagtttcatttctgcttgtgatgttagttgaaaggataatgattagtggctagtggattaaagttaccataccatttccttctattccgaaagtttgcctccatgaggcctctgatatgacgaaaaaataaaaaatgcttcaaaaaaaaaaaaaaaaggaaaaaaaaaaaaaaaaaaaaaaaaaaaaggggggaaaaaacccctaaaggaccccccccacccggaataaaaaaaaaaaaaaaaaacaaaaggaaaacaaaaattcctttaaagaaaaaataaaaaaaaaaaagaaaacatggaaaaaaaatttaaaaaaaaaaaaaaattaaaaaaaacaaaatacccaaaaaaaaaaaaaaaaaaaaaaaaaaaaaaaaaaaaaaaaaaaccaaaaaaaagaacaaaaccaaaaaaataaaaaaaaaccaaaaaaaaaaattatccaaagggaaaaaaaaagagagaaaaaaaaaaaaaaaaaaaacaaaaaaacccccccgaaaaaaaaaaaataaaaattaaagaaacaaaaagagaaaattaaatt

SEQ ID NO: 835 - protein, 259 aa, Oryza sativa
  Orthologous to G489
MEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 836 - protein, 530 aa, Oryza sativa
  Orthologous to G489
MLSSMFLFLLPLSLLSFSLLGNLWAGAATSAGEGWSSVGLRLMLLGGATPFFYINIETVIITNMNYYPEGSNPVYFAVLVKYEDLDGDVVQVDLMESKSAYGGAIGVWTPMRESWGSASAVTSARPFVTNNVIPAIWSRIAPSLPPSPLPRRPRSALAHCRASPASVSPSARASPTPPSPRSPPHRPSRSRHLLLSGIPAAALVVACPNLNDLDFSNDHYGSTSGMRRRRRWPSCVGFWGGFGDGDGDRYSITFSAYIVVLRTQEAYVQILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 837 - protein, 250 aa, Oryza sativa
  Orthologous to G489
MEPSSQPQPAIGVVAGGSQVYPAYRPAATVPTAPAVIPAGSQPAPSFPANPDQLSAQHQLVYQQAQQFHQQLQQQQQRQLQQFWAERLVDIEQTTDFKNHSLPLARIKKIMKADEDVRMISAEAPVIFAKACEIFILELTLRSWMHTEENKRRTLQKNDIAAAITRTDMYDFLVDIVPRDDLKEEGVGLPRAGLPPLGVPADSYPYGYYVPQQQVPGAGIAYGGQQGHPGYLWQDPQEQQEEPPAEQQSD

SEQ ID NO: 838 - DNA, 1886 bp, Glycine max
  Predicted polypeptide sequence is orthologous to G504
cccacgcgtccgcccacgcgtccgacggctgcgagaagacgacagaaggggggggaaacaaaaacaaaacatttcgtccgaaactaatataacgtgttcctccttggaagaagccatagccataacatagccaccagaaaacaaaacccaccttagttattaaaagaaaagaaaactacataaaattaagctttgttcggtggtgaccatggggagcaccgactcatcaagcggttcacaacaaccgaacctgccacctgggtttcggttccaccccaccgatgaagagcttgtggttcactacctcaagaaaaaaacagcttctgctcctcttccggtagccataatcgccgaggttgatctctacaagttcgatccatgggagctacccgctaaggccgcgtttggggagcaggagtggtatttctttacaccgagggacaggaagtatccgaacggcgcgaggccaaacagggcggccacatctgggtattggaaggctactgggactgataagcctgtgttgacctctggtgggacccaaaaggttggggtgaagaaggctttggttttctatggagggaagcccccaagagggatcaaaaccaattggatcatgcatgaatataggctaactgataacaagcctaacaataggcctcctcctggttgtgacttgggcaacaagaaaaacactctaaggcttgatgattgggtgctgtgccgaatctacaagaagagcaacacgcataggtcacccatggagcatgacagggaagattcaatggatgacatgattggagggattcctccatccatcaacgtgggccacatgagtgcgaggtttcatcatctttcaaagatgacgacagcctacaacaacggtgcattgttggaaaatgatcaccacaacttgttggaagggatgatgataggtaacagcaacggagggatgaacacaactactactactacacctggtcccatgtcatctcacttagggggatccaaggaagagctttcttttgttccaaccatgactcactcttcaaacacttctaagagaacactttcatcactgtattggaacgatgaggatgtggcgggtacctcatcttcgaacaaaaggttcaatttggaaagtggggacaataataatcatggaagtgttgtgagggatgatcaagagaatggcactgcttcctctattgccactctgcttaatcaactccctcaaaccccttcattgcaccaacaatcaatattggggtcaataggtgatggacttcttagaacaacataccaaataccaggaatgaattggtatgcttagaacaatttcaggtttgttttaattattgatgaacagggagatattgaattactataaagaaggatatatgatatgatcctcgatcagctggtggaaaccctacactattagattgtaatgattttaatgggatattgagattttggttgttaggaatttggaagcagttgttagagtttgatcatttagatgggcctcattatcatccaatgaagttcttcaaccattggagttagctgcaagcaataacaacaccaaaggtcaggccatgggatacttttagttaaactttaatatagctttatacgtatatatagatatttgctttttttattggtatgtaaataaaaaaatggtggtgtgctcttaattaatgtattcaaatattcaaatgagaaaagagatttcaactcagctgttatatgcataccttgatcaattaggatacaaatgagctttgtgtggatcatatactgtagaagaacgatctattgatattttaattaaagccaaattggtgactatggtttgtcacgggattgtgtaaataaaa

SEQ ID NO: 839 - DNA, 602 bp, Glycine max
  Predicted polypeptide sequence is orthologous to G504
aagttggctcgagcgtttctcaacatttcgtccgaactaatataacatgttcttccgtggaagaagccatagccataacataactaccacttgaaaacaaaacccaccaccaccttagttaaaaaaaaaaaaaggttagataaaaattaagctttgttcggtggtgaccatggaaagcaccgactcatcaagcggttcacaacaaccgaacctgccacctgggtttcggttccaccccactgatgaagagcttgtagttcactacctcaagaaaaaagcagcttctgctcctcttccggtagccatcatcgccgaggttgatctctacaagttcgatccatgggagctacccgctaaggccgcgtttggggagcaggagtggtatttctttactccgagggacaggaagtatccgaacggcgcgaggccaaacagggcggcgacatctgggtattggaaggctactgggactgataagcctgtgttgacctctggtgggacccataaggttggggtgtagaaggctttggttttctatggagggaagcccccaagagggatcaaaaccaattggatcatgcatgaatataggctaactgata

SEQ ID NO: 840 - DNA, 1637 bp, Glycine max
  Predicted polypeptide sequence is orthologous to G504
ccacgcgtcctcatatccctcaaggtttggcttgtgcctttgtgtgctcatttttcactaaacaccaacccaaaccttatacacaaacattcttaattttgatatttttgtttatatattctaggtttttgttaattaattatattaagcatcatgggaaccccacaatccaataacttgccaccagggtttaggttccaccctacagatgaagagctcattcttcactacctaaggaagaaggttgcctccattcctttgccagttgccatcattgctgaggttgatatctacaagtttgatccatgggagctaccagctaaggccgcgtttggggagaaagagtggtacttcttcagtcctagagaccggaagtacccaaatggagcgaggccaaacagggcagcagcttcagggtattggaaggccacaggcactgataagaacatagtggcatcactggcaggaggagtgagggagcactttggtgtgaagaaggctttggtgttctacaaaggaaaacccccaaagggtgtcaaaaccaattggatcatgcatgaatatcgccttgttgacaccaatagacccattaggatcaaagacacctccatgaggttggatgactgggttctatgccggatatacaagaagttcaagcatgctgtatctccaaccacagaggcagcatcaacactgcaagtgatcaatgagcaattagatcaagcagtggtagaagaagaggagcaaatcaaagacacccttttaccaattttgaagaataacaacacttttgtccctcctccacaagccacaatactcatgtctcagaaatccttatccttctcaaatctcttggatgccacagactactccatgcttagcaccatcttatctgagaaccactccaataattaccctactccaagtgaaaccagcttattcaataattgtgagaatctggatcaggaaattaccccccaaaactactacatcaacgatactaatagtattaataataatagctacttgtttcagaagaacccttccaacatggaaaacattgctaggccaaaacgccaccttccaaacatggatcatgaggacaacatgttattataccctttaaagaaatatcatagttcctcttgcaatttccccaacaccaacctccaaaaccagaatccacaatggaacttcatgttcaagcagccactcatgagtcctcaatatcttcaatttcagtgataaatagcaaacaattatacgagtcacataaagaaaagaagaaaaaaaggttagggagaaaataaaaatgaaaaaaaaaggtgaaatatctacaagatgaatgtgctacatggtatccacatcaacctgttcactacgtaaggattagcacacagaaagatagcattttttttctttttcttttatgttgaaaaatgatgaaaagagacttcattggatcatgaactattacggaatcacagaaaaatcgtgtacaaataaaaatgttaatttgtacgtgttgggttgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 841 - DNA, 1465 bp, Glycine max
  Predicted polypeptide sequence is orthologous to G504
gaattcggctcggggccaaattggtattatcgcacttattgattcccttggtctctccttttgtcaagaacaaagtattttctttgatggagggagatcaacatggctctaattactcttttccacctggctttagattccacccttccgatgaagaactcatagttcattacttggaaaacaaagtcagttcacgtccacttccagcttgcattattgctgaaattgatctctataagtataacccgtgggagctaccgaataagtccttgtttggagaggaagaatggtatttctttagcccgagagacaggaagtacccgaatggattgaggccaaacagggctgcagcctcaggatactggaaggcaactggaactgacaagccaattctttcttcttgcggatcgaggcgcataggtgtgaagaaagctctggtgttttattcaggtcgacctcctaagggtgctaagacagattggatcatgaatgagtataggttggttgacacaaccatcaaatcctcaaggctaaaaggctccatgagattggatgactgggtactatgccgggttcgatataaaggctactctcagaagaattcatgtgaaaatcaagagagtcctagtgaactaaacttgtcagcaaaactactgaggagtgaagaaaacccaacaaaaatgaactgtcgggctgacatgatccctgattatcaatataaagactatcaaatcatagcctctattcttgttggtggacctattcctcccattgaaagcatgccaaatctgagctttaagggttgcaaaggcaacaatgtagtttcagattatgaagatggtttcactaaagggaattctcaaacgacaattccttcattggaaagttacttcaacccactgacaagaaaatccaatgaagatgaacagtatggaaatctcatttctttcaacaggaagttcaacactgataacagaatggacggatctactagcaaagtgttgaacagtagagaattgaattgctacaaccaaaaccattctcaagatgacattttcaatgggaacccaccagatcctaccatcaattttcaagagctaaacgaattagacttttcaggaaggtaccatcagtgatgaaggtatttattataagacagtcaacgtccctttacttcacaggtagattttcatggattatacaacttaagacgtaggagaaacctgaaggataatgggccctattccggcgaattattgctgtatttctttatgcatagtcaacatggggcaatagctacatatagaagtttccatgcattcatgaaattccttgtaaacaatgccccggccaactagcttcttgagcgtgccctgtgtcagttcaactagaactttatcctacctagtaattataacgtgtaaatacaatttgtattcgggcggccgccaacttacaggagtta

SEQ ID NO: 842 - DNA, 1503 bp, Glycine max
  Predicted polypeptide sequence is orthologous to G504
gagcggccgcttttttttttttttttttttttttttttttctagttggttttatatggctcataaaactcggggtaaattaacttataatataaacctacaatagccgctacattattatccaacccagtatataccctaagccaaattaaccaccctaagtattccaattcatgcttggaagttgaaactgttgcctcaatactccattaccaatagggccaagaagcgcatttgggtgaaacgatgttgtgttctgtgaaaggtggctaagcagagaaacgaaggaattgtcttcctcaacagtgctgcttccagcataattaagatcacagtggaatctcctgcttgaagaggatgaccctgtgtcattccaaaagtactgtgacgaaagttctcttttcatagggaagtttccctttgaagacacttgttgggaatcagaaacatcatgctacatgctctgatgatcaactcctaagattccatcaaataagttatcatcattttctactccaaggggcccataacttgtgctaatagaagacgtgggtttggaatcctgagaggtgttattattagccattgacaaagtggacctcattggtagcatagaaagctccttattctgctccaccaaaggtaaccttggcaggttggtactgttgcttttcttgtatattcggcacaaaacccaatcatcaagcctcaaggaatttttcttgcaactctgtgcatgatctgaagccatagaaggtggttttgagctagaatttgagttgctatctgcaagcctgtactcgtgcatgatccaattggttttaaccccttttggaggctttccaccatagaaaacaagtgatttcttgactccaactttgtggtggtggccatgagatgcaagtatgggcttgtcagttccggttgctttccaatacccagaagaagcagctctgttaggccttgacccatttgggtatttcctatcccttgggctgaaaaagtaccactcttgatcaccaaaagttgctttacttgggagttcccatgggtcgaacttgtagagatcaacctcggcgatgatggaaccaggaagaggaacagagtctgcttttctcttgaggtagtgaaccactagttcctcatctgtggggtagaatcgaaaacccggtgggagttgtgggtgctgagataactgagatcctgaagatgatgaatccatgctgtacacgatcgatgatgataaagagtcttcaaccccctccttcaattctcatgcatacaatattatgtacaactttttgtgcctggcttttttctgtagattctcttgtttctttgctctatctttctttttattatgggtggatgaagattaggcactatgattgaatcatttcaatcgaaataaagttgagaggaggaaaggatgatcgcatgacaaggatttgaattctgtccccttctgtcgtcttctcgcagccgtacggacgcgtgggtcgac

SEQ ID NO: 843 - DNA, 1457 bp, Glycine max
  Predicted polypeptide sequence is orthologous to G504
ccgcggatacagaacagcagtattatatcgtattcagtttaatataagcttcaaaaaaaaaaactcacaaaaatacaagcgtacggtcatgatctctctctctctctagtatgttatgtatatatggctaataaaacccaagttaaattaacttataatataaacctacaatggcagctacattatccaacccttacccggtatatataccctaagccaaattaaccaccctaagtattccaattcatgcttggaagttgaaactgttgcctcaatacaccattaccaacagggccaagaagcgcatttgggtgaaacgttgttgtgttctgtgggaggtggctaagcagagaaacgaaggaattgtcttcctcaacagtagtgctgtttccagcataattaagatcgtaatggacccgtctgtcgtcttctcgcagccctgtgccattccaaaactgtgacgaaagttcccttttcatagggaagtttccctttgaagacacttgttgggaatgatcagaaacatcttgctgcatgctctgatgatcaactccaaagattccatcaaagaaattatcatcattttctactccaaggggtccataacttgtgcttctagaagacgcagttttggaatcctgaggagtgttgttatcattagccattgacaaagttgacatcattggtagcatagaaatctccctagaaatctccttattctgctccatcaaaggtaaccttggcaggtgggtactgttgcttttcttgtatattcggcacaaaacccaatcatcaagcctcaaggagtttttcttgccactgtgtgcatgatctgaagccgaagaaggaggttttgagctagagtttgaggagctatcagcaagcctgtactcgtgcatgatccaattggttttaacaccttttggaggctttccaccatagaaaacaagtgatttcttgactccaactttgttgtggtgaccatgagatgcaagtatgggcttgtcagttccggttgctttccaatacccagaagtagcagctctgttaggccttgtcccatttgggtatttcctatcccttgggctgaaaaagtaccattcttgatcaccaaaagttgctttacttgggagttcccatgggtcaaacttgtagagatcaacctcggcgatgatggaaacaggaagaggaacagagtctgcttttttcttgaggtactgaaccactagctcttcatctgtggggtggaatcgaaaccctggagggagttgtgggtgctgagaaaactgagatccagaagatgatgaatccatgctatacatgacgatgatatgatgatgatgataatgagtcttcacctctctccttcaattctcatgcatacaataacacaactttttgagcctggctttttctttctttagattctcttatctcgagccgattcggctcgagta

SEQ ID NO: 844 - DNA, 1876 bp, Glycine max
  Predicted polypeptide sequence is orthologous to G504
gaaacattggaggtgtttgtaggagatcatttaattaatttccatctctctcagacagtcacatttccgctccagggccttcaccttgactttggatgggtaagctacatatcatacatagcgaagatgtgtgttgttctcttcttcttgtgtgaagccaaagccacaacaacaaccattggaacaacccaacaacatagtgaacaacaaccttggtaataataaccatggagagcaccgaagactcatccacgagttcacagcaacaaccgaacctgccacccgggtttcggttccaccccacagacgaggagctcgtggttcattacctcaagaagaaagtagattctgttcctctccctgtttcaatcatcgctgatgttgatctctacaagtttgatccatgggaattaccagccatggcatcgtttggggcggaagagtggtactttttcagcccgagagaaaggaagtacccgaatggcgcaaggccaaacagggctgcaacttcagggtattggaaggccacaggtacagataagcctatatgtagtggaactcaaaaggttggggtgaagaaatctttggttttctatggagggaagccaccaaaaggggtcaaaactgattggatcatgcatgagtaccgtgttgctgaaaacaagcctaacaataggcctcctgggtgtgacttgggccacaagaaaaactccctaaggctggatgattgggtgttgtgccggatctacaagaagggtaacacacaaaggtcacatgagagggatgattccatggacgacatgattggagaagtacctccttccatcaacgtgggccacatgagtgcgaggtttcacctttcaaagatgtccacgagctacagtggtgcattgttggaaaatgacagaaacacgttagaaggggtggttataggcaatggtagtgtcaatgggatcagcaatactaataatattacaagtgtcatatcatcatctcaccggtttggcacctccagactccaaggcagagcttcttccttttgtccctccaaacaacacttctatttcggcctccaaaagaacactctcatcactctattggaatgttgatgatcacaaacacttcaatttggacagtaatgggaatgtgagtgttttgaggacagatcaagagaataataataataatagtggtgcttctggctcctttgctactctgcttaaccagcttccacaaacaccttcattgccccaaatagatgggttacttcggacaccgtatcaaatacaagggaccaattggtatggttaattccattttgaggggtatgcttgatatgataatttcataattataatgcacaaggagatcaaattgaactaaggtgtggcaagggatcctcaacttgtgctagattgcaaggattttaaaagggtcattgagattgtggtttaattgttaggagaatggaagaatgttagagcacactaatcaatgttttctttcaaccatttgcaggtagctaagggcaattaataccacatgaggtgagggtgtaagaccttggaacttttagtttaattattatatagatcggtatagtaacatagataaagatagatatatagaagcatatttgcttgttttattagtgtgtaaagaaacaaaatgagggtaaaaactttcgagagaggataaaagaaagagttagccacagttctatatatatatactttgctttatgatacagaatgaagagtatgggcggccgccgtcagaacgatataaattgatgcaagattttaaaatatgtatattgattgtatttatggtttgtctatctataacttgttcatgaagagcttgatattaatct

SEQ ID NO: 845 - DNA, 1807 bp, Oryza sativa
  Predicted polypeptide sequence is orthologous to G504
tttgttttttttgtgtggctgccattaaagaatcacttattgattgatttacatgaatatgagctataaatccggctttatgatcttgacatcattctccttgatctcatgttccagacttctagtgggtctatctcaaagtcttatcaacccctatctagcttaattaatctttagtactgagctagcttgagtacacagtagtatagtaccatgagaaaaaatgtatacacaccacaaactatatagctatgcatgatcggacgacctagctagtccacacaagtacaaattaagtacaatttctttcccaatatatttactatttaaatctatcgttttggacctatttgctttcgaaatagacctcactgttcaaatcatcaattcgccatgtgcaattatgttcagtgtttaatcaggctgtggtattatgtacgaagaacgagctatcagttcatccccatgttagagtggagcagcatctggtggctcagtcccagtgacgatccctgcaaggcgctgcctatttggaaagttgcaccaacgcatgaaccgttcggcttcttgcccgccgcggcagcaggaggcagcgcctggatcgtcggctcgcctccgtccgatgatctcttgcgcttcccggtgacggccggcggctcgacgacggcgcctgccgacgtcgaggcggccgcagaggaggacgggtccaggtgcgcgagctgaaccatgctgttgttcgcgatgaaatggttcatgacggggtggccaaagagggcgtgttgttgttgttggtggtggtggtggtcgggctgcctcgccatctcctgcaggggggcggcggcggcggcgccgccgtcgtcgaagagctgcgacagcgagtactcgttgagcaggtcggaaatggaagggatcttctgcatcgccgtcctctgcgtagcggcggcggcggcggcgtgcagcgacgggaaggcgccggcggcagcgccctgcaagatcatggatgcggcgctcgacgacgacggcgcgtacagcggcgcgttctcctccagggcgcacggctcgtcctgctcgtggtcggagagcggcggcacggccagcggcgacgcgtggctgctcttcttgtagatccggcacagcacccagtcatccagcctcacgcgggccgtgccctgcttcatggggcggtaggtgttggcggcgtgggcgtctgcggcggcgaggcggtactcgtgcatgatccagttggtcttggtgcccttgggcgggcggcccttgtagaagacgagcgccttcttgacgccgacgctctcgttggtcgccgcgccgccgctgctgtggatgggcttgtcggtgccggtggccttccagtagccggagcccgcggcgcggttcggccggatcccgttcgggtacttgcggtccctcgggctgaagaagtaccactccctggtccccgtaattcgccttggctgggaggtcccacggatcgaacttgtagatgtcgacgtcggcgatgatggagacggggcacggcgaggaggcggcccggttgcggaggtagtgcacgatcagctcctcgtccgtcgggtggaaccggaaccccggcggcagcatcgccgggttcgacagaaccatcgtctccggcagtcacccacacacaacacacacctccctgcacaagcaaaacctatctagctatagctgctcacttccaagatcaagccactcgatcccctctcagctatgatctatgagatctatcagggtcgagcttgtatcaagaggaggcgagagatggacctcgtgc

SEQ ID NO: 846 - DNA, 629 bp, Oryza sativa
  Predicted polypeptide sequence is orthologous to G504
cacgcgtccgccttagcttattagcttccttccttcactagtgccagttttcctcctacgtaatctaagctagccaggtcgtcatcttcttccttcagctcacgctgaccaaacaccatctgttattctgtttgtttgttttttttaaaaaaagaaaaaaaatctagctaggcgagccgattgaaggagctgagcatgccgagcagcggcggcgccatgcctgcccttccaccaggcttccgcttccaccccaccgacgaggagctcatcgttcactacctcatgaaccaggccgcctccatcaagtgccccgtgccaatcatcgccgaggtcaacatctacaagtgcaacccatgggaccttcctggtaaggcgctgttcggcgagaacgaatggtacttcttcagcccgagggaccgcaagtaccccaacggcgctcgccccaaccgcgccgccggctcggggtactggaaggccaccggcaccgacaaggccatcctctccactccgaccagcgacaacatcggcgtcaagaaggccctagtcttctacaagggcaagccccccaagggcgtcaagaccgactggatcatgcacgagtatcgcctcacaggcacatcagctaacaa

SEQ ID NO: 847 - DNA, 1195 bp, Zea mays
  Predicted polypeptide sequence is orthologous to G504
ccggcgtcgtagtactacgcggtgatgaggtccatggtgagcacggactcgtcgtccggtgagctaccgccgcagaagcagccgagctcggcgccggatctcccgccgggcttccggttccatcccacggacgaggagctggtcgtccactacctcaagaagaaggccgcgtccgtgccactccccgtcgccatcatcgcggaggtcgacctctacaagttcgatccgtgggagctacctgataaggcgacattcggcgagcaggagtggtacttcttcagcccgagggaccgcaagtaccccaacggagcgcggccgaacagggcggacgacgtccggctactggaaggcgactggcacagacaagcccatcatggcgtccggcggcaaccgcgagaaggtcggcgtcaagaaggctctcgtgttctaccgcgggaagccgccaaagggcctcaagaccaactggatcatgcacgagtaccgcctcgcggatgcggcgagctcaaccaccagccggccgccgccgccttgcaacgccggaggcaaggccacgtctctcaggctcgacgactgggtgttatgccgcatctacaagaagatcgacaaacttggagtcggcgatccgccgcggatcatggagtgcggcgaggactccgtggagaatgcggtggcagcctacccgacgcatgccgcggctgctgccatgggccgtcgcagtcgcaggcggaaggaggggcttaccataccggcaattacacttcgctgatccaccaccatcacgaggacagcttcctggtggatgggctgctcacagcagaggacgcgggcggcagctccctgagccagctagccgcggcagccagggcagctgctccaacagacaccaccaagcagctcctcgtcccgtcctccaccaccccgttcaactggctcgacgcgtcggcactcacgattcttccgccggcaaagaggttccatgggtacaacagagacaccactgacggcggcggcacgtccctcccgtcgccgtccgagaggaataacctgcaggcggctgtcggcgccgtcgatagtggcgccagcggtggcactagtgccgtcattccatcattcctcaatccgctcggcgtgcaaggtgcgacaacctatcaccaccacgccattttcggcacaccggtgacgccggaagccgcca

SEQ ID NO: 848 - DNA, 1447 bp, Zea mays
  Predicted polypeptide sequence is orthologous to G504
gtcgacccacgcgtcccgtttctcctggctactacctctcgctccctccggctccgatccagggtgcgagctgagcttgggctagtttagtctccccaagctcgtggcgcagcagcagactcgttggtggaggtggattagtagccaaggctttgcagctaggtagggttttgtagctagttcctcgcaggctcagctctctcatactagctagcgtcggtcagtcgggcgagcaggccaatggtcatggcgaacccggacatgctgccgccggggttccgtttccacccgacggacgaggagctgatcctccactacctccgcaaccgcgccgccaacgcgccgtgcccggtcgccatcatccccgacgtcgacatctacaagttcgatccatgggacctgccatccagggctgcgtacggggacaaggagtggtacttcttcagcccccgcgaccgcaagtacccgaacgggatccggccgaaccgcgccgcggggtccggctactggaaggccaccgggaccgacaagcccatccacagcagcaccaccgccggcgagagcgtcggcgtcaagaaggcgctcgtcttctacgagggccgcccgcccaagggcaccaagaccaactggatcatgcacgagtaccgcctcgccgccgacgcgcaggcagcgcacgcctaccgccccatgaagttccgcaacgcctccatgaggctggacgactgggtgctgtgccggatctacaagaaggccagctgccaggtgccggcgatggcggcggtgccgcagctctccgaccacgaccaggacgagcactgcggcttcgacgacaacccgtacgccgccatgctcctgcagggcgcgtcgtactcgtacccggcgccgccgcatgccgcggccggcgcgcagaggatgccccggatcccgtccctcacggagctgttcaacgacccctcgctggcgcacttcttcgaggagggcggcggcatgcaggacatggcgcggctcagcaacccgcagcagcagcagcagcagcagcacgctcctctcctcgcccgccccgtcacgagccaacagctgctgctcaacaacggccacagcatgcccggcggggggcaggcgcagatggatcctcatccgcctgctgctgccgcctcgacgtcgtcggccgccgctggtaacaacaagcgcaagagatcgagccctactactgatgccggtgcgctgtcgtcgagccaggcgtctgaggccaagaaaccgaacgggtcctgtttcggcgcaacgttccaaataggcaacggactgcaggggccctccctgggccaccaccacatgccgcttcactctaacatgggcacgatgaactgacagattattgctgttgttctccgctgaaagctatacttgagagcaaaaaaaaaaaaaaaaaaaaaaaaagggcggccgc

SEQ ID NO: 849 - DNA, 1885 bp, Zea mays
  Predicted polypeptide sequence is orthologous to G504
ccggccgggaaaaaaaaagaattcccgggtccagttcagcagccagtcagtcagtcctcgatctgatatcctctcctccctgcagcgactccagctccgatcgattccattccatccatcgagctgcagcagggccatgacgatggcagctacgacgacgatgatgtcagcagcagcgcaggcggcgacgtcgcagctgccgccggggttccggttccacccgacggacgaggagctcatcctgcactacctccgcaaccgcgccgcgtcggcgccgtgccccgtgcccatcatcgccgacgtcgacatctacaagttcgacccatgggacctgccggccaaggcgctgtacggcgacggcgagtactacttcttcagcccgcgggaccgcaagtaccccaacggcatccgccccaaccgcgccgccggctccggctactggaaggccaccggcaccgacaagcccatccacgacgccgccaccggcgagggcgtcggcgtcaagaaggcgctcgtcttctacaagggccgcccgcccaggggctccaagaccaactggatcatgcacgagtaccgcctcgccgccgtcgccggctgcaccagccccctcgccgcctaccgcccgccctccaagttcaggaacgtctccatgaggctggacgactgggtgctgtgccggatctacaagaagtccggccacgcgtcgccgatggtgccgccgctcgccgactacgagcacctcgaccgcgacggaccttctcccggcggcttcttcgacgactacttctgcggcagcaccagcttgtacgccgccgccgcgccggccatcggcggcggtgctgctgctgctggtactacaaacactactacgacgccggccgtcgtcatgcagcagcaccagcagccggcggcgctgccgaggctccccaagatcccctccatctccgagctgctgtgggacgagtacgcgctcgcgcagatcttggaccccccggccgacgtggccgccgaccacgcctcgttcgccgtgcacccgtccctcaaccagctcctggccgtcggcgacgacggctccgatctcatgatgttctcgccgcccccggccgccgcagcaggcgggaagcgcaaggcgatggtggcgatgaacatgagcccagctgacgagtgcgccgccactgcccaccagcaccagtctccggcggccaagcggctcaacggtggctcctgcttcgacgacgcgccgcagccggccagcggcttgccggcgacgatgtcgtccgtgcttggcggcggcctcaaccaccacatgctcccacagttctagatagacgacttctggtagctgactttgttgggggcacatcttccgtgcatgtactgcgtcatcaactgatcaatatggtggatcgtctacgcggaatagctagcaacctgcggcgacatggaaagcaaggatcgagctcgtggattggaggccattaataaagatgggtcgtgcggtgaagaacaattgtagcagtacgtagcactatttgtactggagccagtgttgatcaacgttaggcgtaaccatggtatgtatcccatttttttccctccgttgtagagtacaggtactctatattcatttcaggcgcagtgcgaaggtagctggagcttgatgggtccatgtactactacactagtactcttatttattattcaatatgaagtatatattatattgtcttgctagataaaaaaaaaaaaaaaacagcggccttttaattccagatatatagacagattattaagtaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 850 - DNA, 749 bp, Zea mays
  Predicted polypeptide sequence is orthologous to G504
ttgggtaccctgggccgccggaaaatttaatggcctctctagatcttttaagctagctatccttgcttcctcccttcactttcttattgagagctctctggcgtgctgtaccggacgacaggggttggtaggtcgtaggtgtagctagctcggcgagcgagcaatccggccaacagcacacgcgtcgatcgccatgccgagcggcggcggcaatggcggtggcagtagtcgtagtagagtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtcgtccacgcccacgatccaaaacgtcgtcgtcggcgtcaagaaggcgctcgtcttctacggcggcaggccgcccaagggcaccaagacggactggatcatgcacgagtaccgcctctcgggcgcggcggacgacgactgcaagggcagcagcaccaggcgcagagtgtcctcctcttcctcgtcctccatgaggctggacgactgggtgctgtgca

SEQ ID NO: 851 - protein, 346 aa, Oryza sativa
  Orthologous to G504
MEMTMSSAATSLPPGFRFHPTDEELILHYLRSRATAGQCPVPIIADVDIYKFDPWDLPSKAVYGESEWYFFSPRDRKYPNGIRPNRAAGSGYWKATGTDKPIHDSATGESVGVKKALVFYRGRPPKGTKTSWIMHEYRLAADPLAAAANTYKPSSSSRFRNVSMRLDDWVLCRIYKKSGQASPMMPPLAADYDHDEPSGVLDDAYSFYAPPMISTTLIPKLPKIPSISELFDEHALAQIFDAAADPPADHHQHALAVHPSLNQLLGVGDNFLAECYPSTASTATVAGGKRKASPAGDYAGGGHTPAKRLNGSCFDVAPQSVVGGLQATPSSVLAGLNHQMLPPQLF

SEQ ID NO: 852 - protein, 310 aa, Oryza sativa
  Orthologous to G504
MAMQLSLPVLPTGFRFHPTDEELVINYLQRRATGLSCPIPIIADVEIYNFNPWELPSMALFGEHEWYFFTLRDHRYPNSVRPSRSAASGFWKATGTDKPVQVANMQSTPVAMKKALVFYVGRPPMETKTTWIMHEYRLTNTGGSTASHPSLSSSTAHPSVKLDEWVLCKIFNKSPEPDNTAPPSNVVSRLQCSPPLPPPAAPPGNYPPLPVGATNDGGVFAGAGDMLFTIQEHQEGTPSMLPPIPNLEPPAATIGNSSLNGTAAAAAAADGHGRLEEEDTSAYTFTDQEMEQMLMDLMDQDFFGNDQPQE

SEQ ID NO: 853 - protein, 316 aa, Oryza sativa
  Orthologous to G504
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 854 - protein, 425 aa, Oryza sativa
  Orthologous to G504
MESPDSSSGSAPPRVLRRQQQQPGSAPELPPGFRFHPTDEELVVHYLKKKAASVPLPVTIIAEVDLYKFDPWDLPEKANFGEQEWYFFSPRDRKYPNGARPNRAATSGYWKATGTDKPIMSSGSTREKVGVKKALVFYRGKPPKGVKTNWIMHEYRLTDTSSSAAAVATTRRPPPPITGGSKGAVSLRLDDWVLCRIYKKTNKAGAGQRSMECEDSVEDAVAAYAPSSQQHATAAAGMAGSDGAGGVAAAHGGDYSSLLHHDSHEDTFLVNGLLTAEDAAGLSTGASSLSQLAAAARAAATPCDATKQLLAPSPTPFNWFEAFLPRAKEFPSGLSRSSRDIGDMSLSSTVDRSLSEAGAVAIDTGDAANGANTMPAFINPLGVQGATYQQHQAIMGASLPSESAAAAAACNFQHPFQLSRVNWDS

SEQ ID NO: 855 - DNA, 648 bp, Lycopersicon esculentum
  Predicted polypeptide sequence is orthologous to G509
taccgattcatcaaccggctctcatcatcaaccacaattgccacctggatttcgatttcatccaactgatgaagagcttgtggttcattatcttaagaaaagagttgcctctgttcctcttcctgtttctattattgctgaagttgatctttacaaatttgatccttgggaactacctgctaaggcgacatttggagaacaagaatggtatttcttcagtccaagagatagaaaatatcctaacggggcgcgcccaaatagggcggcaacttccggttattggaaggctaccggaaccgacaagccggtgctcaccgccggcgggacccaaaaagtaggtgtcaaaaaggcattggtgttttatggtggcaaaccacccaaaggggtgaagacaaattggattatgcatgaatataggcttgctgataataaaacaaataataagccccctggttgtgaccttgccaataaaaaatcactaaggctagatgattgggttttatgtaggatttacaagaagaataatactcaaaggccaattgatcatgaaagagatgatttgaatattgatatgatgatgggatcatcatcaattcatccatcatgtataccaaattcaatgtcaatgccaaatatatttggtcaacc

SEQ ID NO: 856 - DNA, 1149 bp, Glycine max
  Predicted polypeptide sequence is orthologous to G509
cataacaagaccacactattattattatcaagctcgaagaatctcattccatccaagtttgatgccacgccatcattgaagctattttcttcgaggtccatgtcccataagaacccatatccattattatcatcacatttgggactaatttgagtaacggtgctagagttgttggtgtttgtttccctagagaactgaaggagacccatcaaggagttgttgttgttgttttggctttggtttggaatatgatgattgtgattgtgatgatgggttgccattgaggaagagaatggggcaagaaattggttatacccaattgatggtgtggtgttttggttggttggagatgacgaagccaaagttagggatggaactgtgctctcgtacatgatgagtttggcactgttgtctgctttgcccttgtgaaacactctacacaaaacccagtcctccttaggtggcaaatgtggcgtctccaagcgaaactcatgcatgatccaacccgttttgatgccatttggagccctgttcctgtagaacaccaatgtcttcctcatccctacaacctcacgcgtggcagggtcaaacaccgtacgatccttccccgttgctttccagtagccagatgtcgtcgcgcgattggttcgaaagccggttgcatatttacggtcacggaagctgaagaagtaccattcgtttgcattgagcttagccacctctgggagttgccatggctcgcacgtgtgcaagtcaatttccatcaaggtacccttcagaacttcctcattagtgatctttttgtaaaggtaatgaaggaccaactcctcatcactcgggtaaaaccgaaaccctgggggcagtgaagcaccaatgtctctaagacccatgaatttgctgattttgaaagcagagggaaaggtttgcaatatagttagagagagaaagagagagggaaatctaattaattgagatctttttgaaattttagatatggatagagaggtttaattagagggagatatatatggtagaggtggatttagaaatgtgaaaaaatcaatataattgaagctaggattgagaggttactctctgctggggatatttgaaatattaaggtatccccttctgtcgtcttctcgcagc

SEQ ID NO: 857 - DNA, 1109 bp, Glycine max
  Predicted polypeptide sequence is orthologous to G509
gaattcccgggtcgacccacgcgtccgtgcatgcgcaataatattaatgcacgcagaggtggctaagctcaatgcgaatgagtggtacttcttcagtttccgggaccgcaaatatgctactgggtttcggaccaaccgggcaactacatcagggtattggaaagctacggggaaggatcgtaaggtggaggatccagccacgcaagaggttgtagggatgaggaaaacactggtgttctacaggaacagagctccaaatggcatcaaaacgggatggatcatgcatgagttccgcttggagaccccacatatgcctccaaaggaggactgggtgttgtgtagagtcttccacaaaagcaaagaagatgacaacagttccaaactcctacagtatgagacgacaccatcatccctaactttgttggcttcgtcatctcccaccaaccaagccatgcctcatggtgttgggtataataaccgacttgccacctctttctctaattcattcatgccaacccaccaatatcatcatcacttcaaccctacccaaaacgctaattctttgatggatctccttcacttctctcgcgaaaccaacaccaacaatactggctttcttactcaaattggtgccaaaggtgatgacgaatatggtttcttatgggacatggatctagaagaaaatagcctagatgatggcgtggcttcaaacttggacgcaataagattcgaggttgataataataatactaatacccccaatatggtattgctataattaaatgtgtaagatgtgttatgtgtgtacatatatacacatatatgttattcatagctcgtaaattgtcgtaagattcgtttatttgtggtgtatttatggtgcttcgctatgaggggcatgtcacatgatagattgggtttagttgttacaagtttgtgtggtatattgttcaagtagtagggtaatactattgtggtccattaggcttttcgtaatcaattactattatttacccattattattgggaactattcctttgtatacagtttgtgtatgtaattagtattggctaaaaaaaaaaaaaaaaaaaaaaaaaagggcggccgc

SEQ ID NO: 858 - DNA, 611 bp, Glycine max
  Predicted polypeptide sequence is orthologous to G509
  misc_feature (122)..(122): n is a, c, g, or t
  misc_feature (124)..(125): n is a, c, g, or t
  misc_feature (177)..(177): n is a, c, g, or t
  misc_feature (183)..(183): n is a, c, g, or t
  misc_feature (189)..(189): n is a, c, g, or t
  misc_feature (201)..(201): n is a, c, g, or t
  misc_feature (208)..(208): n is a, c, g, or t
  misc_feature (210)..(210): n is a, c, g, or t
  misc_feature (213)..(214): n is a, c, g, or t
  misc_feature (219)..(220): n is a, c, g, or t
  misc_feature (224)..(224): n is a, c, g, or t
  misc_feature (228)..(228): n is a, c, g, or t
cccacgcgtccgctgaagggtaccttgatggaaattgacttgcacacgtgcgagccatggcaactcccagaggtggctaagctcaatgcaaacgaatggtacttcttcagcttccgtgaccntnnatatgcaaccggctttcgaaccaatcgcgcgacgacatctggctactggaanagcacnacgggngtaaaagggganaattttncnggnntttanncggngggnttttggttttttgaccctgccacgcgtgaggttgtagggatgaggaagacattggtgttctacaggaacagggctccaaatggcatcaaaacgggttggatcatgcatgagtttcgcttggagacgccacatttgccacctaaggaggactgggttttgcgtagagtgtttcacaagggcaaagcagacaacagtgccaaactcatcatgtacgagagcacagttccatccctaactttggcttcgtcatctccaaccaaccaaaacaccacaccatcaattgggtataaccaatttcttgccccattctctttctcaatggcaacccatcatcacaatcacaatcatcatattccaaaccaaagccaaaacaacaacaacaa

SEQ ID NO: 859 - DNA, 1002 bp, Oryza sativa
  Predicted polypeptide sequence is orthologous to G509
cgcgcacgcgtcctctcccgcgtcctccgcctcctcccgcgcgctgcgtacgtgagagcgccatctcctgcttgcagcagctagcaagcagcaggcgcaacagtattactgcagatagagctctcgaccgattgatcgattgctcactgccatatacatgatacttacataccgacgtactacacacagagatagagatcggagggatagctattgctattgctagccatagtatagtagttccctttgctcctgctgctgctttgttgcttgcttccctacacttctctctctcagctgctagctgcgcatataattattccctcgccaagctatatatatttgcctcctgccttcttcccgagctcacacaatcgccaacctatacagatatatgtgctagctacttccaagttcctacctatcaatttctctcctcctcttcttctctgcatcaatctgcagcttaattcttagctatgtacatatagctagctaccacttccaaaatactccacaggcaccaggcacatatagatatagctagattgctatagacagagagatcatcaaagaaatttagcaggtgatagccacatggggttgagggacatcgagctgacgctgcctccggggttccggttctacccgagcgacgaggagcttgtctgccactaccttcataacaaggtggtgaaccagcatcgcttcgccggagttggaggaggagccgccgccgccgccgccgccgccggcggcggcaccatggtcgaggtggacctccacacccacgagccgtgggagctaccagatgtggcgaagctgagcacgaacgagtggtacttcttcagcttccgcgaccgcaagtacgcgacggggctccgcacgaaccgcgccaccaagtccggctactggaaggccaccggcaaggaccgcgtcatccacaaccccaagctgcacgccgccgcccaccgccgcgcctccatcgtcggcatgcgcaag

SEQ ID NO: 860 - DNA, 486 bp, Oryza sativa
  Predicted polypeptide sequence is orthologous to G509
cttattcatccaaatagtattggtagcttgttgatcgaagaattaatccatggatggattgatcagtgatgatagtatgatgatgggtggtgaggtgagggcgatcgagtcgaggctgcctccgggtttcaggttccatcccagcgacgaggagctagtcggctactaccttcggaacaagcagcagcagcagcagcagcagacggcggccacctccatgctcgtcgaggttgacctccatgcctgcgagccatgggacctaccagaggtggcgaaggttggttcggatgagtggtatttcttcagctggagggagaggaagtacgcgacggggtggcgcatgaacagagcgagcaagcaagggtactggaaggccaccgggaaagacaagcccatccttcatccgacggtggccggcgccaggaagacgttggttttctactccggtcgcgcccccaacggccgcaagaccgcctgggtcatgca

SEQ ID NO: 861 - DNA, 603 bp, Zea mays
  Predicted polypeptide sequence is orthologous to G509
aaaccatccggctacagcaagcaaccgtagcagtcgtagatgtgcagcgcgcgcagccaattccttcttactcccccgggccttccctctgtctctctcctcttctcttcagatcgacgtgctggttgcagagtgcaaactgcgtatataatatacagttcgttgttcttccagctccgcacataaagatagatagatatacagggaaaaagtgtagtagctggagcagaagctagctagcatggggctgcgggacatcgagctcacgctgccgccggggttccggttctaccccagcgacgaggagctggtgtgccactacctgcacggcaaggtggccaacgagcagctcgcaggcgccggcgcagccatgggtggaggtggatctgcacgcccacgagccgtgggagctccctgacgtggcgaagctgagcaccaacgactggtacttcttcagcttccgcgaccgcaagtacgcgacggggcagcgcgccaaccgcgccaccaggtcgggctactggaaggccaccggcaaggaccgcgccatccacgaccccaggtccgccatcgtcgtcggcatgcgcaagaccctcgtcttctacc

SEQ ID NO: 862 - DNA, 1439 bp, Zea mays
  Predicted polypeptide sequence is orthologous to G509
ccacgcgtccgcggacgcgtgggcggacgcgtgggcggacgcgtgggtttaagagtgtgtcccttggcttgggtccagcagccttcagaggcaaaccgtcggccgccttccagctgcggcaggctggctgcaagagagttcatcgatctagctagctagctagcgtgtgtttagggtacctagctagctagcttcaacatatatatcttagttgcacacacagctcaaaagaaaggaaccatcgatcgatcggcagggagggatggggctgagggagatcgagtccacattgccgccggggttcaggttctatcccagcgacgaggagctggtgtgccactacctctacaagaaggtggccaacgagcgcgccgcgcaggggacgctggtggaggtcgacctgcacgcgcgagagccatgggagcttccagacgcggccaagctgacggcgagcgagtggtacttcttcagcttccgggaccgcaagtacgccacggggtcgcgcaccaaccgcgccaccaagacggggtactggaaggccaccggcaaggaccgcgaggtgcgcagcccggccacccgcgccgtcgtcgccatgaggaagacgctcgtcttctaccagggacgcgcacccaacggcgtcaagtcctgctgggtcatgcacgagttccgcctcgactcgccgcatacgccaccaaaggaggactgggtgctctgcagggtgttccagaagcggaaagacagcgagcaagacaacggcggcggctcctcctcgccgacgacctttgccggcgcgtcgtcgcagggggtcgttctagatctgccggacgaccagcgcccagcatgacgatgcccggcgcgtacgtagcagtggaccaccaccagccaggctcttccgccgtcgggttcgcactgccgccgcatgcgcaggacaacggcctcggcgatggcggcctggacgcgttgctgatgaacggagcgaccatgtggcagtacagctcatcggccctcgccgaccacttcccgccggaggaagtgaccgccgcgcccatgatggggctaggctccaggggaggaggtgacgggtgcagcttcttctacgacagcggcttcgacggcatggggttcccgcagggatggatgggctgaggaggcaaggcaccaactacaacgccatgggatgatggattgtgaaggaaacgattgaattgattccattagtggtagtattgtacagtaggtacgtagtgtgaggttaggtaattggaaattattagagtgcacctccccaatccaaaaaaaaaaacacaacggaatgaaaagtagatcgagcgcatgacgacaattgtatgtatctattcactcttactactatgcttgtacattaattaattagtataaacgaatccaagtacgtaccccccccaaaaaaaaaaaaaaag

SEQ ID NO: 863 - DNA, 1350 bp, Zea mays
  Predicted polypeptide sequence is orthologous to G509
aaaaaaaaaaaaaaaaaaaaaaaaaaaaaaaaaaaaaaataaaaaaaaaaaccacacccccactttgtcccggcctcgcgtccggagagaatcatcgagtcggatagagtcctgggctccaggcgctgcgtactgaacgaagaggcgtgtctcttcgatcgacctccaggcttccagctagctagctagcgagcgatggcattgagggagatcgagtcgacgctgccaccggggttcaggttctacccgagcgacgaggagctggtgtgccactacctccacaagaaggtggccaacgagcgcatcgcgcaggggacgctcgtcgaggtggacctgcacgcccgcgagccgtgggagctcccagaggtggcgaagctgacggccaccgagtggtacttcttcagcttccgggaccgcaagtacgccacggggtcgcgcaccaaccgcgccaccaggacgggctactggaaggccacgggcaaggaccgcgaggtgcgcagcagcagcagcgccaccgccgccgtcgtcggcatgcgcaagacgctcgtcttctaccggggcagggcccccaacggcgtcaagtccggctgggtcatgcacgagttccgcctcgacaccccgcattcgccgccaagggaggactgggtgctgtgcagggtgttccagaagacgaaagccgccgacggcgacggcgatggcggcgcccaagacggcgactcctcgtccccgccggccgccttcaccggcccgtcacggccacgcgccgtgtcagagccgccggaccattccgcgccgccggcgggaggaggctactactacggcctcgcgttcgggccgcggcaggtggaggtggcgcagcagcagtgttacggcggcggcggcgccacggtcgccgaccaccaccacggcttcacgcgagacagcgggggcgctgcagggtttggcgcgacgtggggacgaggagtcgccggcggtgagtgcggggctggctacctcgacatggacggcgcctttgacgtcatgatggccggctgctttggcggtggagacatggatgagttccctcaagtgtggaggtgatcgattgggcaacgtcacggggttattaccatcctcttgaaagaggagaatacatattgttcttactggagacactgggtcagttaaatttattggttgtttaatacacatggggtttggctggtagattagaatgggtttgaaatgctgtgagctcgacaaggttcattgtgaacgtgaactatcaaatgtaaattaattgggaaatcctttcttttctatattatttagtgtatagagttaattgataaaaaaaaaaaaaaaaagggc

SEQ ID NO: 864 - DNA, 1371 bp, Zea mays
  Predicted polypeptide sequence is orthologous to G509
caagatacatcagagtagctcattgcatagtttcagtgtgtaattatatatttgtctcctctagtgcagtactagagtctagtctagctagtttagattgagtctgcttgttcatctagcgcgtgttttggggtagctagctagctagacacgcgcacccggacaaacgcacgcagcagacaccaagcaggaatcatcggcggcaggcggagggatggggctgagggagattgagtcgacattgccgccggggttcaggttctatcccagcgacgaggagctggtatgccattacctctacaggaaggtggccaacgagcgctccgtgcagggaacgctggtggaggtcgacctgcacgagcgcgaaccatgggagcttccagcttcagggaccgcaagtacgcgaccgggccgcgcacgaaccgcgccaccaagacgggctactggaaggccaccggcaaggaccgcgaggtgcgcgacccggccgcccgccccgtcgtcgtcggcatgcggaagacgctcgtcttctaccagggccgtgcccccagcggcgtcaagtcatgctgggtcatgcacgagttccgcctcgactcgccgcgtacgacgacgacgccaccgaaggaggactgggtgctgtgcagggtgttccagaagcggaaagtcgacggcagcgagcaagacaacggcgtctccccctcgccgccggtctttgccggcgcatcgcagtcgcagggggtcgtcctgccgccgggccagcccagcgtggtggacgcgtacgtcgtagtagaccagccgggctcttcttccgtcggactcgcgccgccgcaggagaacctcggtagcggcctggacgcgttgctgacgaacggagcgatgtggcagtacacctcgtcggtcttcggtcacttgttgccgcaggaggcgaccagctccccgccggtgatggacctaggctccaggggaggaggaggaggagactacgggtgcagcttcttctacgacagcagcttcgaggacatggccaacatcgggttccgacaagggtggatgggctgatccaggaccaggaagcacacgtacgtgcgtgcagacttgcagtcatgcgatatggaatgtgcatttgtgaaggaagtgattgaattgattccattagtagtagcaccctctagtgttgtacagtaggtacgtatagtgtgagattggattattgggaattgttagagtgcacgggcctctcaaatccaaagaagtaacagcggaaagaaaagctagtagctagagcacacatgtatatttgcacaaggtagatggtttgatcaaccgcatgacacggcaattgtattatctctccacccctactaccatgtttgt

SEQ ID NO: 865 - protein, 278 aa, Oryza sativa
  Orthologous to G509
MGLREIESTLPPGFRFYPSDEELVCHYLYKKVSNERASQGTLVEVDLHAREPWELPDVAKLTASEWYFFSFRDRKYATGSRTNRATKTGYWKATGKDREVRSPATRAVVGMRKTLVFYQGRAPNGVKSGWVMHEFRLDSPHSPPKEDWVLCRVFQKSKGDGEQDNPTSAASPAATFAGSSQAAVPGQAAYSSDDHTGSSMGFAPRQNEILDSSSHQLLNLAMLQCNSVLDHFPQEVNSSPMMGLAGSIGIGDEYGFFYDTGFEETASLGGMRFPQGWS

SEQ ID NO: 866 - protein, 331 aa, Oryza sativa
  Orthologous to G509
MGLRDIELTLPPGFRFYPSDEELVCHYLHNKVVNQHRFAGVGGAAAAGGGTMVEVDLHTHEPWELPDVAKLSTNEWYFFSFRDRKYATGLRTNRATKSGYWKATGKDRVIHNPKLHAAAHRRASIVGMRKTLVFYRGRAPNGVKTNWVMHEFRMENPHTPPKEDWVLCRVFYKKKAETETESSYSMENEQEAVIAMARSAAAIKAGGCYSNSSSSHDPAAAGHHSPPPFPASLAACSSSHHYSSHPPPPPDHHHHHHMPVTGGGGGSLNEFIPTTSMALYSSIFDFSQHLDGGAVAASASAAGSRVDGGEQCGLMELGLEEHYNYNGLMPM

SEQ ID NO: 867 - protein, 324 aa, Oryza sativa
  Orthologous to G509
MAGLREMESTLPPGFRFCPSDEELICFYLRNKVANHRVASGTLVDVDLHAREPWELPEVAKLTAEEWYFFSFRDRKYATGSRTNRATKTGYWKATGKDRIVHEGTTRAVVGMRKTLVFYLGRAPNGQKTTWVMHEFRLETPNSQPKEDWVLCRVFDKKKPSTIEAEGGGSSGSDLFIPGATDGSTDPSSPTTMAPLLGSSPDPTVVDRFDHRSAAVPPLMVLMQGGGDQMISGSGVHCSNNDNSGSSSALLNLTMLQYSFLEHRPTGDDMAVGAHFGTCQGGNNDATMALGMGFEEHGMGEIIEMEPAWRQGGSNCVYRDELYF

SEQ ID NO: 868 - DNA, 1478 bp, Glycine max
  Predicted polypeptide sequence is orthologous to G519
gcggcacgtgtggcggtatcggctataaataaaggggtctctcttatgttctaagtttgaagcggcgccaccatagttggtgtagctagcgagggagggatatagggggaagcgtttattcattcattaagatggcatcggagcttcaattgcccccaggcttcagattccatccaacggaccaggagctggtgttgcactatctctgccgtaaatgcgcatcgcagcctatcgccgttcccatcatcgccgaaatcgacctctacaaatacgacccctgggacctacccggattggcttcctacggagagaaagagtggtacttcttttcaccacgggaccggaaatacccgaacggttccaggccgaaccgggcggcgggaaccgggttactggaaggcaaccggggcggataagcccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaaggttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagacggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggaccttccctaattaatatttgttaaaaaaaaaaaaaaaagggcggccgc

SEQ ID NO: 869 - DNA, 2117 bp, Glycine max
  Predicted polypeptide sequence is orthologous to G519
cccacgcgttcggtggctcctggcggcacgtgtggcggtatcggctataaataaaggggtctctcttatgttctaagtttgaagcggcgccaccatagttggtgtagctagcgagggagggatatagggggaagcgtttattcattcattaagatggcatcggagcttcaattgcccccaggcttcagattccatccaacggaccaggagctggtgttgcactatctctgccgtaaatgcgcgtcgcagcctatcgccgttcccatcatcgccgaaatcgacctctacaaatacgacccctgggacctacccggtaacattatcttcaacttctgatatattcttattcttaattcttaattcattcattttttgaattgttattgtacaggattggcttcctacggagagaaagagtggtacttcttttcaccacgggaccggaaatacccgaacggttccaggccgaacccgggcggcgggaaccggttactggaaggcaaccgggggcggataagccccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaagggtacatacatacatgaatgatgatgcatgccctttctagttcaagattattaggataggataattgcatgaaattacgactttgccctcaagttgaagctgaggatgataatcatttcccatgcaaattgcaaaatctatggccgtaatatcttaaatgttatctcaccgcgcagaaccttcaccagttgaagacttagccatcgcattaaaaacaataattgatgtggaaagagaaaaaattaaaaatataaaatcttctgccaaatcgcaattatcactttctatttttagaaattattccttcttatcactctcacctgccaccgcctgcgagattaaattaatcttacgttggtttccgattatgcagttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagaaggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggaccttccctaattaatatttgttgaattattatcattagtatgtgttacatctaatttagtaggtgctcctttctcttgttttttaggtcctttttaatcgagtatcgtgatatcctactgtgtgtttacttttttattttctatctttagtttaatttattatgtaataatgtaattaatagtctaaaacaagtttagcttttttttttcttt

SEQ ID NO: 870 - DNA, 2799 bp, Glycine max
  Predicted polypeptide sequence is orthologous to G519
cgcatccacgttaataaatggaaattcgagacttttctcccactcgttccacttgggctcgctttgcacctcgctcgcgaattccggcgataccacttgctccgaacagctcgagtccgtgtgcagcttcgggattgaatccgacgggtcgaagtacatgtaatccgtcttcgccgtcgcttgcggcggcgcaggcaccggcacaggcggcggaagacaacctcctccgcttttcagaatctccggcttcctgtcttcgatctccgaggattcgatatttcgggctatgagcaacatcgctgcttggttgcagtttctcgatcgtgcccttcttgttgtaaatacggcaaagcacccaatcatccaactgcgacaaaaaaaaaaaaaaaatcacaaccaccgtaagattatttcttcattttcatttattattataagtattgcaatcggaggcaggtgagagagataaagaaggaatagttttctaaaaatggaaagtgataattgcgattggcagaagatttatttctttccgcatcaattattgtttttttattggatctaatgtgatggctaagtttcttgggcccaagcccagaccacatgctggcaagtcttcaactagtgaaggttccgcgcggtagttttcacatgataacatattacgaccatacattttgcatggtttccaccaaaatcctggacttatcctcagccgatgagagcgtagggacaaagtcgtaatttcgagcaataatcttgaactagaaagaagtacggagtgtatatacccttagggtgttctttttgcgaacggagcgatctacgtctgcgagacgatactcgtgcatgatccaattgcttttgtcccctttaggagctttccctgcgtaaaacaccaaagcttttttaatcccaaccggtttgggctgaccaatgggcttatccgccccggttgccttccagtaaccggtgccagccgcccggttcggcctcgaaccgtttgggtatttccggtcccgtggtgaaaagaagtaccactctttctctccataagtagccaatccgggtaagtcccaggggtcgtatttgtagaggtcgatttcggcgatgatgggaacggcgattggctgcgacgcgcatttgcggcagagatagtgcaacaccagctcctcgtccgttggatggaatctgtagctagggagggatatatatctgagtaagatggcatcagagcttgaattgcccccaggcttcagattccatccaacggacgaggagctggtgttgcactatctctgccgcaaatgcgcgtcgcagccaatcgccgttcccatcatcgccgaaatcgacctctacaaatacgacccctggggacttacccggattggctacttatggagagaaagagtggtacttcttttcaccacgggaccggaaatacccaaacggttcgaggccgaaccgggcggctggcaccggttactggaaggcaaccggggcggataagcccattggtcagcccaaaccggttgggattaaaaaagctttggtgttttacgcagggaaagctcctaaaggggacaaaagcaattggatcatgcacgagtatcgtctcgcagacgtagatcgctccgttcgcaaaaagaacaccctaaggttggatgattgggtgctttgccgtatttacaacaagaagggcacgatcgagaaactgcaaccaagcagcgatgttgctcatagccgaaatatcgaatcctcgggagatcgaagacaggaagccggagattctgaaaagcggaggaggttgtcttccgccgcctgtgccggtgcctggcgccgccgcaagcgacggcgaagacggattacatgtacttcgacccgtcggattcaatcccgaagctgcacacggactcgagctgttcggagcaggtggtatcgccggaattcgcgagcgaggtgcaaagcgagcccaagtggaacgagtgggagaaaagcctcgaatttccatttaattacgtggatgccactctcaacaacagcttcatggcccaattccagggcaataatcagatgttgtcgccgctgcaggacatgttcatgtactggcccaacaagtccttttgagcacatcatgatggttttaaattacgatccgcaattgctcttaagattttctgactcaccatgcgaccacaatcgtaatttaaaaccatgtcacataaaatccacgcgcgccgcccattcgcatgctgcacggtagcacgagactcaaggtccatgagtgtgcctgtgcgaccacacacatacgattattgatcaagttagcttagctaggccaaagtaagaaagaaagaaacattgaagctggaaacgcatgtgttggctccaccgtttgctttggtattttgctatgtgatgatgacgacgacgatccaacggtgcatgtgtgttgacctgttcctagtagtagtagtagcatgtgtacagctattgtagaatgtagataggtacactactacacgttgttgtcatgtgatcatagaaaggtctctcaccgtacaaaaaaaaaaaaaagtgatagaaggtctatttgatagaccttctaattaatatatgttgaattattattagcatgtgttacatctaatttattaggcgtgccctttgtcttttctcatttttttaggtctttttaaattgagtatcgtgatatcctactgtgtttactttttcatttcaatatcttttgttttttatgtactactataatataattaatataaaacaattttagtt

SEQ ID NO: 871 - DNA, 1238 bp, Glycine max
  Predicted polypeptide sequence is orthologous to G519
ttttttttttttttaaacataatagtagtacgaagtcatttttgtcaaaaaacagtcttcttcaaaaccttaaagacaaataagataaatattttgtttccacacaatttatttaatatcaaactattaattgcgactagatcatgtaaacagttggattcatcatgttcatatatgaatgcttctcttttttgtttttttgtttttttataataataatcatctacgcgcaccagcacggacacactcacggacattcactcagtctcgtgcttccatgcaatgcagcaggcacgtcaaaaatgcatcatgcacacacaaagcaaagaacgacgtcgtgccgtctcgtgcgtgttgatttcagaagggcctggagaggtacatgaagatatcctggagcggcgacatctgattattcccgagagtggcatccatgtaattatacgaaaactcgctgttgccctgcctcttccgctcgctctgcacctcgctcgcaaactccgccgacaccacctgctccgaacagctcgactccgtcgtgtgcagccgcggcaccgagtcggaagcctcgaagtacaggcaatccgccgccgtatactccggcttcacgtcttccatttcgtaacattcaattttgtggacaccactcggtggtggcggtgctggttgctgcttctcaattgcacctttcttgttgtaaattcgacacagcacccagtcatccagccttaagctgttctttttgcgaaccgaacgatccacgtcggcgagacgatactcgtgcatgatccagttagttttcactcccttgggcgcttttccggcgtaaaaaaccaatgctttcttgatcccaacaggtttcggtttgccaaccggtttatccgctccggttgccttccagtatccggtccccgcggaccggttcggccgcgaaccgttcgggtacttgcggtccctcggcgtgaaaaaataccactctttctctccgtacaaagccattcctggaaggtcccatgggtcgtacttgtagagatcgatttcggcgattattggaactgcgatttcttgcgaagcgcatttgcggcagagatagtgaacgacgagttcttcatcggtggggtggaatcggaatccagggggtaagtggagttgtgttgctgcggccattgttgagaaagaaaattgggggaaagtgaagtgaaaaggaaaaatgaaatgaaattgtgtggtggcgtggg

SEQ ID NO: 872 - DNA, 1517 bp, Glycine max
  Predicted polypeptide sequence is orthologous to G519
accataattaaccacatccaacattatttacgcatgctaatttatttcctactaattgtacgctagctaatccatccttgatccaagcctaaccatacatcactcaccaagtcaatagatgaacaacaatttgatgtacacctccatcacctttcaattctactactatacttccccggcattttagccagctcgtctacactaatcaaatatagtactgacgaatgatcctagcttacacaaccaaatgtacatcaaatctaagtgtattaaattaatcaattattaacgcatcattaatcaagtacttatttttaaataaccacacattaatatactcaatgatgtattaatacttcattaatttaatatactcataattcatcatgttcatataagaatctttcttcttcttcatcttggtgcttttttgtttttttttgtaataatcgtctacacgaaccagcacggacacactcacggatcttcactcagtctcgtgcttccgtgcaaatggtgcagtggagcagctactgcaaaaatgcataatgcatacacacaacacagaacgacgtcgtctcgtcgtggtggtggtgcgtgttaattgcagaaggacttggagaggtacatgaaaatatcctgcagcggcgacatctgattattcccgagagtggcatccacgtaattatatgcaaactcgttgttgttgttgctgcccctcttcggctcgctctgcacctcgctcgcaaactccgccgacaccacctgctcggagcagctcgagtccgtcgtgtgcagccggggcaccgagtcggaagcctcgaagtacaggcaatccgccaccgtcgccgccgtatacggcggatctggcggcagaatctccggcttctcgtcctccatttcggaacattcaattttgcggaccccactcggtggtggtagttgttgcttttcaattgcacctttcttgttgtaaattcggcacagcacccagtcatccagccttaagctgttctttttgcgaacggaacgatccacgtctgcaagacgatactcgtgcatgatccagttagttttctctcccttgggcgcttttccagcgtaaaaaaccaacgctttcttgatcccaaccggtttcggtttaccaactggtttatccgctccggttgccttccagtacccggttcccgcggaccggttcggccgcgaaccgttcgggtacttgcggtccctcggcgtgaaaaaataccactctttctctccgtacaaagccattcctggaaggtcccaagggtcgtacttgtacagatcaatttcggcgattatgggaaccgcgatatgttgcgaagcgcatttgcgacaaaggtagtggatgacgagttcttcatctgttggatggaatctgaatccagggggtaagtgaagttgtgttgtagtggccattgttgagaattgagaaagaaaattggagaaactaaagagtagaaatgtgtaggaattgtgtggtggttgggccc

SEQ ID NO: 873 - DNA, 680 bp, Glycine max
  Predicted polypeptide sequence is orthologous to G519
agccctctcttgatattaaatacgccgcagcaccgagtcatccagctttcagttgtcttttgccgcgaggaccgattctcgtctagaacatcgatactcgtgcatgatccagttagttctctctccccggcgcgctcctccagcgtaaaaaaccaacgctttcttgatcccaaccggtttcggtttaccaactggtttatccgctccggttgccttccagtacccggttcccgcggaccggttcggccgcgaaccgttcgggtacttgcggtccctcggcgtgaaaatataccactctttctctccgtacaaagccattcctggaaggtcccaagggtcgtacttgtacagatcaatttcggcgattatgggaaccgcgatatgttgcgaagcgcatttgcgacaaaggtagtggatgacgagttcttcatctgttggatggaatctgaatccagggggtaagtgaagttgtgttggtgtggccaaaagtgaatggtgaagtgtgatgcgagaatagtttatttgtagaactttggaagagaacataatggacatgttgctagtggctacagtttgtcatttaaagaagaaaaaaaaaaacattttcatattttcagcacaattataagggcattattccatttaaaaaaaaaaaaaaaaaaaaactcgagactagttct

SEQ ID NO: 874 - DNA, 1818 bp, Glycine max
  Predicted polypeptide sequence is orthologous to G519
  misc_feature (1371)..(1371): n is a, c, g, or t
ctttttttttttttttttttttttttttttttttttttttttttttttttttttttttttttttttttttttttttagcaatgaaacaagaattttctactaggggtccttagtccttacatgtcgacacaattcctaacatagctaatggatcttcattcttcacccagttgagatcatttttcttatttttaggtacctatgatctcattttttcctagtgatcaatggcagtcaaattcaacaatcccaagaacagataatagtcaccacacgtgcagaccaaagccggcatgagtagtagttaggtacagtagtatagtaggtacgcttgaatgtgatttttttgttgtttttttttttaacgaattttaaaaataaatgtgagacccgtatttccttcttggggtcccattgaccctaaaaaaatcaaaatgtctttggtaggtacgtgaacatttcttgccacggtgagagatggttgatttggtattgaacctgaggggcaaaagcgtcatctgaggtcaggtccatgaaattaaaatcgaagcccaaggctgggtcggggcccaactcaagatcattccacttgggctcgctctgcacctccttctcgcacgtgccatcgggcgaaaccacgtgctcggagcagctggagtccgtgtgcaacctgggccccgaatccgacgtgtccatgtacaattggtcgttcctgaaatcatcgtggccgtacatcttgatctgaggcttggtctcgtgctggaactgaacctcctcttctgataacttggccactttctgatccaccaccgcaacaccattgtacttctcaatcttccctttcttgttgtaaattcggcacaaaacccaatcatcaagctgccattccaataagcacaacagttaaaaaaattgtccaaatcacatattatttctacctaaccaaactttgaaacattattaatccctgttcttaatcttagttaaaaaattaaaaaaagaattttgtttatgtatttattaaaatacataaaattatgtattaatgactttttaacgctatctcacattaaatattctttttattcctcaactaacacctaacgatattgattagcaagaatcttataattattattaataagattgttatcgggacataccctcaagttgttggtggtggtgttttttttttgaggcggatctgtcgacgttggctaagcgatattcgtgcatgatccaattggtcttcactccctttggggctttgcccgcgtagaacacgagggccttcttgattccaagggctttcggttttccgatcggtttgtcagctccggtagccttccagtacccgcttccggcagccgnagttcggtctcgaaccgtttgggtattttcggtctcgaggagagaaaaagtaccactctttctcaccgtaaagagccatctctgtacataaaaacataaataataggactttaaggtggagagaaaaaaaatgtagtagaattaagaccctaatgaaattaaaaaaggcaaaagaatacagagactagagtgagaaaagaaaaaaaggtacctggaagctgccatggatcaaacttgtacaaatcgatttctttgatgatgggaacagcaatggtttgtgcagcacactttctacacaagtagtgattcacaagctcatcgtcagtggggtggaatctgaacccgggtggtaattggagttctcctggcattcgcgtttcttctgtcctttgtgagttctagtgttactttgcccacgcgtccgcccacgcgtccgcggacgcgtgg

SEQ ID NO: 875 - DNA, 1497 bp, Glycine max
  Predicted polypeptide sequence is orthologous to G519
tttttttttttttttttttttttttttttcacaaaaatgaaacccttacattttcatttcaattgctgcttactttgaaaattaaaaaaaaatatatatatatatatatataatataatataatataatatttcacagacatacaaaaaaatcctactacaatagcaatgaaacaagaattttctactaggggtccttagtccttacatgtcgacacaattcctaacatagctaatggatcttcattcttcacccagttgagatcatttttcttatttttaggtacctatgatctcattttttcctagtgatcaatggcagtcaaattcaacaatcccaagaacagataatagtcaccacacgtgcagaccaaagccggcatgagtagtagttaggtacagtagtatagtaggtacgcttgaatgtgatttttttgttgtttttttttttaacgaattttaaaaataaatgtgagacccgtatttccttcttggggtcccattgaccctaaaaaaatcaaaatgtctttggtaggtacgtgaacatttcttgccacggtgagagatggttgatttggtattgaacctgaggggcaaaagcgtcatctgaggtcaggtccatgaaattaaaatcgaagcccaaggctgggtcggggcccaactcaagatcattccacttgggctcgctctgcacctccttctcgcacgtgccatcgggcgaaaccacgtgctcggagcagctggagtccgtgtgcaacctgggccccgaatccgacgtgtccatgtacaattggtcgttcctgaaatcatcgtggccgtacatcttgatctgaggcttggtctcgtgctggaactgaacctcctcttctgataacttggccactttctgatccaccaccgcaacaccattgtacttctcaatcttccctttcttgttgtaaattcggcacaaaacccaatcatcaagcctcaagttgttggtggtggtgtttttttttgaggcggatctgtcgacgttggctaagcgatattcgtgcatgatccaattggtcttcactccctttggggctttgcccgcgtagaacacgagggccttcttgattccaagggctttcggttttccgatcggtttgtcagctccggtagccttccagtacccgcttccggcagcccggttcggtctcgaaccgtttgggtattttcggtctcgaggagagaaaaagtaccactctttctcaccgtaaagagccatctctggaagctgccatggatcaaacttgtacaaatcgatttctttgatgatgggaacagcaatggtttgtgcagcacactttctacataagtagtgattcacaagctcatcgtcagtggggtggaatctgaacccgggtggtaattggagttctcctggcattcgcgtatcttctgtcctttgtgagttctagtgttactttgtttgcgacttggaacccccttctgtcgtcttctcgcagcagta

SEQ ID NO: 876 - DNA, 1498 bp, Glycine max
  Predicted polypeptide sequence is orthologous to G519
ggaaagcaagatttttcattcagttgtttcctttgaatggaaaagtagaaagttgtatattacaaaatatatgaaaaaatcatatgctggaatagcaatggaacaagaattttcctaagtgagtccttacacccacacattaaccctccaataacctatcatcaatttgctcacttactttttacttactgcagcacctaatctccttctctcattttttctttacaccaagaaccaatccaaatagcccatttcagccgaattcaacattccctcatctctctagaacaaagaataagaatagttgctaagcttggcctagcccacatcacatgttaggtgcaatgcaattgcatacaaatgctgacttttccttttaaaaaaataataaaacaaagatatttgcgggtcccatgttgctcaaaacgtttcgttttcagttttcacatcttctgtaggtacatgaacatgtcctgcaagggcgagagctggcccatttgatactgaacagtgccaaaaaggtaatcatccacggaaaggttattatcgtccaagtaattaaactgaaaatcaaacgcgttttctagctttaggtccagatcatcgttccacttggggtcgctctgcacctccctctcgcacgtgacatcgggcgaaaccacggtgctccgaactgctcgagtccgtgttcaaccttggcaccgaatccgaagtctccatgtacaattgctcatttcctagcttatgaatctctggcttcgtctcgttctcgtgctcaaaactatgaaccatctcaacattcatcttcgctgcgcctgtgttgtatttctcaatcttccctttcttgttgtagattcgacacaacacccaatcatcaagcctcaaagttgttgttttttttttcttggaggcagatcggtcaacattggcgaggcgatattcgtgcataatccaattggttttcacacctttgggggcttttcgggcgtaaaaaaccagagctttcttgatccctagcgctttcggttttcccgatcggtttatcagcgccggtggctttccaatagccgcttccggcggcgcggttcggccgtgaaccgttcgggtatttccggtcccgaggagaaaagaagtaccattctttctcgccgtaaaaaccaatttctggaagctgccatggatcaaacttgtacaaatcgacctctttgatgacgggaaccgcgattggttgaccagcgcacttcctacacaagtagtgattcaccaattcttcatcagtggggtgaaatctgaacccaggtggcaactctaattctcccttcattcgcgcgcgtttcttcttctctttcttcttgtgtgttcttcttcccttttaactgaagattcttctaatttgcaagccttatgctgatgttgttgttgttgattatgttggttttcttcttcttcttcttggctctgctttgctttgctaagcgctcgagccgaattcagagct

SEQ ID NO: 877 - DNA, 1252 bp, Oryza sativa
  Predicted polypeptide sequence is orthologous to G519
ccggccgggagactacctccctctatatatccccccctccgcccgccatctccccccattcgcacgaggcctcacaacccacaacattttcaaacaacgcaaagcagtagcagcagcgagaagcaagcaagaagcgatggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaccgcgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccgccgtcgccgccgccaccatccccaggaacaacagcagcctggtcgtggactctgagctacgacgatttcagggcttgtacagtgtgctgtcatgcttgcgtcggcgacgattttactcttatttttttctttttatgggtgaagggtcaactcctccgcctttccttttgttattttctctctttgtgtctttacttattatttgtgctctacgttctcacgttgtatcccaatttctatctccattttttttcgacactattgcatttttttacttgtttgatattccttttttattttacttatttttctacattttttctaatcttactctctcttttataatattatttttatttaat

SEQ ID NO: 878 - DNA, 1344 bp, Oryza sativa
  Predicted polypeptide sequence is orthologous to G519
cacgaggggtcgccacgcagccgcagcatcggcagcagcagcagcagcagcagcagcagcgttggtggtggtggtgtgtcatcaccaacattttcacgagaggagaaggatggaaatggcggcggcggttgggggcagcgggaggagggacgcggaggcggagctgaacctgccgccgggcttccgtttccacccgaccgacgaggagctcgtggtgcactacctctgccgcaaggttgcccggcagccgctccccgtcccaatcatcgccgaggtcgacctctacaagctcgacccctgggatctccctgagaaggcgttgttcgggaggaaagagtggtacttcttcacgccgagggaccggaagtacccgaacgggtcgaggccgaaccgcgcagcggggagagggtactggaaggcgacgggagccgacaagccggtggcgcccaaggggagcgcgaggacggtggggatcaagaaggcgctcgtgttctactccgggaaggcgccgaggggggtcaagacggactggatcatgcacgagtaccgcctcgccgacgccgaccgcgccccgggcggcaagaagggctcacagaagctggacgagtgggtgctgtgccggctgtacaacaagaagaacaactgggagaaggtgaagctggagcagcaggacgtggcctccgtggcggcggcggcgccgcgcaaccaccaccatcagaacggccgaggtcatggacgcggcggcggctgacaccatgtccgacagcttccagacgcacgactccgacatcgacaacgcctccgccggcctgcggcacggtggctgcggcggcggcggcttcggcgacgtggcgccgccgaggaatgggttcgtgacggtgaaggaggacaacgactggttcaccggcctcaacttcgacgagctgcagccgccgtacatgatgaacctgcagcacatgcagatgcagatggtgaatccggcggcgccagggcacgacggcggctacttgcagtccatcagctcgccgcagatgaagatgtggcagacaatcctgccaccattctgagatggatggagcaagaaaaaggttgctgtagataaagggcggaaataggagtgatggctagaaaattattagatttactagaacgaaaatgattagaaatctggcaagcatgattctgcaaatgtggtggtagatgcttgcagtatgtaattcatttgttcagtatatgcatttggtaatctgcaaaacaaaaaaaaaaattctcataaaaaaagcgaaacatatatgattttatccttcattagtctgaattctgaaatatatgcttgatggtttt

SEQ ID NO: 879 - DNA, 1159 bp, Oryza sativa
  Predicted polypeptide sequence is orthologous to G519
tcgacccacgcgcccgcccaccaccctcattccctcaagtcccaagatcgaacacctcgtgtccatggcggcggcgaagcggcgagtgcgcgacgcggaggcggacctgaacctcccgccgggcttccgcttccaccccaccgacgaggagctggtggcgcactacctctgcccgcgcgccgcgggccgcgccgccccggtccccatcatcgccgagctcgacctctaccgccacgacccatgggacctcccccaccgcgccctcttcggccgccgcgagtggtacttcttcaccccgcgcgaccgcaagtaccccaacggctcccgccccaaccgcgccgccgcctcgggctactggaaggccaccggcgccgacaagcccgtgctgcacaacggcaggacggccgggatcaagaaggcgctcgtgttctaccacggcaagcccccccgcggcgtcaagacggagtggatcatgcacgagtaccgcctcgccaagaagggcggcgccgccgccgccgcgggcgcgggcgcgctcaggctggatgactgggtgctgtgccggccgcgcggcaagaagaacgagtgggagaagatgcagagcaggaaggaggaggaggaggccatggcggcggcgcagtcgtggggggagacgcggacgccggagtcggaggtcgtcgacagcgacgcgttcccggagatggactactcgctgccggcggcgtcgttcgacgacgccctgctgcccaaggaggaggcgcgcgacgacgactggctcatggggatgagcctcgacgacctccagggcctcggctcgctgctgcaggccgacgacctctccatgctcgcgccgccgccggcggcgaagacggagccgctcggcgcgccattcttctgagctctctctctctctctctctctctctctctctgtgactgcaccactgtatataaattcagagttttcagacatgttcagtattcagagttctcaggcaagttcagaattcagagatggttaaggattagtggcttatgagcagtatgatatgcaggttagtttctagtttagcagtgttactccagattggagatttgattaatgatttgattctaattaatgtagtatactgagtgttactcatcaaaaaagattcatcaga

SEQ ID NO: 880 - DNA, 745 bp, Zea mays
  Predicted polypeptide sequence is orthologous to G519
  misc_feature (688)..(688): n is a, c, g, or t
agtcctcctctcctccctcctcccacctagatcagcagcagaagagaaggaaaattcagtagcagtagaactcagagcagcggcagcagaactgcggcgagctgatccagcgagagaactacagcgaggtttgttggatcgccgacccgaccggagatgagcggcggacaggagctgaatctgccgccgggcttccggttccacccgacggacgaggagctggtgacgcactacctctgccgccgctgcgccggcgcgcccatcgccgtccccatcatcaccgagatcgacctctacaagttcgacccctggcagctcccaaagatggcgctgtacggcgagaaggagtggtacttcttctccccgcgggaccgcaagtaccccaacgggtccaggcccaacagggccgccgggtcagggtactggaaggcgacgggggccgacaagcccgtgggcacccccaagccgctggccatcaagaaggcgctcgtcttctacgccggcaaggcccccaagggcgagaagaccaactggatcatgcacgagtaccgcctcgccgacgtcgaccgatccgcccgcaagaagaacagcctcaggttggatgactgggtgctgtgccgcatctacaacaagaagggcggcttggagaagccggcgtccgtggaccgcaagccggcggccatgggcnggctacgggggtcctcctggggccatggtgagctccccgcaggagcagaagccgtca

SEQ ID NO: 881 - DNA, 2405 bp, Zea mays
  Predicted polypeptide sequence is orthologous to G519
cgattgggtccctcgaggccggccgggattccattccctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgccctcgcggacgtcgaccgctcggccgccgcacgcaagaagaccaacaacgcgctcagggtaattcactacaccatgacctttctcaggagaacatatttatctccccgaaatactgacacttgcagttagagggaaaaaatatagagagaagtaaaaaaaaaaagattgatgtttgattttaccaatgctgcaacaagaaacagtggatcgaatcgaaatgtgttgttaggcttgcaactatatatgcagattcttagttaagaggaattgaaaaaggctctagagacatgtaaagcgcgggcggcgtggcgtcacggctcacgcacgccgcgatagagacaagcgcggcaaccatggtccatggccggcgcagagccgccgcctgatcttatcgcccgcgcacaaattaccacatgcgcggcgcgcaccggatccgacgtcacgtcgacctcatctccaagcctcttccaaacactccaatgcgtactggatgactgggtgctgtgccggatctacaacaagaagggtgttatcgagcggtacgacacagtggacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacaactccgtgccgtggacgacgcaccacacgcacacggacaactccagcagcggctccgagcgcgtgctctcgccgtcgccggacctgcccgaccgcgaccacgccgagagccagcccgccgccgccgccgccgccgccgggtggtggcctgtcggaggcgactggggcagcgccgccgaggacgggttcatggtcgacgtcgacgtcgacgacgggagctcgctgttcgggccgctgtccccggggctgttcgcgcgcgtcgacgccgccgcgttcggcttcggcgacatgctcgcgtcgtacctgcacaaaccgttctgatgcaacgcgacgcgacgcgacgcgagcgcggccaccccgcgcctgcgtgctcctctaggccactgaccactgacatggacattctggtcgtcgtgtagctcggttcaggacgaatcgagagccggccggtctaggtgtagtgctgcgaaaccaacaccaccgtgcaggcacactctccgcgggcggcagatcgacggacaatcctgcgcccgtaggtatataccggtcgtcgatcaggtgttcatcagttcttcattcattcaggtcgacgtgcaactggtaattgtacaagatcttgggcagctgccgtatggagatcgatgagtgccgagttagcatggaggacgactggtggtcatggttggtacagagctagctagccgtccgatcgggtatcggattaatctgattgccagttttgtttttttttggtcgcgtcaagtagctgacatcttaagaatgaagcctactggattcagaggcctgttgatggtaatggtatggtgtatgtatatcgtctagtttagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaagttgttgtaagatgtaaaaaaaaaaaaaaaaatcgaagcggccgca

SEQ ID NO: 882 - DNA, 842 bp, Zea mays
  Predicted polypeptide sequence is orthologous to G519
cattgggtacctcgaggccggccggcggcccattccaaagctctcgagacttcctcagcaatcaatcagctttccagcgatcggcagctcctcgatcgtttcgaagctccaatccgcccggccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcaggctggatgactgggtgctgtgccggatctacaataagaagggcgttatcgagcggtacgacacagtgaacgacgacgacggcgacggcgccgtggccgaagacgtcaagccggtgccggcgccggcggcgtcgaagaacccgcgtgccagtgcccgcgtaggggcagcagcggcggcgccgaatgaaggtggagctccccgagtaccgcggcggctactacgactacgacgacctg

SEQ ID NO: 883 - DNA, 1617 bp, Zea mays
  Predicted polypeptide sequence is orthologous to G519
cattgggtacctcggggccccccgggccccgcccgaagctctcctcccctcttcctaccattagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctcgccgacgtcgaccgctcggcgcgcaagaagaacagcctcaggttggatgactgggtcctgtgccgcatctacaacaagaagggcggcgggctggagaaggcggcggcgccggcggccggcggcgaccacaagcctgtgttcgccacggcggcggtgagctccccgccggagcagaagccgttcgtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcgtcggccacgccggcggcgacccgctgctgcaggacatcctcatgtactggggcaagccgttctagacgacaccgcccatcatgtcctgaggggaggtgggggtggcgaagcatcctcggctgcggttggttggttgattgatctgtcttgggcagcgcaatgcaatgcaaccgcacggtgtgggcttgactcaggcgagccgccattgttgacttgcaaggaggatataatatgaaactatagctggattacatggagaggcggcaatgagaccgtctggccccgccggaagggagacggagacggagacggatggcgcagtgcatcgggtgtggtggatcgtgcgcggcatgtgtgtgtgtggctgtacatatacatactgtacatgattggttcagtgcagggtttctgttccttcattgattagttattatactaataagtactagtaattttgtaagggcttgtagttgcagtctccgtactggtggtaggtagtgcaggccatattcgtcatcgccaagcttcgagtgtacttactcctacaatatatattttacagtatatattgtagctgtgttggctcttccggaaaaaaaatggaaggggaaaatagggattatgttattttgattaaaaaaaaaaaaaaaaaaaactcgagggggggcccggtacc

SEQ ID NO: 884 - DNA, 2122 bp, Zea mays
  Predicted polypeptide sequence is orthologous to G519
ccgggaagctctcctccccgcttcctaccattagcagcagcactgcagcagtagccacagccagcaccagcagacagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctcgccgacgtcgaccgctcggcgcgcaagaagaacagcctcagggtaagaacaagcgcgctccgccgccgtccgtccgtccgttggcgtcgtcaccgtccaaatcaaacaaaaagaacttggcgataatgtgtcgctttcgtaatgaacgcggggataagcgtggcccatggttttgggccgctgaattttttttacgtgggccatgctaggtggggtggggggctgcaccgtgcccaatgattcgaccgcgtcgcagtcctccgcgcgcaagtattcgatgcccatgggtcatggcgtacagatcattttcgcccgtcgcgcccctgcgactgcgacggcgacggagagccagtggggtctgggattagacatcgaaatgacgctttgtgattctttagctcatccatttctcgtcagctgcacggatgacaaactaagttctctattgtgttgacgggtgcagttggatgactgggtcctgtgccgcatctacaacaagaagggcggcgggctggagaaggcgccggcggccggcggcgaccacaagcctgtgttcgccacggcggcggtgagctccccgccggagcagaagccgttcgtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcctcggccacgccggcggcgacccgctgctgcaggacatcctcatgtactggggcaagccgttctagacgaatcatgcatgcaaacacccatcctcggctgcggttggtttggttggttgatctgtcttgggcagcgcaatgcaatgcaaccgcacggtgtgggcttgagtcaggcgagccgccattgttgacttgcaaggaggatataatatgaaactacagctggattacatggagaggcggcaatgagaccgtctggccccgccgcggaagtgagacggagacggagacggatggcgcagtgcatcggatgtggtggatcgtgcgcggcatgtgtgtgtgtggctgtacatatacatactgtacatgattggttcagtgcagggtttctgttccttcattgattagttattatactaataagtactagtaattttgtaagggcttgtagttgcagtctccgtactggtggtaggtagtgcaggccatattcgtcaccgccaagcttcgagtgtacttactcctacaatatatattttacagtatatattgtagctgttggctcttcggaaaaaaaatggaagttattttgattattctgctagaaaaaaaaaaaaaaaaaaaaaaaaaaaaaaaaaaaaaaaaaaaaaaaaaaaaaaaaaaaaaaaaaaaaaagtgtctagtagtgcacaatagctgctccccgccgttgcggtcttcgtaactacgctttcaaacgacttcggtatctaaagcacgctggagtataccgaagcctacacacagcacctact

SEQ ID NO: 885 - DNA, 861 bp, Zea mays
  Predicted polypeptide sequence is orthologous to G519
  misc_feature (838)..(838): n is a, c, g, or t
cattgggtacctcgaggccggccggcatgcctttcgcgagagaaaggggtcgaatcggcggctgatttgacccggctcgctattagagctgcgaaagtgatccgagcagtcacggtttcggaagcggcgcgtcggccggaggagaaacgcaaccagctgtcgaggagctatgagcagcggtggcggaggcagagtgccggcggcggcggcggcgcagtcgcaggagctgcagctaccgccggggttccggttccacccgacggatgaggagctggtggtgcactacctctgccggcgctgcgccgggctgcccatctccgtgcccatcatcgccgaggtcgacctatacaagcacgatccctggcagctcccaaggatggcgctgtacggcgagaaggagtggtacttcttctccccgcgggaccgcaagtacccgaacgggtcgcggccgaaccgcgccgccggcgccggggtactggaaggccaccggcgcagacaagccggtgggcacgccgaagccggtggccatcaagaaggctctcgtcttctacgccggcaaggcgcccaagggcgacaagaccaactggatcatgcatgagtaccgcctcgccgacgtcgaccgcaccgcccgcaagaagaacaacagcctcaggttggatgattgggtgctgtgccgaatctacaacaagaaaggcgcgctggagaagccgaccggagccggcggcagggccgaggccagcagccagggcgcgctggggtccatgtccatgggctcgccgccggagcagaaaccgtccgtaaacacgtctgccacggcaacggccgcggccgccgactngagtgctcgtcgaaccaggaatt

SEQ ID NO: 886 - DNA, 2162 bp, Zea mays
  Predicted polypeptide sequence is orthologous to G519
  misc_feature (607)..(608): n is a, c, g, or t
tcggcacagctctcctcccctcttcctaccttagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaagtacgtcccgtcgtcctcggtcttcttgcagcagcagtagcagccgtgaaccaatttcctgtgcggccgtgacgatggcgagctaatcgatcgattgctaactctctgtgtgcagggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctggnncgacgtcgaccgctcggcgcgcaagaagaacagcctcagggtaagaacaagcgctccgccgccgtccgtccgtccgtttggcgtcgtcaccgtccaaatcaaacaaaaagaacttggcgataatgtgtcgctttcgtaatgaacgcggggataagcgtggcccatggttttgggccgctgaattttttttacgtgggccatgctaggtggggtggggggctgcaccgtgcccaatgattcgaccgcgtcgcagtcctccgcgcgcaagtattcgatgcccatgggtcatagcgaacagatcattttcgcccgtcgcgccctgcgacggcgacggcgacggagagccagtggggtctcactgggattagacatcgaaatgacgctttgtgattctttagctcatccatttctcgtcagctgcacggacgacaaactaagttctctattgtgttgacgggtgcagttggatgactgggtcctgtgccgcatctacaacaagaagggcggcgggctggagaaggcggcggcgccggcggccggcggcgaccacaagcctgtgttcgccacggcggcggtgagctccccgccggagcagaagccgttcgtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcgtcggccacgccggcggcgacccgctgctgcaggacatcctcatgtactggggcaagccgttctagacgacaccgcccatcatgtcctgaggggaggtgggggtggcgaagcatcctcggctgcggttggttggttgattgatctgtcttgggcagcgcaatgcaatgcaaccgcacggtgtgggctttgactcaggcgagccgccattgttgacttgcaagggggcgcgtgggtgaaactatagctggattacatggagaggcggcaatgagaccgtctggccccgccggaagggaggcggagaccggagacggagacggatggcgcagtgcatcgggtgtggtggatcgtgcgcggcatgtgtgtgtgtggctgtacatatacatactgtacatgattggttcagtgcagggtttctgttccttcattgattagttattatactaataagtactagtaattttgtaagggcttgtagttgcagtctccgtactggtggtaggtagtgcaggccatattcgtcaccgccaagcttcgagtgtacttactcctacaatatatattttacagtatatattgtagctgttggctcttcggaaaaaaatggaagttattttgtttaatataaaattattaaagaatattttttttctcatcatttttactttttaattttcacacttcctctttaaaacgggggggccgtttttaa

SEQ ID NO: 887 - DNA, 1507 bp, Zea mays
  Predicted polypeptide sequence is orthologous to G519
ggcgcggggaaacaggcagctctccacggacaacgcgattctatttagttatctggcggctgccagtgccagccagccgcctttcgaaaccgagcacgagggagccgacgtggtggtctctggaacctggttcgagcgagcgagcgatccatctatccagccgcccgccgggaatttctgtgacgaggaggaggaggaggagggggtatggcaatggtggcgtcgcagggaggcggccggagggacgccgaggcggagctcaacctgccgccggggttccggttccatcccaccgatgaggagctggtggtgcactacctctgcaggaaggtggcgtgtcagcagctgcccgtgcccatcatcgccgaggtcgacctttacaaattcgacccgtgggatcttccagagaaggcgctgtttggccgcaaggagtggtacttcttcacgccgcgggaccgcaagtacccaaacggctcgcgccccaaccgcgccgccgggagggggtattggaaggcaacgggcgcagacaagccgatcgcgcccaagggcggtggcggggcggcaggaatcaagaaggctctcgtcttctactcgggcaaggcgcccaggggattcaagaccgactggatcatgcatgagtaccgcctcgcgggcgcggaccgtgcgccgggcaagaagggctcacggaagtcttgcagttggatgagtgggtgctgtgccggctgtacaacaagaaaaacaactgggagaaggtgaaggccgaggagctggaggcggcggcgccgctccgtaaccagcagggcgcagcggaggattccatgtctgacagcttccagacgcacgactcggacatcgacaacaatgccttcggcatgcagaacggcttcggtaacatggtgcacgggcaggccatgaccatgaggaacggcattggcagcgtggcgaggacggtgaaggaggatagctattggttcacggacctgaatctggatgatctgcaggcgccctacaacgtgacccatgtgttgaatccgaacccggtccagacgatgaatctggcggctgggcaaggccatggctacttgcagtctatgagctcgccgtcgacgaagatgtggcagacgatcctgcctccgttctgagagttgctgtgatggaagggggaagagatgatcttgggcgtaggagtggttagactggctaggaacagcaggtttaaaatttggagggtttgaattctgcaactgttgctggtagtcttgtaagggttattcatttgttaaattatgtgcttggtaatataccaaaaggaaaatccatctccctttgcactacttgaagaaaccagtacaaaattacagttctcatatttcatatggtcggtttgagccgagattggtttaggacactttcctctttattcgggtataaattcggccagttgtttcaaaatgattaaatggtaggagtaacattcagtgaatggaatcgactcccttttttccct

SEQ ID NO: 888 - DNA, 1496 bp, Zea mays
  Predicted polypeptide sequence is orthologous to G519
gaattcccgggtcgacccacgcgtccgcccacgcgtccgcaggcctgccagccagccgcctttcgaaaccgagcaccagggagcagacgcggtctctggaacccaggttccagcgagcaaaccatctaaccaggcgctgagaattctgtgcggaggaggcggatggcaatggtggcggcggcggaggggagcgggcgcagggacgccgaggcggagctcaacctgccgccagggttccggttccacccaacggatgaggagctcgtggtgtactatctctgcaggaaggtagcgcggcagcaggtgcccgtgcccatcatcgcggaagtggatctttacaagttcgatccgtgggatctgcccgagaaggcgttgtttggtcgcaaggagtggtacttctttacgccgcgggaccgcaagtacccaaacggctcgcgccccaaccgcaccgccgggaaggggtactggaaggcgactggggccgacaagtcgatcgtgcccatgggcagcaccagggcggcagggatcaagaaggcgctggtgttctactctggcaaggcgtccaggggcgtcaagacggactggattatgcatgagtaccgcgtcgctcaagcggaccacaccctggggaagaagggctcacataagctggacgagtgggtgttgtgccggctgtataacaagagaaacaattgggacaaggtgaaggtcgaggagcaggagttggaggcggcgccgcgccgacaacatcaccgacaaagtgcggaggattccatgtctgacagtttccagacacacgacttagacatcgacaacgccttcgagctacataattgctacggtaacaacatggtgcaagggcaggccatgacccccaggaacgacattggcgtcgtgacggtgaaggaggacaacgactggttcaccgacatgaatctggatgatttgcaggcatcctacaacatggcccatacggtgaatccgaacccggcccaaaccgcgaacctggtggcagggcaaggccatggctacttgcaaggctatggctacttgcagtacatgaactcaccgtcgatgaagatgtggcagacaatcttgcctccgttctgagtgtccacgatgaagatgagtgtccacgatgaagagatgctcttgtacataaggggacataggagtgactagactggaatagaaacaacagggtatgattctgtatctataggcttgtaacgtttattcattcgttagataatacgtatgtggttggtaataccaaaaaaatgcatctccctttgcactacttgaagaaagcacaaagttgtagttctcgtatctcatatggtcggtctaaatcgattctgatcttcatgtgatgtgatatatattatatgttcgcacatttatttaaagatgatgaaatggtaggggtaacattcagtggacggatataaataaaaccatgtgattctacaaaaaaaaaaaaaaagggcggccgc

SEQ ID NO: 889 - DNA, 1399 bp, Zea mays
  Predicted polypeptide sequence is orthologous to G519
ggccggggccttgactctctatttatcccccgatcgccaagaacaactccactccgctcccccatttttttctcacctcccgtggcagcagccggccaacacccgcaccgcagtccacagcaagaaccaagccacagcgaagaaaagatccaatggtgatggcgccggcggcggcgcagcagcagcggcgccgcgacgcggaggcggagctgaacctgcccccgggcttccggttccacccgacggacgaggagctggtggcgcactacctctgcgcgcgcgccgcgggtcgccgccccccggtgtccatcatcgccgaggtcgacctctaccgcttcgacccctgggacctgcccgagcgcgccctcttcggccgccgcgagtggtacttcttcacgccgcgggaccgcaagtaccccaatggctcccgccccaaccgcgccgccgggtcggggtactggaaggccacgggagcggacaagcccgtggagcacggtggcaggacggtcggcgtcaagaaggcgctcgtgttctaccacggcaagccgccgcgcggggtcaagacggagtggatcatgcacgagtaccgcctcgccgacgccggcgcccgcgcccgcgccaggaagcccggcaccggcacgctcaggttggatgactgggtgctctgccggctgtacaacaagaagaacgagtgggagaagacgcagcagcagcaggagaagaagcagaatcagaagcaaatggagtcggaggcctcgctctcgcactcccactcagacacgcggacgccggagtcggagatcgacgacgacccgttcccggagctggcctcgctgccggcactcgacgacatgatgggcccagcagcagcagcgcctgccggcgccatcttgcccaaggaggaggtggaagacttgggcggcctcggcggcgacgactggctcgcgggcatcaacctcgacgacctgcagatcccgggcgaggccgacttttatggctccatgctcgtgtcgccgatggccgccaagatggagcaggacgccgccggcttcccgttcttctgagaccttctgcgcaacgcaaactgtgtatagttcagatttcttcaggattcggagaaaaaaacagttctgctgatatctggttgtagtggtttagtgcacaagcagcagtatgccggtcagttaagattgaagtccattgtagttcatcaccacttgagctgtgactgtgataagtgacagcattctttcatttctggtctgctaattcttcaatggtcagaatatagtttgtggccttcccagagtggtcacaccactgtggagccttgagatggagtaaattttttcttcaaggtttacggtttacctctttaaaatatcttagtactgtttct

SEQ ID NO: 890 - protein, 303 aa, Oryza sativa
  Orthologous to G519
MSGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPPAAAVAAAGMVSSGGGVQRKPMVGVNAAVSSPPEQKPVVAGPAFPDLAAYYDRPSDSMPRLHADSSCSEQVLSPEFACEVQSQPKISEWERTFATVGPINPAASILDPAGSGGLGGLGGGGSDPLLQDILMYWGKPF

SEQ ID NO: 891 - protein, 276 aa, Oryza sativa
  Orthologous to G519
MAAAKRRVRDAEADLNLPPGFRFHPTDEELVAHYLCPRAAGRAAPVPIIAELDLYRHDPWDLPHRALFGRREWYFFTPRDRKYPNGSRPNRAAASGYWKATGADKPVLHNGRTAGIKKALVFYHGKPPRGVKTEWIMHEYRLAKKGGAAAAAGAGALRLDDWVLCRLYNKKNEWEKMQSRKEEEEAMAAAQSWGETRTPESEVVDSDAFPEMDYSLPAASFDDALLPKEEARDDDWLMGMSLDDLQGLGSLLQADDLSMLAPPPAAKTEPLGAPFF

SEQ ID NO: 892 - DNA, 658 bp, Glycine max
  Predicted polypeptide sequence is orthologous to G545
cggaacaagccaagaaataaatttatataggaatctgtatatgatgggaattaacttatatttatctttggcataaacattactgatgaaagcaattgttagattgaatcaatgacaaagaagagtccaaaagcaatgaacaaaatttgtctgtacagagtagcagaaacaaaatcccaatcccacctatatactaaaaaaaaacataaaatgaaaattaaactaactggtttgaattcataatcatattcgcgatataccagcaacaaattcaatttcaatcaatttaaaataaaattctgcaaacaaatctacgcggtttcatcatcttcccctgtaaacaaacgcgcgcctcttggcggttaccggcaacgggctttccacctcttgttcaccgcctaccttcttcttcccgaaatcaaaccccatcggcgaccagaactccgtcagcggcgccggaaggttcaggtcaaacccacggagcgtgtgggaggaggaggcagcgccgccgtcggaggtagtggcgccgctgctgttgtttccgttggcgttgctgttactgtggttgttcccgccgtcgtagtggcagcgcttgtggccacccagggcctgaccggtagggaaactcttgtgacagatggagggcggccgcgtacta

SEQ ID NO: 893 - DNA, 1101 bp, Glycine max
  Predicted polypeptide sequence is orthologous to G545
ggccgaatcccggtcgagcgaggctccccacgcgtccgtacggctgcgagacgacagaaggggactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttaccagtcctcatccatccaagaagtcccgtttcaatttgaccatacccaagattgaaatccctcaatactgatgatccatagatccaaaaaaattattcagtgtttttttcttctttcttttttaaagttatttgggattaatttgtccttgtacatatatagtacttgggccttattcgctagttttagcttttagattgtagtcattgtacttttgacagtggcaatgcaattcaattcaattcatttatttttatttgtaaaaaacgcgagactagttccctcgtgccgaattcggcacgaggc

SEQ ID NO: 894 - DNA, 1178 bp, Glycine max
  Predicted polypeptide sequence is orthologous to G545
agcacaccgcgcttacttgctcaccacttgtcacgcaacttccctcatttcctcacgtctttataaaccctcctctcccccctcgcgccccattccgcgtcaactcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccggccgccacagccacagccacagccgacaccagatccttccaccaagctcagttacaaatgctccgtttgcgacaagagcttcccctcttaccaagcgctcggtggacacaaggccagtcaccggaaactcgccgccgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtggggtccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcgttgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaattagtaaaaaaaaaaatcaaaattgaaattaaaaaagaaaaaaaaaaaactcgagac

SEQ ID NO: 895 - DNA, 992 bp, Glycine max
  Predicted polypeptide sequence is orthologous to G545
ggactcgagccgagcccaaactcaagttcaccaaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgctcacggcggcgccggcggtgtccccgccgccaagcctgctgtctccgacaacaattccgcgccgctacccgccgccaaactgagctacaaatgttcggtctgcaacaaagccttctcctcttaccaagcactcggtggacacaaggccagccaccggaagctcggcggcgagcaccactcgacctcctccgccgtgacaacgagttcggcgtcgaacggcggtgctaggacccacgagtgctccatctgccaaaagacgttcccaacaggacaggccttgggaggacacaaacgttgtcactacgaaggcggtaacagcgccgtaaccgcctctgagggagtggggtccactcacacaggaagccaccgcgatttcgatcctgaacctcccggcttttccggacttttcaacaaggttcttcgttgatgacgaggttaccagtcctcatccatccaagaaatcccgtctcaatttgaccatacccaagattgaaatccctcaatactgatgatccatagatccaaaaaatattcagtgtttttttcttctttcttttttaaagttatttgagattaatttgttcttgtacatatatagtacttggaccttattcgctagttttagcttttagattgtagtcattgtacttttgacagtggcaattcaattcaattcaattcatttatttat

SEQ ID NO: 896 - DNA, 1010 bp, Glycine max
  Predicted polypeptide sequence is orthologous to G545
cccacgcgtcccaacccaacccaaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcaacatcccggcttttccggatttttcgaccaaggtcggagaagacgaggttgagagccctcaccctgtcatgaagaagcctcgccccttcgtcattcccaagatcgaaatccctcaatatcaatgaactctatgaattttttatttttatttttttcgattattttggagaattttgagatttactataatttgattttgtacatagtcctacctggaagttttgttgaaccgtacgtaccggacccagttctctgatttaggttgtactttcacagtgacagatttgcaattcaattcaatttctttatttaatttataaaattatttgatct

SEQ ID NO: 897 - DNA, 390 bp, Glycine max
  Predicted polypeptide sequence is orthologous to G545
gcgtggatcacgcgaccacccttcagaggaagagtaccgtggatcttgactcatcatgcgggctcgcggtggcaccaaccgccgggtcagcactccaccggcgcatccgactccagatgcttccaccaagctcagttacaaatgctccgtttgcaacaagaagcttgccctctgtaccaagcgctcggtggacacaaggccagtcaccatagactcgctgactccggcgaccaagaccaacccaccatgacctacttcggcggcagcttcatcaacaccgactccagaggtaggacccacgaatgctacatctgccacaagtcctttctcaccagacaggccctctgcggacacagacgacgtcactacgaaggtaacagtaatggaaat

SEQ ID NO: 898 - DNA, 650 bp, Glycine max
  Predicted polypeptide sequence is orthologous to G545
ctcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccgccacagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcattgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttat

SEQ ID NO: 899 - DNA, 614 bp, Oryza sativa
  Predicted polypeptide sequence is orthologous to G545
gcacgaggctccctgcagctacgtactgtacttgttagcaatcaatcccatcaaatcatccaccggtcgctgctgctgctacgtactatacagcttgattaattaggttttacgacgacggcaacggggacagatatgacggccgccctgcaagcgctgctcgacccgacggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgcccctactggga

SEQ ID NO: 900 - DNA, 864 bp, Zea mays
  Predicted polypeptide sequence is orthologous to G545
gcggccgccctttttttttttttttaacctcaattggtagatgcctatatggcctatggcttttatctcaagtatatatggctcgacaaaattaaatacacgtttattcaccgcgcaaacacaaaaactaaaatacggttaaaagaatgaagcaacgaaaacactctacaagcctcagatcgccaaaaggaactctaaatcgttaaactaagttcggtggaaggaccggaggacagccgccgcttcttgaccggcaaggggctctgcacctcttcctcctctcgccaccttgccgcgccggcggccggcaccaaattcagatcgaagcccctcaagctcgacgcggaccccgacgccgccgacgcggtgagcgacaccgagagcccgtcccagtaatggcacctcttgtgcccgccgagcgcctgccccgtggcgaagccccggtggcacaccgagcacctgtgcctcccctgcccggcgccgctgccgcccgccgacgaggtattcgtcgtcaccgacgacgacgacgacgccgcctgtacgagcgtcggcggcggcttccggtggctggccttgtgcccgcccagcgcctggtgcgacgcgaaggccttgccgcagacggagcaccggaagcggagctcgcactcttgcgtcgtcatcgtcgtcgtcgtcctggcactggcagccgcagcgtgccctcctcctcctcccgcggctgcgagcgccatgaggcacagggagacgtagtcgtcgtgggtgatggccatctatcggtcacggcgcgcgagcgaggcttgttgaaaagctaatgctgctagctggttaggtttccgctggtttagcaagtccgatcgatgagtcgac

SEQ ID NO: 901 - DNA, 758 bp, Zea mays
  Predicted polypeptide sequence is orthologous to G545
gaattcggctcgagatcgccatctgcctcgccgcgctcgccgggacccgcaagttcgggctcggtcgggagaaggaccagcaccagcacaccaagtggtgcccgacgacgacgacaacccacgcgccatctgcgcagcaggagcttcggttccggtgcgcggtctgcgggaaggccttcgccacctaccaggcgctcggcggccacaagtccagccaccgcaagccgacgacgccggagcggtacgccgccgcccttgccgccgcggcgacgacgacagcggcccggggcgaccactccgacgagacgacggcgtcgtctctgtcggggtcggcggctagcggcgggccacaccggtgcagcatctgccggaggggcttcgccacgggccaggcgctcggcgggcacaagcgctgccactactgggacggcatgtccgtgtcgatctccgtgtcgtccgggatggcgtcgtcgtcgggcctcagtaccgtcaggaactttgacctcaacctggcgccactgccggagaatggcgacgccgggatgatgaagaggtgggccgaggaagaggaggtgcagagtccgttgccgatcaagaagcgcaggatgtcggactgactactcaccgatgccgtcgtgtctatcgtttcatgtaaaaatggatctacgccatcgttgtgtcgttaatttaatttcttttaattaggttctgtttttctggacataaattcgttcaattcattgattcgtcaaaaaaaa

SEQ ID NO: 902 - DNA, 436 bp, Zea mays
  Predicted polypeptide sequence is orthologous to G545
tccgcgggaggaggcccgcaccgatgcacgatctgccggagggggttcgccacgggccaggcgctcggcgggcacaagcgctgccactactgggacggcgcgtcggcgtccgtctccctgtccgcgtccggtacggggtcgtcgggcgtcacactgaggaattttgacctcaacctgatgcccgtggcggagaacgcagggatgaagaggtgggtcgaggaggaggaggtgcagagtccactgccgatcaagaagcgcaggatcttggattagctctcgcgctactaccagcggttgagacctgtgtgcccacagcctcggttcgtgtaaaaaggaagattgattgtttcatcgattatttgattcgttctttacttctttcacactaataaaatatttgattgttgtatcaaaaacctacctccgcggacccatg

SEQ ID NO: 903 - protein, 181 aa, Oryza sativa
  Orthologous to G545
MALAAAARGESTALALALAPPPPELHFRCSLCGKAFASYQALGGHKASHRKPSAAAAAPPAHRDVVVAAAPASSGRVAADADAASEADGRRRRHVCSLCRRGFATGQALGGHKRFHYLHGPSVSATVSSAATAASVGAAFDLNVAPIKEIAGEQRRCGEEADDDDEAESPSPAKKPRRRPG

SEQ ID NO: 904 - protein, 226 aa, Oryza sativa
  Orthologous to G545
MGLNEKPLVPPLSPTPVDFRAHQVFPSKHHDFDTSKSRNISGSVAIGSDSEEEYLATSLLMLAHGIRDETKDIRGMGDVKGVGVDTLELVKPSQRAYECSVCGKVYWCYQALGGHMTCHRNLFAQVVAGDELSSDRTMVVKGHKCSICRLEFPSGQALGGHMRVHYVGGVEGGSVKEKNVVKTKVTGALKLVLKDFDLNVPVVATMVGDEAESSHSEAKARMMTLP

SEQ ID NO: 905 - protein, 200 aa, Oryza sativa
  Orthologous to G545
MVTNMTHDDYVSLCLMALAQAGVGGQWPAQKQQIDMAPPAPERELLRFRCSVCGKAFPSHQALGGHKASHRKPQTTALPMHVIDAPPPPSAEDTASSSTTTTTSGGGRHRCSVCHRTFATGQALGGHKRCHYWDGLSVVSVTASASGSGSSSVRNFDLNLKPVPETVAAGVTRWGEEEEVQNPLPFKKRRLSSPSLELNL

SEQ ID NO: 906 - protein, 220 aa, Oryza sativa
  Orthologous to G545
MTAALQALLDPTALSLGLPTPAINKEEYLAICLAALACTRAGKALVGVGGQQQVQACNKWLCPAPAAPEELRFRCTVCGKAFASYQALGGHKSSHRKPPSPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 907 - protein, 247 aa, Datisca glomerata
  Orthologous to G545
MALEALNSPTTATPVFHYDDPSLNYLEPWTKRKRSKRTRLDSPHTEEEYLAFCLIMLARGRVASANRRDSQSSIQIQPEATTSATKVSYKCSVCDKAFSSYQALGGHKASHRKLAGGEDQSTSFATTNSATVTTTTASGGGGRSHECSICHKSFPTGQALGGHKRCHYEGSIGGNSIHHHNNTTNSGSNGGMSMTSEVGSTHTVSHSHRDFDLNIPALPEFRSNFFISGDDEVESPHPAKKPRILMK

SEQ ID NO: 908 - DNA, 566 bp, Oryza sativa
  Predicted polypeptide sequence is orthologous to G546
  misc_feature (498)..(498): n is a, c, g, or t
  misc_feature (503)..(503): n is a, c, g, or t
  misc_feature (546)..(546): n is a, c, g, or t
  misc_feature (548)..(548): n is a, c, g, or t
gcgtcgtcgtccgggccctcgacgcgcgcgacgacgggtgcgcggcagacggggcaggtgggcgcgcgcgtgagcagccaccggtcgacgcactccctgtggaacccatgcccgcacgccggcagcacgcgcacctcgtccccggcggcgtactccgccaggcacaccgcgcagtcgccgctgccgccctcctcgtcggcgccgccgccgccgccgtcgcggggcggcatctggaccacgtgcaccgggatcccgtcgagcgcgcgcttggtctcctcggacggctcggggcgcaccgacgacgacccgccgtcttctcgccgtcgccgcccgccgccgtcgcagaagcaggcgtagagcgcggtgagcgcgatgtaggagacgctggcgacgaagagcaccgtggtggtcacccccagcgcccgcaccatgtgcgcccccgcccccggtccatcgagtgggccgaagccgaacccaagcccggcagcggcggcggcnaggcngtgccggcgccgaggagacggcgcccgcatggctgcatagccncngctctcgtggtggtgcac

SEQ ID NO: 909 - DNA, 418 bp, Zea mays
  Predicted polypeptide sequence is orthologous to G561
cggacgcgtgggattttcgaattttgagaaagttttttttccttataaccttggtatgtctatctagaacctgtcatgtttaggcaataactgttttgtggttcatcgactgcaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcaaaaccgtctcccagcaaagcagccgcattcccattctatcccgtgcctcggcggagaacatcctttccatgatcgaca

SEQ ID NO: 910 - protein, 372 aa, Sinapis alba
  Orthologous to G561
MGSSHEEGKSTTQSDKPAQVQAPPPPPPPIQEQSNVHVYHHDWAAMQAYYGTRVAIPPQYYNSNGHAAPPPPYIWGSPSPMMAPYGTPYPPFCPPGGIYAHPGVQMGTQPQGPTSQATPVVTTPLNLEAPANSAGNTDQGFMKKLKEFDGLAMSISNNKAGSAEHSSEPRNSQSSENNDDSSNGSDGNTTGGEQSRKKRSREGSPTNDGKPSSQIVPLLRDENEKQAVTMGTPVMPTAMDFPQPCHGAPREVWNEKEVKREKRKQSNRESARRSRLRKQAETEELSVKVDALVAENMTLRSKLGQLNDESEKLRLENEALLAQLKATQTQATGKTENLISGVDKNNSVSGSSKNVEQQLLNVSLRTDSVAAS

SEQ ID NO: 911 - protein, 358 aa, Raphanus sativus
  Orthologous to G561
QSDKPEQVQAPPPPPEQSNVHVYHHDWAAMQAYYGPRVAIPPQYYNSNGHAPAPPPPYIWGSPSPMMAPYGTPYPPFCPPGGVYAHPGLQMGSQPQGPVSQATPVVTTTPLNLEAPANSPGNTDQGFMKKLIEFDGLAMSISNNKAGSAEHSSGPRNSQSSENDDSSNGSDGNTTGGEQSRKKRSREGSPNDDGKPSSQIVPLLRDENEKPAVTMGTPVMPTAMDFPQPCHGAPHEVWNEKEVKREKRKQSNRESARRSRLRKQAETEELSLKVDALVAENMTLRSKLAQLNDESEKLRLENEASLAQLKATQTQAAGKTENLISRVDNNNNSVSGSSKNVEQQLLNVSLRTDSVAAS

SEQ ID NO: 912 - protein, 376 aa, Brassica napus
  Orthologous to G561
MGKSEEPKVTKSDNKPSSPPADQTNVHVYPDWAAMQAYYGPRVAMPPYYNSAMAAASGHPPPPYMWNPQHMMSPYGTPYAAVYPHGGGVYAHPGFPMPQGQKGATPLTTPGTPLNIDTPSKSTGNTENGLMKKLKEFDGLAMSLGNGNNGDEGKRSRNSSETDGSSDGSDGNTTGADEPKLKRSREGTPAKDEKKHLVQSSSFRSVSQSSGDNNCVKPSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 913 - protein, 374 aa, Brassica napus
  Orthologous to G561
MGKSEEPKVTKSDNKPSSPPADQTNVHVYPDWAAMQAYYGPRVAIPPYYNSAMAAASGHPPPPYMWNPQHMMSPYGTPYAAVYPHGGGVYAHPGFPMPQSQKGAALSTPGTPLNIDTPSKSTGNTENGLMKKLKEFDGLAMSLGNGNNGDEGKRSRNSSETDGSSDGSDGNTTGADEPKLKRRREGTPTKDEEKHLVQSSSFRSVSQSSGDNVVKHSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 914 - DNA, 2158 bp, Glycine max
  Predicted polypeptide sequence is orthologous to G562
  misc_feature (2054)..(2055): n is a, c, g, or t
  misc_feature (2057)..(2057): n is a, c, g, or t
  misc_feature (2118)..(2118): n is a, c, g, or t
  misc_feature (2130)..(2133): n is a, c, g, or t
  misc_feature (2150)..(2150): n is a, c, g, or t
  misc_feature (2154)..(2154): n is a, c, g, or t
cggtcgtttgggcagacacacgggcggacgcctgcgccacgcgtccgctctttccctcgttttttaagagagagaaagtagagagagagagaaacacaactgctttgccaaaccttaatttcagggcacttccaagctaacaggaccagttgttgttccctttttgtgttgtttgattcagcgatttctggttttcgttttttttctttctttgttacaaggagagttcgatgtctttaagttgaataacttgttgggacatatttgactcggtgcttttcttttggtgcttgcctcatgggaaacagtgaggatgagaaatctgttaaaactggaagtccttcttcttcacctgcaacaactgagcagaccaaccaacctaatattcacgtctatcctgattgggctgccatgcagtattatgggccaagagtcaacattccaccatacttcaactcagctgtggcttcaggtcatgctccacacccatacatgtggggaccaccacagcctatgatgccaccttatgggccaccttatgcagcattttattcgcatggaggggtttatactcaccctgcagttgctattgggccacactcacatggtcaaggagttccatcttcacctgctgctgggactccttcaagcatagaatcaccaaccaaattatctggaaatactgatcagggtttaatgaagaaattgaaagggtttgatgggcttgcaatgtcaataggcaattgcaatgctgagagtgctgagcgtggagctgaaaacaggctgtcacagagtgtggatactgagggttccagcgacggaagtgatggcaacactgcaggggctaatcaaacaaaaaggaaaagaagccgagagggaacaccgaccactgatggagaagggaaaactgagctacaaaatggtccggcttccaaagagactgcatcttccaaaaagattgtgtcagctaccccagctagtgttgcaggaacattagttggacctgtagtttcttcaggtatggccacaacactggagctgaggaacccttcgactgttcattctaaggcaaattccacaagtgccccacaaccttgtgcaattgtgcctaatgaaacttgcttacagaatgagcgtgagctgaaacgggagaggagaaaacaatctaaccgtgaatctgctagaaggtccaggctgaggaagcaggccgagactgaagaattggcacgaaaagttgatatgttaactgctgagaatgtgtccctgaagtcagaaataactcgactgactgaaggttctgagcagatgaggatggaaaattctgcattgagggaaaaactgataaatactcaactgggaccaagggaagagataactttgagcagcattgacagcaagagggctgcacctgtaagtacagaaaacttgttatcaagagttaacaattccggatctaatgatagaactgcagagaatgagaatgatatctgcgagaacaaaccaaattctggtgcaaagctgcatcaactactggatacaaatcctagagctaatgctgtagcagctggttgaaaccagtaactgcactggctaattatgtaattttggcatattacaagcccaaaattacagcttggtgctaacagttttcagagggatggatcagctgaattttacaatctaattccatctatatagaccagaactaattctttgcttgtgagtttcttagggcataaactctgtattttactagatttcacagaattgaatgacaactttaaaagtttgtaaattgaagagtattagggatttagtttagactttaagagaggcttgtcggccgctgtataattggttgtgtattaactatattggtgtgatctttctaatggtatcttagtcaaggcattctgacttttggttagttttggttttgtatactttaaagcaattcctcatgttgtggctgtggttgccttttaccatgtgtttgttaccacttagtgtgcatttggattgaattaattttagaaatgttaatctgaatgatnnanaaaaaaaaaaaaaaaaaaaaaaaaaaaaaaaaaaaaaaaaaaaaaaaaaaaaaaaaaaaanaaaaaaaaaaannnnaaaaaaaaaaaaaaaanaaanaaaa

SEQ ID NO: 915 - DNA, 1715 bp, Glycine max
  Predicted polypeptide sequence is orthologous to G562
tcgcttcgggatgttttcttggttaccaagattatataggatcatgtgtagattttagatggcagaaatcttggtttatgaattttgtcttgtcccttgcaatattttcatgccgataataattaacaagctgacatggctcctgttaatgcagttgagacatttttcaagaagtagtaaagctccttctacaatattttttgacttggtgctttccttttggatcttacaatgggaaacagtgaggaagagaaatctgctaaaactggaagtccttcttcttcacctgcaacaactgagcagaccaaccaacctaatattcacgtctatcctgattgggctgccatgcaggggccacactcacatggtcaaggagttccatcttcacctgctgctgggactccttcaagcgtagaatcaccaaccaaattctctggaaatactaatcagggtttagtgaagaaattgaaagggtttgatgagcttgcaatgtcaataggcaattgcaatgctgagagtgctgagcgaggagctgaaaacaggctgtcacagagtgtggatactgagggttccagcgacggaagtgatggcaacactgcaggggctaatcaaacaaaaaggaaaagaagccgagaaggaacaccgatcactgatgcagaagggaaaactgagctacaaaatggtccggcttccaaagagactgcatcttccaaaaagattgtgtcagctaccccagctagtgttgcaggaacattagttggacctgtagtttcttcaggtatggccacagcactggagctgaggaacccttcgactgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctaaagtcagaaataactcgactgactgaaggttctgagcagatgaggatggaaaattctgcattgagggaaaaactgataaatactcaactgggaccaagggaagagataactttgagcagcattgacagcaagagggctgcacctgtaagtacagaaaacttgttatcaagagttaacaattccggagctaatgatagacctgcagagaatgagaatgatatctgcgagaccaaaccaaattctggtgcaaagctgcatcaactactggatacaaatcctagagctaatcctgtagcagctggttgaaaccagtaactgcactggctaattatgtaattttggcatattacaagcccaaaattccagcttggtgctaccagttttcagagggatggatcagctgaattttacaatctaatcccatctatatagaccagaactaattctttgcttgtgagtttcttagggcataaactctgtattttactagatttcccagaattgaatgccacctttaaaagtttgtaaattcaagagtattagggatttagtttagactttaagagaggcttgtcgccccctgtataattggttgtgtattaactatattggtgtgatcttcctaatggtatcttagtcaaggcattctgactttgggtcaaaaccaaaaaaaaaaaacaatatttaat

SEQ ID NO: 916 - DNA, 1775 bp, Glycine max
  Predicted polypeptide sequence is orthologous to G562
cccccgcgtccgcccacgcgtccgccctcgcggacacttggagctgcgagcactagttttcccttttccccttgtttgtttttttaggataataattgaccaattgggtatcttgtcagttgagacatttttcaagaagtagcaaagctccttctacaatatttgacttggtgctttccttttggatcttacaatgggaaacagtgaggaagagaaatctaccaagactgaaaaaccttcttcacctgtaacagtggatcaagccaatcagaccaaccagaccaatattcatgtctatcctgattgggcagccatgcaggcatattatgggccaagagtcaccatgccaccatactacaactcagctgtggcttctggtcacgctcctcacccatacatgtggggaccaccacagcctatgatgccaccttatgggcctccttatgcagcaatttatccacatggaggggtttatactcaccctgcagttcctattgggccacatacacatagtcaaggagttccatcttcacccgccgctgggactcctttgagcatagagacaccacccaaatcatctggaaatactgatcagggtttaatgaagaaattgaaagagtttgatggacttgcaatgtcaattggcaatggccatgctgaaagtgcagagcgtggaggtgaaaacaggctctcacagagatggagaagggaaaactgagatacaaggcagtccaatttccaaagagactgcagcttctaataagatgttgggagttgtccctgccagtgttgcaggaacaatagttggacatgtagtttcttcaggtatgaccactgcactggagctgagaaatccttccagtgttcattctaaaacaagtgccccacaaccttgtccagtattgcctgcagaagcttgggtacagaatgagcgtgagctgaaacgggagaggcggaaacagtcaaatcgagaatctgctagaaggtccagactaaggaagccaggctgaaactgaagaactggcacgaaaagttgaatccttgaatgctgagaatgcaacactgaaatcagaaattaatcgactgactgaaagttctgaaaaaatgagggtggaaaagtttttgactcagggaaaacttaaaaatgctcaactgagacaaacacaagagataactttgaacataattgacagccagagggctacacctataagtacagaaaacttactatcgagagttaataataattccggttctaatgatagaactgtggaggatgagaatggtttttgcgaaaataaaccaaactctggtgcaaagctgcatcaactactggacacaagtcctagagctgatgctgtggcagctggttgatacagaaaaccagtaattgtactggctgatcagaggtagttttggcatattacaagcccaaaattactactaacaatttcctgagggatggatcagctgaattttagtatctaaatccatcaaaatcagaactaattcattgtttacttaggacaaaactctgtattctattagatttgacaaaaatggatgaccaagtttgtaaaatgaagagaactagagatttcagattggagggggtttgttgaaacgctacataattgcgtatgtattaacgattggtgtggagactttctaatgatatctacgcagttattctgccttattatttgtttggtttgtattttgtgctagctaaaaaaaaaaaaaaaaaaaaaaaaaaaaaaaaaaaaaaagggcgc

SEQ ID NO: 917 - DNA, 1597 bp, Glycine max
  Predicted polypeptide sequence is orthologous to G562
agtagaaccattatcctcattgtcttatttcttccatgctccaaagtcaagtgattctgtagctacttcttccttgggacgacaccaagcttattttttatttaaaaatacttagtgtatttccattttcttttttgtggatgaagcaatgaactgatgaaagcttcttatattccctcttgtgaattattgtttatcctctcagaatataaatattagagtgtcattcctgtggtgcattgtattacctattctgtgttttgtgagttgttatcaatatgtacccctaatcaatgtcagactgaaattatgcactgaattgctactggatttggcaatcagttggggtaatatctaggatgagatgtgctttgtccctggattgctcaatctgtaaaaaaaacattgattcgatggtataaaactattaattttatccctttcaaattggttcacccagcaagttttcaagtgtgtttggtctctagtgtagtgaatagtgactgtattataatttaaaatgtctactatatcttcaggcatattatgggccaagagtcaccatgccaccatactacaactcagctgtggcttctggtcacgttcctcacccatacatgtggggaccaccacaggtagcccttctgtcgtcttctcgcagccgtgcagcaatttatccacatggaggggtttatactcaccctgcagttcctattgggccacttacacatagtcaaggagttccgtcttcacctgctgctgggactcctttgagcatagagacaccacccaaatcatctggaaatactgatcagggtttaatgaagaaattgaaagagtttgatggacttgcaatgtcaattggcaatggccatgctgaaagtgcagagcctggaggtgaaaacaggctctcacagagtgtggatactgagggttccagtgatggaagtgatggcaacacttcaggggctaatcaaacaagaaggaaaagaagccgtgagggaacaccaaccactgatggagaagggaaaactgagatgcaaggcagtccaatttccaaagagactgcagcttctaataagatgttggcagttgtcactgctggtgttgcaggaacaatagttggacctgtagtttcttcaggtatgaccaccacgctggagctgagaaatccttccagtgttcattctaaagcaagtgccccacaaccttgtccagtattgcctgcagaaacttggttacagaatgagcgtgagctgaaacgtgagaggcggaaacaatcaaatcgagaatctgctagaaggtccagactaaggaagcaggctgaaactgaagaactggcacggaaagttgaatccttgaatgctgagaatgcaacactgaaatcagaaataaatcgactgaccgaaagttctgaaaaaatgagggtggaaaatgctacattaaggggaaaacttaaaaatgctcaactgagacaaacacaagagataactttgaacataattgacagccagagggctacacctataagtacagaaaacttactatcgagagttaataataattcccggttctaatgatagaactgtggaggatg

SEQ ID NO: 918 - DNA, 538 bp, Glycine max
  Predicted polypeptide sequence is orthologous to G562
  misc_feature (327)..(327): n is a, c, g, or t
cttctgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctgaagtcagaaataactcgactgactgaaggttctgagcagatgaggatggaaaattctgcattgagggaaaaactgataaatactcaactgggaccaagggaagagataactntgagcagcattgacagcaagagggctgcacctgtaagtacagaaaacttgttatcaagagttaacaattccggatctaatgatagaactgcagagaatgagaatgatatctgcgagaacaaaccaaattctggtgcaagctgcataactactggatcaaacctagagctatgttgagcactggtgaacagtactgactgctaatatgtatt

SEQ ID NO: 919 - DNA, 2359 bp, Zea mays
  Predicted polypeptide sequence is orthologous to G562
tttcaattctgcgggcaatgcgttgatttctcccgcctctctgcgcggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggaggtattattttctattgatcttttgagtgcagcatcgtcgcgtcagcagcggcgaagctctatactggtcagacccattaggtgtattccattcccacctacagtcggtgaatcactcgtctgcatctcatcgaagctggtgatgcaagctttgcatgcatccttagcttattaactggtgaagtggtttctttcgccctgtaactctttgggtgtaacttatggagagcgattagcaaattattaccgttttagatagttctgcgtcaagattttaaaccatttttttctgtaagttttttgctgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgaaaaaggtatttatttttaagttcatttagtattattttggctggctgaattgtatatttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtacaggaaaaaaaaaaaaaaacaaaaaaactcgaggggggg

SEQ ID NO: 920 - DNA, 1646 bp, Zea mays
  Predicted polypeptide sequence is orthologous to G562
cctttgcgtgaagagagctaggtgggccgtagaaaaggcttcagttcagatctcatttcagatagcacaggaccaatctggtctgcagtgttcaactggaatataagatttcgctgcataggtcaaagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctccccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttcccccgtcgcaataacccaattcagatcggagtttgttccggaaatatgtaaaaaaaaaaaaaaaaaaaaagggcggccg

SEQ ID NO: 921 - DNA, 1807 bp, Zea mays
  Predicted polypeptide sequence is orthologous to G562
cattgggtacctcgaggccggcccctcgcggcccccacgcgctcccgggctcccctgcctcgccgcctctctccctgtcgtacccacctgccccctcgcggtctctctctccttcctgattggatcaatctggcctcgcggctccgactgatccgtggcgcctcgctcccgagcggaaccaccacctgatttgacgagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccatttttgcacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggtgtgctgtgtgatacagttgtacaatgaagcagcatcctgaaacatgggagtggagtctggcttggattatttgtcctaacaacatatcttcaatcttatacttatgccctcccttggtgtaggctgagacagaggagttggctacacaagtggagtctcttgcagcagagaacacgtcccttagatctgaaatcggccggctaacagagagctcagagaagctcagactggagaattcagctctaatggtgaagctgaaggacaccgcagaaccgtctccgagcaaagcagccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgacgatgaagctggtccggcaaatacgccacagcacatgcatgtggcctggggattccgcaggctcatgcggctcgagtgctcgccgtaaacgtcagcgttacggactcggactctgtactccagtttaggcactgattccagtgaagtaaccgagggtactcgtaattttatctgctctcgcgccagagtgccgggctgcctgcgaccactcctgtgtacccagagttgtaacgtagtagggtgttgtgctgcatgccgaccttttgaaactttggagaccgtcatttggaccatttttttcgtcgcaataacacaatacagatcggagtttgtac

SEQ ID NO: 922 - protein, 380 aa, Oryza sativa
  Orthologous to G562
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDLKVGKTGRKRRLDDGAGAETSAAAKMENALPPSHILGSTAILPNHSFPAQVIRPSATNVANSRALGTPISPPPGVIVPSHTGVSTELLIKDERELKREKRKQSNRESARRSRLRKQAETEDLATQVESLTAENTSLRSEISRLSESSEKLRLENSALMGKLKDPAASTQAETSLQKTTTASSPRVVENFLSMIDNTNKTSVRHTEHAEPKLRQLLGSGPATDVVAAS

SEQ ID NO: 923 - protein, 191 aa, Oryza sativa
  Orthologous to G562
MPLDFGLPDMDVGFGLFGVDAAAFGYDGVASDAAAGLSPVVGAGDGSGGGGDVLLYCDGGGGGGGGGEDGEEERRRRLRRKISNRESARRSRARRRQRVEELERAADELRAERRALASRLNATARRALAVRGANARHHAEAGVLRRRLGEAQRNAAVLIGLSRLLRSTANGAHGGAAPAQLSNGGVASLMT

SEQ ID NO: 924 - DNA, 1019 bp, Glycine max
  Predicted polypeptide sequence is orthologous to G567
attcggctcgagacagaatcataggaaaggagacgtacgatacgatacgatacgatatggatagggtattctcagtggacgatatctccgatcatttctggccgccgcctccgatccccgtctccggcgccaacacctcctctcagatgagccgcagcgcctccgagtgggcctttcagcgcttcatccaggaagcttccgcctccgcaccctctcctccgtcttcttcctccgccgccgacgtcgtattcgtcgagatcgaagatcaacctaaacccgcccctccccctccgacaaacggcgccgttctccccaatgcccctggtcccgtcccccttgactccgacgaataccaggccttcctcaagagcaagctcaacctcgcatgcgccgccgtcgccatgactaggggatctttggctaaatctcaagacccgtcccctttttctgaaggtggatcacagccgactaatccttctctagttgaatctcagactacttctaaaggatctattccttctgaaaatgatccatctaagttacaagataaagataccaatgtaccagttgggattccttccatacctgccatgcaaaagaaacctgctgttgcaattaggccatctacaagtggatcatcaagagaacagtcagatgatgaggacattgagggagagacatctatgaatgacaacacggaccctgctgatgtaaaacgagtaaggaggatgctatccaatagggagtcagcccgacgctctagaagaagaaagcaggctcatttaactgacctagaaacacaggtttctcaattaagaggtgaaaattctaccttgttaaagcgccttactgatgttagccagaaatacagcgactctgctgttgacaacagagttctgagagccgatgttgaaacattaagagcaaaggtaaatccttgccttagtatataggccttaagtaaaacctgttacataggagacctactggactcttgctaagcagttccctaggtttgg

SEQ ID NO: 925 - DNA, 1881 bp, Oryza sativa
  Predicted polypeptide sequence is orthologous to G567
gttgttacttacgcatattttgccgttagttaattattatccggtaaagaagattagtagtaatccaaaattttcccaaccccaacctcggaacaaaaaccgcgtagtatttgtcgtaaccaggagcatccgagtcattaatttacacccaaacacaaaaaattagcagcacgcagccgccttcccaacccccttcccaatcctctcctcttctccaagcggcaattcgcgcgaggttttctccgatcaaaccctcgaatccccccctcgcgaatccatcggagggtagccccgcgatccgcgtcggcgagagcggattccgattccgcgatggagcgggtgttctccgtggaggagatctccgacccattctgggtcccgcctccgccgccgcagtcggcggcggcggcccagcagcagggcggcggcggcgtggcttcgggaggtggtggtggtgtagcggggggcggcggcggcgggaacgcgatgaaccggtgcccgtcggagtggtacttcccgaagtttctggaggaggcggtgctcgatagccccgtcccgaaccctagcccgagggccgaagcgggagggatcaggggcgcaggaggggtggtgccggtcgatgttaagcagccgcagctctcggcggcggcggcggcggcggcgacgacgagcgcggtggtggaccccgtggagtacaacgcgatgctgacgcagaagctggagaaggacctcgccgcggtcgccatgtggagggcctctggcacagttccacctgagcgtcctggagctggttcatccttgctgaatgcagatgtttcacacataggcgctcctatttccatcggaggcaatgctactccagttcaaaacatgctaagtggccctccccgggctgcgggctcacagttggtacagaatgttgatgtccttgtaaagcaggccaccagctcttcatcaagggagcagtcagatgatgatgacatggagggagaagctgagaccactggaactgcaagacctgctgatcaaagattacaacgaaggaagcaatccaatcgggagtcagccaggcgctcaagaagcagaaaggcagctcacttgaatgagctggaggcacaggtatcgcaattaagagtcgagaactcctcgctgttaaggcgtcttgctgatgttaaccagaagtacaatgatgctgctgttgacaatagagtgctaaaagcagatgttgagaccttgagagcaaaggtgaagatggcagaggactcggtgaagcgggtgacaggcatgaacgcgttgtttcccgccgcttctgatatgtcatccctcagcatgccattcaacagctccccatctgaagcaacgtcagacgctgctgttcccatccaagatgacccgaacaattacttcgctactaacaacgacatcggaggtaacaacaactacatgcccgacataccttcttcggctcaggaggacgaggacttcgtcaatggcgctctggctgccggcaagattggccggacagcctcgctgcagcgggtggcgagcctggagcatctccagaagaggatgtgcggtgggccggcttcgtctgggtcgacgtcctgagaccgaaacccagagctgcttcggttctgaaagacactgcgagcaggaaatgatgattggacaggcgtagacattgctaatgctgtgaggttgatgattgttggtcgtcgtcgtcgtcattgtgcattctttgtaagggacacctcttagtaccctcttcttctaagggacttagtaccccttgtggatctcatcgtcctctcgtgccgctcgtgccgctcgtgccgaattcggcacgagctcgtgccgaattccagctgagcgccgtcgcta

SEQ ID NO: 926 - protein, 284 aa, Oryza sativa
  Orthologous to G567
ASGTVPPERPGAGSSLLNADVSHIGAPNSIGGNATPVQNMLSGPSGGSGSQLVQNVDVLVKQPTSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRTASLQRVASLEHLQKRMCGGPASSGSTS

SEQ ID NO: 927 - DNA, 856 bp, Glycine max
  Predicted polypeptide sequence is orthologous to G568
  misc_feature (831)..(831): n is a, c, g, or t
  misc_feature (841)..(841): n is a, c, g, or t
  misc_feature (848)..(849): n is a, c, g, or t
  misc_feature (851)..(853): n is a, c, g, or t
  misc_feature (855)..(855): n is a, c, g, or t
atggcctcgtggccacccaaacctgcagagatattttgttcgtttgagtgtgagagagaaagcgatggcctcatcaccatgtgattgctggccccattcttcttcttcttcttcttctcccattgaacatgtctggaacgacatcaaactcgcctctctctccaattcctccgttgacttagacttgaacaacaacaaccactctgtctccgtttcttctttccttaaccaacctctttccacttttctcactctcacttctacttcctcttcctcctctgtctttcacaaacatgaccactctcttctctctgtctccgaccccaacaccctgcaagatcaacgccatacgcgtgtgatcaagaatcgagaatccgcggttcggtccagagccagaaaacaggcttatagaaaaggcttggaagttgaaatttcccgtttaacggaagagaattccagactaaaaagacaattgaaagagttgcagcgctgtttgtgctcctctcacactcccagaatggccgctccgtgtagaacctcttcatctccattttgagaaggaaaggaacccgtgaatatggcatgactcttgcatgttttcacctttcaaatgtttgtgaaagaaacacaaggattataaatggattgaattttaatagggttttttttttgaggaagagttttgataaccctggttttgtagttttgactaagtttgtctagtagttgggatttgagtaattaacatggaatcttaaatttaagcttcgttaccattattgtatatattaaaaaaaaactggctgctttctgttagcaagactaataaanaaaaaaaaanaaaaaannannnana

SEQ ID NO: 928 - DNA, 520 bp, Glycine max
  Predicted polypeptide sequence is orthologous to G568
ggggtgaagcatggcctcatggccacccaaacctacagagattttttgtgtgcatgcgagggagaaagcgatggcctcatcgccatgtgattgctggccccatctctctcctccttcttccattgagcatgtctggaacgacatcaaactcgactctctctccaattcccctgttgacatagacttcaacaacaaccactctgtctctgattcttcttttcttaacctcacttccacttcctcttctgtctttcacaaacatgaccatgaccactctcttctttctgtctccaacacttccttcgaagcctccggctctaagaaaaccaccctgctagatcaacgccatgcgcgtataataaaaaatcgagaatccgcggttcggtccagagctagaaaacaggcttatagaaaaggcttggaagttgaaattgcccgtttaacggaagagaattccagactaaaaagacaattgaaagagttgcagtgctgcttgtcctcctctgataaccctcccact

SEQ ID NO: 929 - DNA, 917 bp, Oryza sativa
  Predicted polypeptide sequence is orthologous to G568
ttgaaaaaaattgaacaggatactgcatgctgatcgagttgaacaagtaagaaaaggtgttcatctttgcagagacaagatctaacacatttctaactgcagaggtagttcatagcatccatcgatcacctacacacaatatcctctctcatgcctgacccctgcacaaacgcacaccggattgcaaatacacataatttagatctttctaatgattttgtatcgtcagataatcttgcttgttttggtcgaccttcagaattgagttgatgaagttcgtcgcagtgagctctttgtaggcatcaccagtgcagcaacctcctgtttcagctctttgcactgcttcttgagattcaagttgtcatccaccagccggcgaacctctttctctagctcttcaacgtacgccctcttgcgcgccctggagcgaagcgcggactcccggttcctcatcatccggatggtcctccggtcgtcgccgctgccgccgctctgctgccgcaccctccacctccacctcctcgcccccgcgggtactggcgccgccgacgatcccggccagcgacaccggcgtggcgggcagcgcggcgccggcgaggcggacgccgccgccgtcgtcgtcgtccctcagggtggagatggagaagagggagctgcagccgctcatgatgctcagctgcgggctgtccggctccctcggccacgccaccgccgccgccgccgccatctggtagtactcctggtggtggtagttcgccatggccgcaccctgcacctgcaccttcttgcttgtagctgcaggatccttaattcgatcgccaacagctgcagttagtgctccttgcttttggttgttgttgctaagcttgtctctggctctctctctctctctctctctctctctccggacgcgtggg

SEQ ID NO: 930 - DNA, 948 bp, Oryza sativa
  Predicted polypeptide sequence is orthologous to G568
ttgttgttttttttttttttgggtttttttttttttttccgtgtctcatacaatttatattaatttgggtcttgcagcaagcaagcaaacaagggtatgcaaaagttagccggtgacacaaacaattaagcatgcatgtatgcatccatgtgtagcggatgatcgacacagtaacaaaatagagtacttacgtactaccggaatgcatggaaagccaagccggcggatcagagtgagttgttgttacttgctagagactcttgctggagctggacagccaacccaattaaataatggtccccaatccaatggctgcccgctaccttgcctatgcttaattaattaaaggcttaagctgctgcgttctgatcaagtggatgagcttcttcggtgggaactctgcttgttggtaggctgctggatcagagcagccatctccgtcttaagttgtttgcagtgcctcttgagcttgagattctcattcaccagccggcgaacttccttctccagctcctgcacatacgccctcttccttgccctggagcgcagcgccgactccctgttcttcatcatccggatggtcttgcgctcctcctcttcctcgtcgccgccgccgccaccgccaccgcctatgcccacctgcagcagcagatccagctcctcggcgccgcccacgccgagggatagatggggagcaccatcggcggcgctggtaccggcgctggagatggaaaggaaggagctgcagctgctcaggcttagctgcgggctgcccacgccgcccagctgctccgccatgcctaccctattattgtgcctctcttttctttttcttcttttagctaagctaaagctagtgtgtgagtctagtagacccgaccgtgggccctcctcctcctcctcgtcccccccctttggtactccgtcgcatcagcagcaaaagtgcgc

SEQ ID NO: 931 - DNA, 525 bp, Oryza sativa
  Predicted polypeptide sequence is orthologous to G568
tctctctgtgtgtttgtgtcacactcacgctgagcttgcgagcttgcttgctcagaggaggtaaagaaaccgaccgcgaggaggtctcgtcggccgcccccgccggtgtcccgccgccggggaccgccgcaagaggcggatgatcaagaaccgcgagtccgcggcgaggtcccgcgcgcgcaagcaggcccgcgtcaacaaccgggagaccgaggtggagcagctcaagcaggagaacaagatgctccgcgtcaagtacgagcagctgaggaagacggtggaggtgccggcgccggtgaggaggactctgcagagggtgctctccgcgccattctgattcttcctcctcatcgatctcctgctgctgctgctgctgctttgtgatgatcttggatttgtttttggagatggtggtggattagtagcttgtgttgctgtgatgatgcttaattagcagcaaagctagctaatccaggcatgtacattcaggtggacgaacttagctactatggttactactactac

SEQ ID NO: 932 - DNA, 427 bp, Zea mays
  Predicted polypeptide sequence is orthologous to G568
gaaaaaatgcacacagcacaagtccaacaaccatattccttctcgatcttaactttgtactgctactgctaccaccaaatatataaatctatatatttcatttcccttcgccccttcagaattgggtggatgaggttctccgaagtgagctcttggttgggaggaccagtgccgctacctcccgtttcagctctttgcactgcttcttgagcttcaagttgtcatccactagccggcgaacctctttctccaggttctccacgtatgccctcttcctggccctggagcggagcgcggactcccggttcctcatcatcctgatgctcctccgatcgtcgccgctggcctgctgcacctccatgtcgacctcgttgccgacgaagcccgcgagcgagacgggcgtggagggcagcgcgtggccggcgcg

SEQ ID NO: 933 - protein, 142 aa, Oryza sativa
  Orthologous to G568
MAEQLGGVGSPQLSLSSCSSFLSISSAGTSAADGAPHLSLGVGGAEELDLLLQVGIGGGGGGGGDEEEEERKTIRMMKNRESALRSRARKRAYVQELEKEVRRLVNENLKLKRHCKQLKTEMAALIQQPTNKQSSHRRSSST

SEQ ID NO: 934 - protein, 301 aa, Populus balsamifera subsp. trichocarpa x Populus deltoides
  Orthologous to G568
MWSSPGANIDNNNTSNSKVSGNSPSKCFSSTCSSPSPPSPSPPIPNQSMNGASMEEVWDDINLASLHDHSNTNTSSNTNHHSFNGMVFQDFLARPSNKDTSTRAASKEPSSGGGNSFLKNSLGPPPATMLSLNSGSDHFHYLESSNTVPVRPNPQMHSHANGGTISFDSSLDSPFDALGSSSAFLSICKKRPQENGDVSGGDRRHKRMIKNRESAARSRARKQESSSPFENLFLVKFNDYRMLMFYLLLILQAYTVELEREAAHLAQENAKLRRQQERFLAAAPAQLPKKNTLYRTSTAPF

SEQ ID NO: 935 - DNA, 2411 bp, Glycine max
  Predicted polypeptide sequence is orthologous to G584
accttccctctctcctccctccccccccgcacatagaaaaacaagcacgcacgcacacgcatacacacacacactctctcttttccactccctcttttggccgccagaacaaacaaaacccacacttcactcccatccaattccaaacccacgttgttgttggtgcatggaatgaccgagtaccggatgaacctgtggaccgacgacaactcctccgtcatggaggccttcatgagctcctccgacctctcctccctctggcttgccacgccgcagtccgccacctccaccacaactccaggcacggcaaaagcccctcctcctcctcctcctcctccgccgccgccggcgcagtcccagtccctcctcaaccaggagactctccagcaacgcctccagactctcatcgaaggcgcctgcgagagctggacctacgcaatcttctggcaatcttcctacgactattcctccggcacctcccttctcggctggggagacggttactacaagggcgaggaggacaaagacaaagtcaaaaccaaagcccccaaaacgaggtcgtccgcagagcaggaccatcgtaagaaggtcctccgcgaacttaattccttaatttccggcccttccgcttcagctgacgacattgacgaagaagtcaccgacaccgagtggttcttcctggtgtcgatgactcagtccttcgtcaacggtagcgggctgccgggccaggctttttttaactcgagcccggtctgggtcgccgggcccgaaagactttccgaatcggcctgcgaacgggcccgccaggggcagctcttcgggctccagactcttgtctgtataccgtccgcaaacggcgtcgtcgagctcgcctccgcggaggtcatttttcagaaccccgatctgatgaacaaggtgcgtgatttgttcaacttcaacaacaacaacaacaacaacaaccctgaaacgtgttcctgggcgttgaattgcgttgccaccaccgatcaaggcgagaacgacccttcctcgctctggctcaaccctgaaatcaaagactcctccaccgtctcgccgccgaattccacggttaataagacgatgcatttcgaaacccctggttccagtaccctaaccgaaacccctagcgctgctgctgctgttcacgtccccaattctaaaagccagggattcttcccgagggaattgaacttttcgaattcattgaaacctgaatccggtgaaattctgagctttggggagagcaagaagagctcttacaatggggctttctttcccggtgttgttgcggttgaggagaacaacaacaataacaagaacaagaagaagaggtccccggtggtttctcggagcagcattgacgatggaatgctttccttcacttccctgccggctgcaaatataaaatcagttaacggtgcttgtgtcggtgccggtgattcggatcactcggatctggaagcttccgtggcgaaacaggtggtggagcccgagaaacggccccggaagagagggcgaaagccggctaacggaagagaggaaccactaaatcatgtggaagccgagagacagaggagagaaaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaaccaaagaagacaacaagcaagctcgctgatttggagttagaggtgaagatcattggttgggatgcaatggtaagaatccaatgcagcaagaagaaccaccctgcagccaggttgatggcagcattgaaagatcttgacttggaagtgcatcacgccagcgtgtctgtggtgaatgatttgatgatccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctgaatgatcaaccaggggatagtaatatctctgatgaagtccaagtggattttttttgtgttaatattattatctgtttatattgtatatatatatatatatatgtttatgaattatcataaatgtgaactgatgttggtgaattt

SEQ ID NO: 936 - DNA, 806 bp, Glycine max
  Predicted polypeptide sequence is orthologous to G584
ggtccccggtggtttctcggagcagcattgacgatggaatgctttccttcacttccctgccggctgcaaatataaaatcagttaacggtgcttgtgtcggtgccggtgattcggatcactcggatctggaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaaccaaagaagacaacaagcaagctcgcttgatttggagttagaggtgaagaatcattggttgggatgcaatggtaagaatccatggcagcaagaagaaccaccctgcagccaggttgatggcagcattgaaagatcttgacttggaagtgcatcacgccagcgtgtctgtggtgaatgatttgatgatccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctgaatgatc

SEQ ID NO: 937 - DNA, 1203 bp, Glycine max
  Predicted polypeptide sequence is orthologous to G584
ccggttcctgtcgaaatcctcgacgaccacaccatctccttcgccgacatcggcatcgttgccggagtccaagaaaccaaaaagcggagaataaaccaaacacaaacacaaaaacctcccaggaaaaacgacaactatgtcaactccgaacactccgattcggattgtcccacgttgccaaccgccaccaccccgacaacctcggagccgaagaaaagagggagaaaaccgattctcggacgcgagactccggtaaaccacgtggaggcagagagacaacgtagggagaagctcaatcatcgattctatgcgcttcgtgctgttgttccgaatgtttcgaggatggacaaggcttcgctgttgtcggacgctgtcgcctacatcagcgagctgaaggcgaagattgagtacttagagtcgcagcagccgagagacagtagtaaaaaagtgaagacagaaatgacggatactctagataaccatagcaccacgacaatatcgacagtggtggatcaaagcgggcctgaacctagattgggcccaagcccgcttggtctcgaggtcgatgtgaaaatcgtggggcccgatgccatggttagggtacaatcagaaaatgtgaaccaccctggggcgaggctaatgggtgctttgagagacctagaatttcaggttcatcacgctagcatgtcttgtgttaacgatctcatgcttcaagatgtggttgttaagcttcccaatggaatgaggagtgaagagggtcttaaatctgcgattctgatgaggttggatcagtgacactggtgaggttattagctgtaatgtaactgtgagatgttgttgctgttcatagtagtcggtttttggtgtacgttatagataatttgtatttatcttttttgtttttttggggggtctttgtcttgcgtggtgcttgatgacggtggggttggctccaacctgcaattatgtgagggaatctaagaagcctgtcgtttatgttttgtatatataataatccttttggattttgaagttgatcaagaactagactagaagaaaaagtggtcgccatcttgttttaacattcctcaaaatacaaatattataatccaaaccctataatctagtatcactagatttagattttgtatgaataaataatataattaagcatgtgtttactataattttattatataaaaa

SEQ ID NO: 938 - DNA, 2463 bp, Glycine max
  Predicted polypeptide sequence is orthologous to G584
cccacgcgtccgcttactccccctccgcccaatctcaatcccagtgagtgctttctttctgtaactaaccccaatcatcaactcagtcagcgaatgaatctgtggacggacgagaactcctcggtgatggaggccttcatgccatcctccgatctctcctccatctggccccctcccgctcctccgcagccgcaatccacggcggtcttcaatcaggacaccctccagcaccgcctccaggccttaatcgagggcgcccgagagacctggacctacgccatcttctggcagtcctcttacgactattccggctccactctcctcggttggggcgacggttactacaaaggcgacgacgacaaagccaaggcaaaggccaagtccaaagccacctccgccgccgagcaggaccaccgcaaaaaggttctccgggaacttaactccctcatctccggctcctcctccgcttccgcctccgacgacgtcgacgaggaagtcaccgacaccgagtggttcttcctcgtctccatgacgcagtccttcgtcaacggcggaggactgcccggacaggccttcttcaactcgacccccgtttgggtcaccgggagtgaccgtctctctgcctcgccctgcgagagggcgaggcagggacatatgttcggcttgcaaaccttagtttgcataccgtccgcgaacggcgtcgttgaactgggttccaccgagttaattttccagaactcggatctgatgaacaaggtgaaggttctcttcaattttagcaacaacaacttcgacatgggttcttcttggcccgccaccagcgccgatcaaggcgaaaacgacccttcctcgctctggctcagcgatcccgaagttagggattccgttaacactgctgctgctaccccttcggtcatggttcctgcacagactcaggggatttcgatttcaaagaccatgcagttggagagttctattcaaacccctggttccagtactttaaccgaaacccctagttctattcacgcgattccgcagaaccagagcgtcttctccagagaattgaacttttctgagtatggtttcgacccaaagactgggaacaatcagaatcaccattctctgaagccggaatccggcgagattctcagcttcggcgagagcaagagaacctcctacggcggcgtcaatgggaattccaattccaattcccattttttctccggtcagtcgccgtttgttgctgctgcggatgagaacaccaacaaaaataacatcaacaacaatgggaagacaaagtcaccgaattcgcgcggtagcaacgacgacggaatgctttccttcacctccggcgtgattcttccggcctcgaatttgaagtccggtggcggcggcgattccgaccactcggatctggaggcttcggtggtgaaggacccggtggtggagccggagaagcggccgcggaagagagggcgtaagccggcgaacggaagagaggaaccattaaaccatgttgaagcagagagacagaggagggagaagctgaaccagaggttctacgcgcttcgtgctgtggttcccaacgtgtcaaagatggacaaagcgtcactcctgggcgacgccatatcttacatcacggagctgaagtccaagcttcagaccctcgaatcagataaagatggaatgcagaagcagctggaaggtgtgaagaaggagctcgagaaaacaaccgagaacgtttcttctaatcacgcgggtaatagtagtagttgtaacaacaacaacaagttgtcgaatcagaagttaattgacgtgttggagatggacgtgaagatacttgggtgggacgcgatgataaggatccattgcagcaagaagaaccaccccggggcgaggttgttgacggcattgatggagttggacttggacgtgcaccacgccaacgtaaatttggtcaacgatatgaccatgctacaagcaacggtgaagatgggaagtaggttttacacgcaggagcagcttcgtgcggctctggcggctaaggttggggatgcacgatgatgttggctctgcactttgcggcagcgtttgagattatgtgtgtgtttgtgtcgtgttattagctagctagctctttgtaagttgtgctgctctgggatattttaagccttcccggtagctgtttctgtaaaattataagctttttttctttattgggtagcttagtattgaattttgaggtaatcaaattgggaagctccatggagtagtagaactagctagggacacttttcatcaaatctgtgggtggagtggagatagcagcagctatatgtggaaataggggtaattttatctgttttagattgtgtatatattataataatatcataaatgtgaacagcatcatgcaagttctcaatattattattaaaaaaaaaaaaaaaactcgagccgaat

SEQ ID NO: 939 - DNA, 960 bp, Glycine max
  Predicted polypeptide sequence is orthologous to G584
gtaagagagggcggaagccggcgaaccggagagaggaaccattaaaccatgttgaagcagagagacagaggagggagaagctgaaccagagattctacgcgcttcgtgctgtggttcccaacgtgtcaaagatggacaaagcgtcgcttctgggcgacgcgatatcttacatcaccgagctgaagtccaagcttcagaccctcgaatctgataaagatgtattgcataagcagcttgaaggagtgaagaaggaactcgagaaaacaaccgataacgtttcttctaatcacgcgtgtaataataacaataacaacaagttgtcgtcgaatcagccggcgttaattgacttggttgagatggacgtgaagatcattgggtgggacgcgatgataacgatcacatgcagcaagaagaaccaccccgcggcgacgttgatgacggcattgatggagttggacttggacgtgcactacgccaccgtaacgttggtcaacgatttgatgatccaacaagcaacggtgaagatgggaagtagattttacacgcaggagcagcttcgagcggcgctgtcggctaaggttggggatgtacgatgatgttggcactttgcggcagcgttgagattataagtgtgtgtttgtgtcatgttattagctagctatctctttctaagttgtgtgctgctctggggtattttaagccttcccggtagctgtttctgtaaaattttaagattttatttttctttattgggcagcttagtattgaattttgaggtaatcaagctgggaagctccatggagtagtagtataactagctagggacagttttcatcaaatctgtgggtggagtggaaataggggtaattttatctgtttaggtagtgtatatatttataataaatcataaatgtgatcatgcaagttctcaatattattatgcttcagctaaagggcggc

SEQ ID NO: 940 - DNA, 870 bp, Zea mays
  Predicted polypeptide sequence is orthologous to G584
cgcactccgcggggctccgcgggcacgacggcgggccgcgctgccacgcggtggagatcgacgccaagatcctggggctggaggccatgatccgcgtgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatcaaggaggagagctgctcagctcgcctgtggctgccggaataggggacgacactgatactactgctactcaccaccggactgtcctgtcgtcgtggtcaccacggttacaacacgataggcagaaagattcaggagggagacgacgacgatgccgatgctgtataaactttagaaggatggatggatggatggatgatgataccgagcttctgctcctgttcatcatcatcttctcgtgtttttgctagtagcgtgttaattagcaggattaagcaaccaacaagcgtccaaccgttgttgttaattaagtacatgttgttgtgagctgtgatgatgatggatccaccgatgttagggttcgattggatcgaaaactgtgtatagtatatggatcggccgtcgtcctatccggtggaggtggacgatgccctgatcctgatgtatgtatttttacagcaggatttcgctttgcaatggagtcagcctttttgatccaaaaccaaaaaaaaaaaaaaaaaaaaaaaaaaaaagggggccgctcgcgatctagaactagc

SEQ ID NO: 941 - DNA, 723 bp, Zea mays
  Predicted polypeptide sequence is orthologous to G584
tgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatcaaggaggagagctgctcagctcgcctgtggctgccggattaggggacgacactgatactactcccgcgccccaccggactgtcctgtcgtcgtggtcaccacggttacaacacgataggcggaaagattcaggagggagggagacgacgacgatgccggtgctgtataaactttagaaggatggatggatggatgatgataccgagcttctgctgctgttcatcatcatcttcttgtgtttttgctagtagcgtgttaattagcaggattaagcaaccaacaagtgtccacccgttgttgttaattaagtacatgttgtgagcgaccaaccgatgttagcgttgggttggatccaaacctgtgtatagtatatggatcagccgtcgtcctatccggtggacgatgccctgatcctgatgtatgttttttacagcaggatctcgctttgcaatggagtcaggctttttgatcaaaaaaaaaaaaaaaaacccggggttttcggaccg

SEQ ID NO: 942 - DNA, 510 bp, Zea mays
  Predicted polypeptide sequence is orthologous to G584
gaaagcgttttttgaagcccgcgaacgggcgcgaggagcgggtgaaccacgtggaggcggagcggcagcggcgggagaagctgaaccagcgcttctacgcgctgcgcgccgtggtgcccaacgtgtcgaagatggacaaggcgtcgctgctcggcgacgccatctcctacatcaacgagctccggggcaagctgacgtcgcagcagcccgccgccggaggcgaccacgtggagacggacccgtccatgctatggctcgccgacgcgccggtcatggacatcaaggattccttgtcgcacccgtcggccgagatctccgtctccaagcctccgccgcatccgccgcagatccattttgagaacgggagcacgagcacgctcacggagaaccccagccccttcgtgcacgcgccgccacccccgtcggcgcctgctgctccacagcagcggcagcaccagcaccagcaccagaatcaggcgcaccagggcccggtccgccgggagctcaaat

SEQ ID NO: 943 - protein, 688 aa, Oryza sativa
  Orthologous to G584
MEAFMASADLPAFPWGAASTPPPPPPPPHHHHQQQQQQVLPPPAAAPAAAAFNQDTLQQRLQSIIEGSRETWTYAIFWQSSIDVSTGASLLGWGDGYYKGCDDDKRKQRSSTPAAAAEQEHRKRVLRELNSLIAGAGAAPDEAVEEEVTDTEWFFLVSMTQSFPNGLGLPGQALFAAQPTWIATGLSSAPCDRARQAYTFGLRTMVCLPLATGVLELGSTDVIFQTGDSIPRIRALFNLSAAAASSWPPHPDAASADPSVLWLADAPPMDMKDSISAADISVSKPPPPPPHQIQHFENGSTSTLTENPSPSVHAPTPSQPAAPPQRQQQQQQSSQAQQGPFRRELNFSDFASNGGAAAPPFFKPETGEILNFGNDSSSGRRNPSPAPPAATASLTTAPGSLFSQHTPTLTAAANDAKSNNQKRSMEATSRASNTNNHPAATANEGMLSFSSAPTTRPSTGTGAPAKSESDHSDLEASVREVESSRVVAPPPEAEKRPRKRGRKPANGREEPLNHVEAERQRREKLNQRFYALRAVVPNVSKMDKASLLGDAISYINELRGKLTALETDKETLQSQMESLKKERDARPPAPSGGGGDGGARCHAVEIEAKILGLEAMIRVQCHKRNHPAARLMTALRELDLDVYHASVSVVKDLMIQQVAVKMASRVYSQDQLNAALYTRIAEPGTAAR

SEQ ID NO: 944 - DNA, 2409 bp, Glycine max
  Predicted polypeptide sequence is orthologous to G585
ccacgcgtccgggatgtttgaaatcaaataacaaacaggaagtgactacttttcttttgtgaccaaaatgaaagtgatgtgagtgacagtccttcacttttgatgacatttcaaagctactagaatggccaacaacgggagtccaaagcataagaagatgcaaaagaacctttgcacacaactagctgttgcagtgagaagcactcaatggagctatggtattttctgggcaccttcaaccactgaagttcggctcgtgctcgagccgaatcggctcgagcggctcgagattaagacaagaaagacagtccaagccatggaattggaaatgaaggctgataaaataggactgcagaggagtgagcaactgaaggaactgtacaagtttcttcttgcaggtgaagctgatccacaaactaaaaggccttctgctgcattagctccagaggacctctcagatttggagtggtattacttggtttgcatgtcctttgttttcaatcacaaccaaagtttgcctggaagagcactagaaattggtgacactgtctggttatgcaatgctcaacatgctgatagtaaaattttctctcgttctttgctagcaaagagtgcgtcagttcagaccgtggtgtgttttccctatcagaaaggcgttattgagataggcacaactgaactggttactgaggatcctagtctcatacaacatgtcaaggcttgcttcttagaaatctcaaagcctacatgctctgataaatcttcctctgtccttgataagccacatgatgacaaatatccaacatgcaccaagggtgaccaaagggtgttagaagcaatggctctggagaacccatgttcccttgaagaaaatatcaaatttgatcatgaccccatcaatgaattgcaagatggcaacaacgaagattctaacatggattctcctgatggttgtcagcatcatttccctatggatggatccatgattgagggtatcaatggtgtgccatctcaagttcattttgtgaatgaagccttagtcattggtgctccagattctttgagttcttgtgattgtatgtctgaggcttctgagaaccaaggcaatgattccaagaatgtggaccaaactcaacttatggaacttcaatattgccatataccacagagaagctccatggatgttggagctgatgaggacttgtgctacataagaacactttgtgctattttggggaactcatcaacttttaaaccaaacccttatgctggtaactcaaattgcaaatctagttttgcgaaatggaagaaagggagagtttctgaaaggaagaggccaaagttgcaccaaagcatgttaaagaagactttgtttaatgtcccttttatgcatagaagttactcttctctcaagtcacaaaaagagaatggcagaatgaaatggactagtaaattggaaaatgctaatgatggtttcatggagaaaacattctctgataagaaaagagaaaataaaaactttcatgttgtcaaaccaatggttccatcttctataagtgaggtagaaaaaatttcaattcttggagacacaattaagtacttgaaaaagcttgagacaagagtggaagagctagaatcttacatggaagttacagaccctgaagcaagaatcaggagaaattgccctgatgttccagagcagatgtcagataactatggcaccagaaagatttgcatgggaatgaaacccttgggtgaacaagaggaaggcttgtggtattgatgagatagccccagagctagaaagaattgtttctgaagaatcaaaggttttggatgtgaaagtcaatgtgaaggagcaggaggttctgattgagatgaaatgtccttacagggaatacatactgtatgacatcatggataccattaacaacctacatttagatgctcaaacagttgaatcatcaacaagtgatggtgttctcacattgacacttaaatctaagtttcgaggagcagcaacagcaccaacgaggatgatcaaagaagcactctggaaagtatctggaaatacttgacatgcctatttggatttcacatgatagtattagtagtagtaatagtaaatatttatgattaaacaactttagctctagaacagtgatttgtttcctaacaaaatatgtatgccttgttgtatgaaccatgattttggctattgtgcttaagtgctgacttgttagagttaccagagctccactctgtaatttttaaaccacttcagccaatctgttagcatgcatttgcaagattttgtttgcttttactgccagcagtatagaactgtttccttgcatttagaaagtgaagtgtgaatgtaaggtttcaatgtgatcaagaaggtgcttt

SEQ ID NO: 945 - DNA, 2403 bp, Glycine max
  Predicted polypeptide sequence is orthologous to G585
gtcgacccacgcgtcagcccatctgatcatataacacaacacactgcaggcttgttgtgttgtgctgtgttcattctgaaactttgatctatgtgagacaagttgtggctaccctgcaaagccagaaaaaatggtgccagagaacttgaagaaacaacttgctttggctgtgagaagcatccattggagctatgcaatcttctggactgattcaactacccaacccggggtgttgagctggggggaagggtattacaatggagacattaagactaggaaaacaagtcaaggagtagaactcaattctgaccaaatagggttgcagaggagtgaacagctgagagaactattcaaatccctcaaaactgtagaagtcacccctcaaaccaaaaggccttcagcagcagcactgtccccagaagatctcacagatgctgagtggtattacttggtttgcatgtccttcatattcaacattggccaagggttaccaggaagaactctagcaaagggtcaacccatttggctgaacaatgcccattcttctgattgtaaaatttttagccgttctcttctggcaaagagtgcatccattgagacggttgtgtgctttccgtttagggaaggggttattgagttaggtactactgaacaggtcccagaagatttgagtgtcattgaactgatcaaaacttctttcttgaatagtctgcatgccaatgttcccaataagtcagtagctacattgaaatcaaggaaccaggaaggtctttcttatgcagcatttgatcataatgactataatgttaaatcaattccagaagttgggtatgaaatagccaacacaacctctcctgatggtagttcaaatgcattccaagccaatcaaccgctagatgaaacatttatgattgaaagtataaccaatggcacttctcaagtccaaaactggcaagttattgatgatgaattgagtaactgtgtccataactccatgaattccagcgactgtatatcacaaacttttgcctgccctgagaatattgcttctgcccccaagtctaacaacccttctgatccttgtgcccgaaattttcaaaagtgcaacaacccaaaaatgaccttagtggatcctcgaagtgatgatttgcactatcagagagttctttctacccttataaaaagttctgaccagttacttatgggaatgcatttgcaaaaatttcctcaggaatcaagctttgttagttggaggaaagaacagccaatggattgcaaatggccaagagcaggaacgtcacaaaagttattgaagaaagtattgtttgaagttcctcaaatgcacttggatgggctgcatgagtctcaagaagagaatgactataaagagggaatgagagtagaggctgatgaaaacggcatgaaccatgttatgtcagaaaggaggaggagagcaaaactaaatgaaaggtttttaacccttaggtcaatggtcccttcaatcagtaaggatgacaaagtttcaatactagatgatgctattgattaccttaaaaagctcgagagaagggtaaaagagttggaagctcacagggtggtaacagacatagagactgggactagaagatcaccacaagatacggtggagaggacttctgatcattattttaggaaaaataataatggcaagaaaccagggatgaaaaagaggaaggcttgtggtgtagatgagacagaaaaagagattaattcagatgctttaaaaggaagttatgctaatgatgttactgtgagtaccagtgacaatgaaattgtgatcgaattgaagtgcccctcgaaagcaggaaggctgctagaaattatggaagcaatcaacagtttcaatatagattttagttcagttcagtcaacagaagctgatggaaatctttatctgaccattaaatctgtgctcacaggaccaagtgttgcaacaaccaaaagaatcaaacaagcactccaaaaattggcttccaagtgctgaatttttatctataccttaaaaaccgtggggggtgttgaatctaattcataccactgccgtgtgacatagagagtccattagaatgatggagtcacaactcactagtgcagctcttggagattttttttctttgaagatttctcataaaaggaaaatgtagactttcactcatctttcggcaataccataactcttggtgacgcaagatatatggactttgaatcacttgtaaatgggtaggtaggcttagttgactagatttatgtaattaatgccacttgctcctatgggaacactaaggttgaccaatgactaaatattgacagagagacgtacattattaattatgataaaaaaaaaaaaagggcggccgcaaaaag

SEQ ID NO: 946 - DNA, 911 bp, Glycine max
  Predicted polypeptide sequence is orthologous to G585
  misc_feature (893)..(893): n is a, c, g, or t
gccaagaggcacctgtcccgatttcccggttcactctacgctttcggtttgttccattaacaaacctgaggcaattgtctgggctcatgctaagtgtgcatccattgccaccgttgtgtgcattccgtttagggaaggggttattgagctagggccttctcttcaagttccaataacttttgcgtgtcattgaactgatcaaaacctcttttttaaatagtctgtatgccaacgtaccaattagtcagttgtctacattctaatcaatgaaccaggaaggcctttcttatgcaccatttgatcataatgactattatgttaaatcaatcccaaaagttgggtatgaaatagccaacacaacctcttctgatggtaagttaaaaggcaattccaagccaatcaaccgcttgatgaaacagttatgattgatagtattacccatgggccccttctcaagtccaaaactggcaaggttattgatgatgaattgagtaactgggtccataactccttgaattccagcgactggttatcacaaactttcgcctgccctgagaattttgcctctgcccccaagtctaacaacccttctgatccttgtgcccgaaattttcaaaagtgcaacaacccaaaaatgaccttagtggatcctcgaagtgatgatttgcacagccaatggattgcaaatggccaagagcaggaacgtcacaaaagttattgaagaaagtattgtttgaagttcctcaaatgcacttggatgggctgcatgagtctcaagaagagaatgactataaagagggaatgagagtagaggctgatgaaaacggcatgaaccatgttatgtcagaaaggaggaggagagcaaaactaaatgaaaggtttttaacccttangtcaatggtcccttcaat

SEQ ID NO: 947 - DNA, 440 bp, Glycine max
  Predicted polypeptide sequence is orthologous to G585
ccataaacaaacctgtggcaattgtcttctctcatgctcagagtgcatccattgagacggttgtgtgctttccgtttagggaaggggttattgagttaggtactactgaacaggtcccagaagatttgagtgtcattgaactgatcaaaacttctttcttgaatagtctgcatgccaatgttcccaataagtcagtagctacattgaaatcaaggaaccaggaaggtctttcttatgcagcatttgatcataatgactataatgttaaatcaattccagaagttgggtatgaaatagccaacacaacctctcctgatggtagttcaaatgcattccaagccaatcaaccgctagatgaaacatttatgattgaaagtataaccaatggcacttctcaagtccaaaactgggcagttattgatgatgaattgagtaactgt

SEQ ID NO: 948 - DNA, 2517 bp, Oryza sativa
  Predicted polypeptide sequence is orthologous to G585
tgctagatctctcctccacatccggactctcgctatcaaatttacgtaagcacagtgagaaaaataattagcagggccaccagcatactgttggcgtacagctgcaaatacctgtcgagctaatcttggttaaaatgttggtttagattctgttgcttaattgctggtgaggaggagcactcactatatagctcaatccatcttcctctgcaaaacgtacgcacgacactctggttgcgatcgattatcactccctgatcgcgagttcttggtctgcgagcgtctgcaattaagggaagagttcctctttgttttgacgaggatcgaggattgtttggacgaaccagcagcagcgtacgtgccaatttcattgatagtcgctgtatctgatttacaggaaaaatacatacaacagtgtgtggtaaagtatactactattactggagtactaattaatggaagagacccctctgccatccgggaagaacttcaggagccagcttgctgctgcagcgaggagcatcaattggacgtatgccatattttggtccatttcaaccagccgcccaggagttctgacttggaaggacggcttctacaacggcgagataaagacgaggaagatcacgaactccatgaacctcacggccgacgagctggtcctgcagagaagcgagcagctgagggagctctacgactctctcctctccggcgagtgcggccaccgagcgaggaggcccgtcgctgcgctgttgccggaagatctcgcggacacggaatggtactacgtcgtctgcatgacctacgccttcggcccccgccaagggttgccaggcaaaagcttcgcaagcaatgaatttgtttggctgacaaacgctcagtctgcagatagaaaactattccatcgcgcgcttatagcaaagagtgcatctattaagacaatcgtctgcgtgccatttatcatgcatggtgtccttgagctcgggaccactgatccgatttcggaggacccggctctcgtcgaccgtatcgcggcgtcgttctgggatacgccgccccgcgcggcgttctcgtcggaggcgggagacgccgacatcgtcgtcttcgaagacctcgaccatggcaacgccgccgtcgaagcgacgacgacgacggtcccgggggagccacacgcggtagccggcggcgaggtcgccgagtgcgagcccaacgccgacaacgacctcgagcagatcaccatggacgacatcggcgagctctacagcctctgcgaggagctggacgtcgtgcgccctctcgacgacgacagtagcagctgggcggtcgcggatccctggtcgtcctttcagctagttccgacgtcttctccggcgccggatcaggcgccggcggcggaagctactgacgtcgacgacgtcgtcgtcgccgctttagacggtagctccattgatggatcttgcaggccgtcgccgtcgagttttgtggcgtggaagaggacggcggactcggacgaggtgcaggccgtgccgctcatcagcggagagccgccacagaagttgctgaagaaagctgtcgccggagccggtgcctggatgaacaatggtgacagcagcgcggcggcgatgacgactcaaggaagcagcatcaagaaccatgtcatgtcagagagaaggcgccgggagaagctcaacgagatgttcctgattctcaaatcagttgtcccgtccattcacagggtggacaaagcatccattctcgcagaaacgatagcctacctcaaagagctggagaaaagagtggaagagctggaatccagcagccaaccatcgccatgtccattggaaacaagaagcaggcgaaagtgccgtgagatcactgggaagaaggtttctgcaggagcgaagagaaaggcgccggcgccggaggtggccagcgacgacgacaccgacggggagcggcgccattgtgtgagcaacgtgaacgtcaccatcatggacaacaaggaggttctcctcgagctgcaatgccagtggaaggaattgctgatgacgagagtgttcgacgcgatcaagggagtctccctggatgtcctctcggtgcaggcatcaacatcggatggtctccttggactgaagatacaagccaagtttgcctcatctgctgccgtcgaacctgggatgattacagaagctctccggaaagctatagcaagctagctagctagaaggttgagatcagtatcgtcttggtcatttgctctcatcttgtttaggaggtaccgggaaataaatcttgtcgctctgatcagtgcctccttactagtctcgtgatctgttgtaagtaatagttagacatgcatatatatcatacaacaacgtttgatcttgcatggtagcatatatatgtacaccacatttcttatatctttactcctttaaaattcagtgaggatggtaagtgatgaatctgccaccccatcaccaactccctaaaattctgaaaaaaaaaaaaaaaaaa

SEQ ID NO: 949 - DNA, 2601 bp, Zea mays
  Predicted polypeptide sequence is orthologous to G585
cccaaggttcgtggcatatctgtaggcatctaccccgtcttcgtcgtccgctcctcactagctaccaagaggtcgccattattgccaacatagagtgtacgtggatgtctatatatatgcctacttgcacccatatggcataggcgttcgatccccttagcgcggaggagagctcctccggttcttctctacccttcgcatggaagttcttgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccacctcgtcatgcagaggagcgaccagctccgggagctctacgaggccctcctgtcgggcgagggcgaccgccgcgctgcgcctgcgcggccggccggctcgctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagaccggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccgctaccgctagaggacggctggaccgtggacgcgtccaatttcgaggtcccctgctcttccccgaacccagcgccgcccccggtggacagggctaccgctaacgtcgccgccgacgcctcaagggcacccgtctacggctctcgcgcgaccagtttcatggcttggacgaggtcctcgcggcagtcgtcgtgctccgacgaagcggcgcccgcagtagtgccggccatcgaggagccgcagagattgctgaagaaagtggtggccggcggcggcggtgcttgggagagctgtggcggcgcgacgggagcagcacaggaaatgagtgccaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctctatatcaacaattatatgggcatgaatacttaagactccagcccttaacacgtagaaactcaaaaaagaagagaggaagctaaagactaagcgtaaggtatatttggaagtaaattgtttttgatagtttctaagcgatcccatggttttataggaatactagagtgtttatggcataaggtgtttggttgcattcataaaacctatattttcaaagtcatagcattctagataccatgatatttttgtaatattggaaactacactccaacgcaaagtttttatgacatggct

SEQ ID NO: 950 - DNA, 2563 bp, Zea mays
  Predicted polypeptide sequence is orthologous to G585
taggcgttcgatccccttagcgcggaggggagctcctccggttcttctctacccttcgcatggaagttcttattgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggttcgttccttcacatagaagcgagtacagactacagaccacacagtatcagctggcacgaaacgaaaatggttacttgcaaattgcatgcacgagctagaattatattcttctaatcttcttcgttgactttctggcttcagcaggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgacgtactcggaagagccgagctccagcccgtcaggacgagcaaacgagaccggcgaggccgcagcagacgacggcacgtttgcgttcgaggaactcgaccacaataatggcatggacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcgcccgtctacggctctcgcgcgaccagtttcatggcttggacgaggtcctcgcagcagtcgtcgtgctccgacgacgcggcgccggcagtagtgccggccatcgaggagccgcagagattgctgaagaaagtggtggccggcggcggtgcttgggagagctgtggcggcgcgacgggagcagcacaggaaatgagtgccaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagcgaagggtgcaagagctggagtccagtagggaacctgcgtcgcgcccatccgaaacgacgacaaggctaataacaaggccctcccgtggcaataatgagagtgtgaggaaggaagtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctttatatcaacaattatattggcatgaatacttaagactccagcccttaacacgtagaaactcaaaaaagaagaaaggaagctaaagactaagcgtaaggtatatttggaagtaaattatttttatagtttctaagcaatctcatggtttataggaatactagagtgtttatggcataaggtgtttggttgcattcataaaacctatattttcaaagtcatagcattctagatacca

SEQ ID NO: 951 - DNA, 2004 bp, Zea mays
  Predicted polypeptide sequence is orthologous to G585
ccacgaaatggaaatggtcacttccaaattgcacgagctggaattatatactcttctgatcttcttcaccgtctctttatagcgtgatatgcgtttctggcttcttgcttacgtgaaggattattagtaaggcgcgtgatggcgctctcagcttccccggctcaggaagaactgctgcagcctgctgggaggccgttgaggaagcagcttgctgcagccgcgaggagcatcaactggagctatgccctcttctggtccatttcaagcactcaacgacctcgggtgctgacgtggacggacgggttctacaatggcgaggtgaagacgcgtaagatctcccactccgtggagctgacagccgaccagctgctcatgcagaggagcgagcagctccgggagctctacgaggccctccggtccggcgagtgcgaccgccgcggcgcgcggccggtgggctcgctgtcgccggaggacctcggggacaccgagtggtactacgtgatctgcatgacctacgccttcctgccgggccaaggcttgcccggcaggagttccgcgagcaacgagcatgtctggctgtgcaacgcgcacctcgccggcagcaaggacttcccccgcgcgctcctggccaagagcgcgtccattcagacaatcgtctgcatcccgctcatgggtggcgtgcttgagcttggtactactgataaggtgccggaggacccggacttggtcagccgagcaaccgtagcattctgggagccgcaatgtccgacatactcgaaagagccgagctccaacccgtcagcatacgaaaccggggaagccgcatacatagtcgtgttggaggacctcgatcacaatgccatggacatggagacggtgactgccgccgccgggagacacggaaccggacaggagctaggagaagtcgagagcccgtcaaatgcaagcctggagcacatcaccaaggggatcgacgagttctacagcctctgcgaggaaatggacgtgcagccgctagaggatgcctggataatggacgggtctaatttcgaagtcccgtcgtcagcgctcccggtggatggctcaagcgcacccgctgatggttctcgcgcgacaagtttcgtggtttggacgaggtcatcgcactcctgctcgggtgaagcggcggtgccggtcatcgaagagccgcagaaattgctgaagaaagcgttggccggcggcggtgcttgggcgaacacgaactgcggtggcgggggcacgacggtaacagcccaggaaaacggcgccaagaaccacgtcatgtcagagcgaaagcgccgggagaagctcaacgagatgttcctcgttctcaagtcgttggttccctccattcacaaggtggacaaagcatccatcctcgccgaaacgatagcctatctaaaggagcttcaacgaagggtacaagaactggaatccaggaggcaaggtggcagtgggtgtgtcagcaagaaagtctgtgtgggctccaactccaagaggaagagcccagagttcgccggtggcgcgaaggagcacccctgggtcctccccatggacggcaccagcaacgtcaccgtcaccgtctcggacacgaacgtgctcctggaggtgcaatgccggtgggagaagctcctgatgacacgggtgttcgacgccatcaagagcctccatttggacgctctctcggttcaggcttcggcaccagatggcttcatgaggctcaagataggagctcagtttgcaggctccggcgccgtcgtgcccggaatgatcagccaatctcttcgtaaagctatagggaagcgatgaaagggcgctacatgtgaagcttaattaatggaagcaaacttgtatttcttgtgcaaaagcttactatatatttctgcaaaacctggtgtgccttgttttgattttcagtcgccaattgtgcccttgtttttatcaagtgatgatctacaaaatatataaggaatctttgaaaaccga

SEQ ID NO: 952 - DNA, 1568 bp, Zea mays
  Predicted polypeptide sequence is orthologous to G585
cggacgcgtgggctgcatcccggttatgggcggcgtgcttgagcttggcacaactgacacggtgccggaggccccggacttggtcagccgagcaaccgcggctttctgggagccgcagtgcccgacgtactcggaagagccgagctccagcccgtcagaagcaaacgagaccggcgaggccgcagcagacgacggcacgtttgcgttcgaggaactcgaccacaataatggcatggacatagaggcgatgaccgccgccgggggacacgggcaggaggaggagctaagagaagccgaggccctgccagacgatgcaagcctggagcacatcaccaacgagatcgaggagttctacagcctctgcgaggaattggacctgcaggcgctaccgctaccactagaggacggctggaccgtggacgcgtccaatttcgaggtcccctgctcttccccgaacccagcgccgcccccggtggacagggctaccgctaacgtcgccgccgacgcctcaagggcacccgtctacggctctcgcgcgaccagtttcatggcttggacgaggtcctcgcggcagtcgtcgtgctccgacgaagcggcgccggcagtagtgccggccatcgaggagccgcagagattgctgaagaaagtggtggccggcggcggcggtgcttgggagagctgtggcggcgcgacgggagcagcacaggaaatgagtgccaccaagaaccacgtcatgtcggagcgaaagcgacgagagaagctcaacgagatgttcctcgtcctcaagtcactgcttccgtccattcacagggtgaacaaagcgtcgatcctcgccgaaaccatagcctacctcaaggagcttcagcgaagggtgcaagagctggagtccggtagggaacctgcgtcgcggccatccgaaacgacgacaaggctaataacaaggccctcccgtggcaatgagagtgtgaggaaggaagcctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgctatcaagggcctccatctggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaattggacctctatatcaacaattatattggcatgaatacttagactccagcccttaacacgtagaaactcaaaaaagaagaaaggaagctaaagactaagcgtaaggtatatttggaagtaaattgtttttgatagtttctaagcgatcccatggttttatagg

SEQ ID NO: 953 - protein, 375 aa, Oryza sativa
  Orthologous to G585
MEQVLEDPQLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 954 - protein, 370 aa, Oryza sativa
  Orthologous to G585
MSRVPTSWGFVYSRVNKVSEEPNVVNRITTAFWELQLPACSDEPISSGTPSSPSSPPTKETGDANTVVIDDLFLAHSDAILPAGGDQKEEHQLGDDLGQQQAATAMEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPCSETIIGGGGGGGGAGAVKEHHHWVLSESQEGTPSDVRVIVMDKDELHLEVQCRWKELMMTRVFDAIKSLRLDVVSVQASAPDGLLGLKIRAKYASSAAVVPAMISETLRTAVAGY

SEQ ID NO: 955 - protein, 506 aa, Oryza sativa
  Orthologous to G585
MADELVLQRSEQLRELYDSLLSGECGHRARRPVAALLPEDLGDTEWYYVVCMTYAFGPRQGCVWLPGKSFASNEFVWLTNAQSADRKLFHRALIAKTIVCVPFIMHGVLELGTTDPISEDPALVDRIAASFWDTPPRAAFSSEAGDADIVVFEDLDHGNAAVEATTTTVPGEPHAVAGGEVAECEPNSDNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKVVISAAK

SEQ ID NO: 956 - protein, 265 aa, Oryza sativa
  Orthologous to G585
MVSEDPNLVNRIVAYLKELQFPICLEVPSSTPSPDETEDADTVFDGLIEEDQMVILQGEDELGDVVVAECETNGANPETITMETDEFYSLCEELDLDLGSYQLVPTSARETVAAAAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 957 - protein, 567 aa, Oryza sativa
  Orthologous to G585
MASAPPVQEEPLQPGTNHFRSLLAAAVRSISWSYAIFWSISTSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKTIICIPFTSGVLELGTTDPTFIIAYACHNMEQVLEDPKLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 958 - protein, 265 aa, Oryza sativa
  Orthologous to G585
MEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPCSETIIGGGGGGGGAGAVKEHHHWVLSESQEGTPSDVRVIVMDKDELHLEVQCRWKELMMTRVFDAIKSLRLDVVSVQASAPDGLLGLKIRAKYASSAAVVPAMISETLRTAVAGY

SEQ ID NO: 959 - protein, 620 aa, Gossypium hirsutum
  Orthologous to G585
MSTGVQHQERVPMNLKKQLALAVRNIQWSYAIFWSISTRQPGVLEWGEGYYNGDIKTRKTVQSVELNTDQLSLQRSEQLRQLYESLSAGESSPQAKRPSAALSPEDLTDTEWYYLVCMSFVFNIGQGLPGRTLSSGQPVWLCNAHCADSKVFGRSLLAKSASIQTAVCFPFSGGVVELGVTDLVFEDLSLIQRVKTLLLDDPQPIVSKRSIQVDGMNNDLACPALDPLILATKLSPILGCEQLETVSPDDSPDGLEPKQSREDSLLIEGINGGASQVQSWQFMDEEFSNCVHHSLNSSDCISQTIADHRKVVPLCRGENDNGLQDVEECNQTKLTSFDRQNDDRHFHEVLSALFKSSHPLILGPQFRNSNKESSFIRWQKNGLKPQKERDETPQKLLKKILFLVPHMHDRGLIESPETNAVRDAAWRPEADEICGNHVLSERKRREKINERLMMLKSLVPANNKADKVSILDVTIEYLQTLERRVAELESCRKSEARTKIERTSDNNGKKSSLSKRKAYDVVDEADQEIGYVASKDGSTDKVTLSMNNKELLIEFKCPWREGILLEVMDALSILNLDCHSVQSSTTEGILSLTIKSKYKGSSVAKAGPIEQALQRIASKC

SEQ ID NO: 960 - protein, 644 aa, Antirrhinum majus
  Orthologous to G585
MATGIQNQKIVPENLRKQLAIAVRSIQWSYAIFWSNSVAQPGVLEWGDGFYNGDIKTRKTVQSVELNQDQLGLQRSDQLRELYESLSLGETNTQAKRPTAALSPEDLTDAEWFFLVCMSFIFNIGQGLPGRTLARNQAVWLCNAHRADTKVFSRSLLAKSASIQTVVCFPYSEGVVELGATELVPEDLNLIQHIKTSFLDSPATVPKIPNYVSNSITNNNDLICEALEHANIPENDLDQLLNCPDTNICSPDNSLDDFADNLLIDESNLAEGINGEVPQTQSWPFMDDAISNCLNSSMNSSDCISQTHENLESFAPLSDGKGPPETNNCMHSTQKCNQQIENTGVQGDEVHYQGVLSNLLKSSHQLVLGPYFRNGNRESSFVSWNKDGSSGTHVPRSGTSQRFLKKVLFEVARMHENSRLDAGKQKGNSDCLAKPTADEIDRNHVLSERKRREKINERFMILASLVPSGGKVDKVSILDHTIDYLRGLERKVDELESNKMVKGRGRESTTKTKLHDAIERTSDNYGATRTSNVKKPLTNKRKASDTDKIGAVNSRGRLKDSLTDNITVNITNKDVLIVVTCSSKEFVLLEVMEAVRRLSLDSETVQSSNRDGMISITIKAKCKGLKVASASVIKQALQKVTMKS

SEQ ID NO: 961 - DNA, 1695 bp, Glycine max
  Predicted polypeptide sequence is orthologous to G590
  misc_feature (8)..(8): n is a, c, g, or t
aaggcaanttgtttttatcgggaactgaaataaaacccccataggattttctacaggggttatataatccgcataacaatggggagttatattctctgcatacattatacatacataattttatcaactcgagaagctagaaagagaaaaaaaaaaaaatctgctctcatgtcacgtaggccagaggctttttgagaacattacaaaatgctcaagggataatattgagattcctgcttttacgaaaccaaaattcagaaggcattactggcagtaaacttcaaaaatctgacttttcggtcttcgagttgccactgaccactttctcccttctgcagtctctggtgaaaagcttttcaagacatgttgcattgcatgcacgaacctagctacatatcattcacataagcatcatatacctacctaccaacaatgttggtctcactatttcttatgatcactcctgaatgatctcttccgccaatgcatggttgcgaagagttgctgttgtctttgggttcacatgcttgcgtgtcaaaagggaatgatagtctcgtgcctgattcgaattctttgacaacttgagaaccacctaatgtattggcatctgaatggataccacttgattgctggtgctgcaaaatgtcttcccctcgtattggctcagaagatcctcctttgtgttgaagaggtttcatatccgtttggattcggggttccagaccgaaagaagtttctgggttgtcaatgtatggaggatagggcacagatggctgatttgggagattgtgtttgttaggtagattggatgcatagtgcaagggattgttgtcttggtgcagaggcagagtagctgacatgtttaaagaggtaaacctgtttctttcacttaattccatacccatctgagacaactgcagaggctgcaagccttcaggaaagcacataggatgcaaactcaacccatttctcattgacagcatctgtacttgtagctgaagctgtttaaggtattcaatagcttcatcgagcattgaagccttatctgtcttgttagaatttggaattaggttttgcaaagccttcattttctcgttgatcctaccccttctccgcttctctgacaaattatgaacttctgcagctcttgatcttttagatgaactcctagaagaagcagcctttgttggaacttcttcggccggagcctcaacaccctcctcactctcacaatcatagtcatcattctcgttctcactcactccagcagaagaagaagacacatttgcagcagaagcaccatggcccttgaaggaactgcaagcggcagaacccgaggcaaaagaagcggtggaatcaacggccaagatcttcccatcttggagctgtgacgccgtgaaagaagggtggtgtgcatttacgttttgttgagcagcgttggaggtgcaggatccagcaggcatggagtgggaaggtgaagatgaacggagcagaatctgacgcagaaaaagtgagatttcgtcttgtgaggagaggttcttgtcaaagtggtacatgtcacccattctgtgtgtgtgtgtgtgtgtttgaagaatgcagagaactgaaaggggtttcggtttggttgtggtggttttgttttgttttcggacgcgtggtgagaagaggagagaaagaaagtagtaaatggtactg

SEQ ID NO: 962 - DNA, 1373 bp, Glycine max
  Predicted polypeptide sequence is orthologous to G590
acggctgcgagaagacgacagaaggggcaccctatgtagaaaaaacgaaattcccaaaaaatagacagggacataacctaaagcagcatataaatatcacacatcaggtcagataatacacggccgatagcataacagagcacaccaacaccaacatcagcattctcattctctctctgctccctgtcggttttggctttgatctttcaagttcaatggctggtgacgtaggaagagccttgcctcctcctgattcagaagaattctcaaccttgttcagccaactcctccacaattctcccccactaggaatggaccccaatcattcacctcctgatttcaccccacacaacaccaccatcaacatcaacagcaacaacaacaacaacgctgggccttcctctccctcaaatttcaatttaaatttcaatttctctgacccccatcattacatccctgcctctgatgccaccaccttcaagcaacacaacatcaaccacaacaacaatcacacccctgatttcacttcttctcatgttgagaagagtgtggaggcatcgaaacctgtcccaccaccacgttcttcgtcaaagaggagtagagctgcagagttccataatttgtctgaaaagagaaggaggagtaggattaacgagaaaatgaaagccttacagaatttaattccaaattccaacaagacagacaaagcttcaatgctagatgaggccatagaatatttaaagcagctccagcttcaagtgcaaatgttaatgatgagaaatggtttgagcttgcatccaatgtctttgccaggaggactaagacctatgataatgcctcagactggattgaatcttgatgggagtaatggatttcagaattctacctgtgcaattgcctcatcttcaaatgatgaaagcttggtgcggcatgcctttagttttccaaagcaatgcagcatctcaaataagtctattggtgtaccctccgtgaaaaacatagcaacttcggatacctcatccacttttcatccctctattaaggatgcactctacggcaacatgccacaaccgtttatggatacaacaaagattggaaaaccctctccagacgtgtcttaaacagctcgatttcattgagggagaaaagaattttttagatggcaagtcgcctcgtaaaagggtagctttgttcaggcattataatctacatttaaatctgctgactatatgacactccattgggttgttcctggtgcagtttaatttgtagcagtttgacagagtctttgtgccattgttgacacttgcataaaaatgtacaagtattttataacttcatcaattgcaaaatgcagataatgaacattctgc

SEQ ID NO: 963 - DNA, 930 bp, Glycine max
  Predicted polypeptide sequence is orthologous to G590
ctctctctctccaagttgtttttggtttgatctttcaagttcaatggctggtgacgtaggaagagccttgcctgctcctgattcagaagaagggtgagccttgttcagccaactcctccacaattctcccccactaggaatggaccccaatcattcacctcctgatttcaccccacacaacaacaccatcgacatcaacatcaacaacaacatcatcaacaacaacaacaacaacaaccctggtcctttctcttccttcaaatttaaatttctctgacccccatcattacatccctgcctctgatgccaccacctttaaacaacacacccctgatttcacttctttttctgttgagaagagtgtggaggcatcgaaacctgtcccaccaccacgttcttcttcgtcatagaggagtagagctgcagagttccataatttgtctgaaaagagaaggaggggtaggattaacgagaaaatgaaagccttgcagaatttaattccaaattccaacaagacagacaaagcttcaatgctagatgaggccatagaatatttaaagcagctccagcttcaagtgcaatacttgtgattgattctgcagatgttaatgatgagaaatggtttgagcttgcatccaatgtctttgccaggaggactaagacctatgataatgcctcagactggattgaatcttgatgggagtaatggatttcagaattctacctgtgcaattgcctcatcttcaaatgatgaaagcttggtgcggcatgcctttagttttccaaagcaatgcagcatctcaaataagtctattggtgtaccctccgtgaaaaacatagcaacttcggatacctcatccacttttcatccctctattaaggatgcactctacggcaacatgccacaaccgtttatggatacaacaaaga

SEQ ID NO: 964 - DNA, 670 bp, Oryza sativa
  Predicted polypeptide sequence is orthologous to G590
aactagtggatccccgggctgcaggcaatgaacctctccaccccaccccgcgacgcgacgcgacgagccgtacaccgaccgccccgcgccgctgctgccggagccggagagagaagctgaagccgaagcagaggcagccgcagcggcaaaactcaaaagacgtcgtcaaaagctctgccgcgcttgcagctttctcgggctcaaggaaaagccatcacaaaaccagagacacacagagagagagagagagagagagagagagagagactgaagaaaggtggcaactcctgcagcagctgcagcagcaagcgctagtgtttgtggtttgctggtgctgtggcgaggcgatgatggatgggcgaggaagccaggaggaggagcacctggatttgatcatgcgacaccacgccagcatggggctggatcgctgcgagagcgaggaggcgctggggtcgtcggagtcggagcagcccaccaggccggcgcggccgcgcggcaagaggagccgcgccgccgaggtgcacaacctctccgagaagaggaggaggagcagaatcaatgagaagatgaaggccctgcagagcctcattcccaactccagcaagacggacaaagcctccatgcttgacgatgccatcgagtacctgaagcagcttcagctccaggtcca

SEQ ID NO: 965 - DNA, 908 bp, Zea mays
  Predicted polypeptide sequence is orthologous to G590
  misc_feature (6)..(6): n is a, c, g, or t
cggggnaaccgtcccgtctccaatcctaaatgcacccgccgtttgcgatgcgacggacgacgacgcggccggaggagagggaggcccgcgaccgaggcgaagcgcaggaccgccggcactgcagccgatcgaaaggcgctctcaaaagctctgcgctgcgctggcagctttgagctttctcgggccggagaaaagccgaaacaaacaaacggactggccgagtcgaggagagagagagggtgagagggagaagagaaggcggagagagaaagcgagctgaggagcgcaggcgctgtcgctggcgaggacatgctcgcggcagcgcggtatgggctcaaaccataggcgtgtcaggaacggtggagagcggcgaccactactcgccttcgtctcggtcctcgcgcgctcctgggctgcctcttggtgctagaaaccctcgcgtcgcgggtgcttggttgcgactgcaagcgccaagctgctgtgctgtgccgtgggtggcggcggcgggagtggaagtggaaccgcagccggtgctgtgatggacgcgcagcagcagctggatttggtcatgcgtcaccagagcatggccaccgtctgcgagagcgaggacgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgttgcagaccctcatacccaactcgagcaagacggacaaggcttccatgcttgatgatgccattgagtacctgaagcatcttcagctccaggtgcagatgttgtctatgaggaatggcctctatctgcccccaggaaacctggtctggagcacccgagactctggcaccc

SEQ ID NO: 966 - protein, 315 aa, Oryza sativa
  Orthologous to G590
MGLDRCESEVGVRCPRLIRSDAGGDLAALGSSESEQPTRPARPRGKRSRAAEVHNLSEKRRRSRINEKMKALQSLIPNSSKTDKASMLDDAIEYLKQLQLQVQMLSMRNGLYLPPVNLSGAPEHLPIPQMSAALDQNSAKASDPSVVLQPVNQTSGALLPFELASQHKPLFLPGVPNATALEPRFLVESSRSNLQSLRFTEPAEMIYPDEMMLKHRLTSASESTIVPGTDEKSVRQNTYMMNADRFDRYALSKDQLQHIMPKNTESVLDMPHLQRILTKVLIVSDYKLTIQLPILDRLQTSDTKVRVEGRIKVNP

SEQ ID NO: 967 - protein, 315 aa, Oryza sativa
  Orthologous to G590
MDEQRGRGGFDELVLLHQQQEQRRRREQQQEEEEEEEVRRQMFGAVVGGLAAFPAAAAALGQQQVDCGGELGGFCDSEAGGSSEPEAAAGARPRGGSGSKRSRAAEVHNLSEKRRRSKINEKMKALQSLIPNSNKTDKASMLDEAIEYLKQLQLQVQMLSMRNGVYLNPSYLSGALEPAQASQMFAALGGNNVTVVHPGTVMPPVNQSSGAHHLFDPLNSPPQNQPQSLILPSVPSTAIPEPPFHLESSQSHLRQFQLPGSSEFHKILFLHVLLSVKDGVSWRDNAKAPPIITSRKSARKRDELHQERIIHVEHQ

SEQ ID NO: 968 - DNA, 1309 bp, Oryza sativa
  Predicted polypeptide sequence is orthologous to G597
ccgcgcaagtacgcgcccgacgggagcatggcgctcgcgctcgcccccatctcctccgcctccggcggcgccgcgccgccgcctccgccgccagggcaccagccgcacggcttctccatcagcagcccggcgtcggatccgaacgccaagcgccgcggccggccacccggctccggcaagaagaagcagttcgaagccctaggctcatggggcatcgccttcactcctcacatcctcaccgtcaaggccggcgaggatgttgcttcaaaaattatggccttctcacagcaaggccctcgcacagtttgcattctctcagcgaatggtgcaataagcaatgtaacacttcggcagccagctacatctggtggacttgtgacttatgagggccgatttgagatcatctctctatcaggttctttcctgcttgcagaggatggcgacactcgcagcaggactggtggcctgagtgtcgcacttgcaggatctgatggccgagttcttggtggatgtgtagctggaatgctgatggccgcaacccctgtccaggttgtcgtggctagcttcatcgcggaaggtaagaaatcgaagccagtcgagacaaggaaggtcgaaccgatgtcagcgcctccacagatggcaacctacgtgccagctccggtggcgagcccgccatcggagggcacatccagtggatcgtccgatgactcgggcagcccgatcaaccacagcgggatgccgtacaaccactccgggcagcagcagcaacaccagcagcaccagcacatgccccctgcttacgcatccggtggctggtcgctctcagctcatcatcagaacaggcacgactctgacatgaagatgatgtcgaactaacactctgctcggcctcgaggcgccccatttgtttggttgggctgaagaaggagctgatgatggatggtggatcgtgttcgtacccccctctgctagctaagagatttaggaccatggtgatgaatgatctcagagagatgtgttgttgctgttgtttttccttggagtaagattaatttaggcgctgttgtaacgctgtagctgtcataattaagccgcctctaacgcaagagtttattatgtgttgtactaccggtggatatgccttctgcttgtctgtcttgctgagatcttcacctccttagtaggctagtagtagtctacatacagacttgtatgaatttacctgaatgctttgatttcaattcgagaacttttactaggttgtttcaaaaaaaaaaaaaaaaaaaacgacctgcagcccggggatcca

SEQ ID NO: 969 - DNA, 1040 bp, Oryza sativa
  Predicted polypeptide sequence is orthologous to G597
atgattaggtgacactatagaagagctatgacgtcgcatgcacgcgtacgtacttggatcctctagagcggccgcggcgccgccgcagagcgggcgcttggcgtacaccgcggacggcaccccggtgttcgccccggtgagcgccgcggtctcggcgccgccgggttaccagccgggtggcgccgccggtggcaatggcgcggcggcgctggcggactccggcggggagcccgtggccaagaagaagcgcgggcggccgaggaagtacggccccgacgggtccatgtcgctggggttggtgacctcgccgacggccgccgcgtcgacgccggtggcgcagggcgtcccagggccgttctcgccgacgcagccgaagccgccggcgagcttcttgtcgtcggggtggccggacggggtgaagaagcgtggccggcccaagggttctaccaacaagccgcgcatcgacgccgtcggatcggcgggagttggatttacaccacacgttattacagttctagctggagaggatgtgtctgcaaagattatgtcgtttgctcagcatggaaatcgtgcggtttgtgttctttcagcaaatggtgccatatcaaatgtaacacttcgccaaactgctacttcaggtggaacagtaacatatgagggccgattcgagatactatcgctgtctggctctttccttctaaccgaccatggaggccagcgtagtcgaactgggggactcagtgtttcactggctggtcctgatggtcgtctgttgggaggcggtgttgccggacttctcatagcagctactccagtccagattgtggttggaagcttcaattctgaagggaaaaaggagccaaagcagcatgctcattcagaacccgcatccgcgccatcgaaagccgtgccgacggccgggatgggacccaacagcccaccttcaagaggcacacttgagtgaatcctcaggtggagctggaagcccatggcatgctagacaagaatggcgcctcgtgccgaattcctgcagcccgggg

SEQ ID NO: 970 - DNA, 1172 bp, Oryza sativa
  Predicted polypeptide sequence is orthologous to G597
ttttttttttttttttttaccagaaggtaaaagttctgtgcctcttgctaaccgcaacatgccaacatagttacatagaagcaatgagctttttcatcggtgtctggaagatagaaaaacaatttaaccacctaaataacacattgagtctagtctccaatagtaacagcacctacaccagaagagctagctagagatgcaacggctacagttttcttccctgattcaggttcagacattacactagataggggggcctcctccgccccctcgcctcccgccgccggacctcgagtaccaccgccacgacatttcctttcgcaagttctacggcggtcagacgggaccaaggtctggtcactgatgatgaggaggaggaggagctcacttccaggataagctgggtagccctggctggccatggttgctggccgtgacaccttggttcagcgggctccccgggccgcccgatgattcactcaatgtgcccctcgatggcgggctgcttggccccgtcccgctcatcggcaccatctttagcggtgcagacattgggtctgaaggagcatgcagcttcggcccctttttcccttcggtgttgaagcttcccaccacaatctgcactggtgaagcagctgtcagaagtccagcaactccaccacccaagacgcgaccatcagggcctgctagagaaacactgagcccaccagttcgactacgatggcctccattctctgatagaaggaatgaaccggacagcgacagtatctcaaatcgtccctcgtatgttactgttccaccggaagtagcagcttgccgaagtgtcacatttgatatggcgccgtttgctgacagaacgcatactccacgagttccatgctgggagaatgacatgatctttgcagatacatcctctccagctttaacaaaaataacatgaggtgtgaatccagctcctgctgacccgatatctccaattccgaaagagggcacgtgcttcttgttcgtggagccctttggccgccccctcttcttcgcccccggcggcggcgccgacaacacggcgtccggcgacttcgcggcagccgccggcgagaaaggcccggaggccgccaccgccgcggtggacacgggcaccaatgccagcctgcagcccgggggatccactagtt

SEQ ID NO: 971 - DNA, 1923 bp, Zea mays
  Predicted polypeptide sequence is orthologous to G597
tatcgagctagtgacacccaagacgcttgacagctcagcgtcgtctgagtcagaagtacgtgtcctctattacagcactctcggatccgtcgctcgtgtcgacgttgagacatcgtactcgtctactatcgctcttgctgtcagtgtcggacgcacgcgactgtagcttcattcgctctctctttggtccgttatgcgattgtgtccctatgacttgcccaccggccccccccgacacctatacgaccactataaggaagctggtacgcctgcaggtaccggtccggaattcccgggtcgacccacgcgtccgcccacgcgtccggacgaggcgcgctgcggcacgggtgaggggagctgcgccggagcaccagccctagggttttcaccgccctgccgcgagatggacgtccgggacctgcaccagcagccgcagcagcagcaggctccgccgcgcgtgggatccccgccgcaggccggcgccggcggtgtcatgatgcagcatgccgccgcgttcggcgcggcgccgccgccgtccgggttgccgcaggcctcggcggccaacgttatgcacgggatgtcccttgcctttaaccctatggcttcgccggacgcctcgtcacccataagcagcatgaagattgtggacatgccgctggggtctatgtaccgccctgattccggcgcgacgggcttgcagcagcagcagcccggctccggtggcgttggtgccagcggtggtgctatcgtcgccgtcagcggcggggaccttgtgaagaagaagagggggaggccgaggaagtacggcccagatgggagcatcggcttgggactcaagaccgccgcggcgggggtcactgaagcgacgggtgcccagtccggtggaggcgggtctacccctaaccccgacggcaagcgtagagggcgtcctcctgggtcaggcaaaaagaaacagctggatgctttgggatcttcggggacgtcgtttactccccacataataactgtgaagcccaatgaggatgttgcgtccaaaataatggctttttcccaacaaggcccgcgcactacatgcataatttcggcaaatggtgctctgtgcacggcaacactgcggcaaccagcaacctctggtgggatagtgacatatgagggccacttcgatatactctctctttcgggctcattcttgcttgcagaggatggtgacactcgcagcagaacaggtggtttgagcgtggcactggctggaagtgatggacgcatagttggaggttgtgttgctggaatgctgatggcagcgacacctgtgcaggttgtagttggcagtttcattgctgaagctaaaaagccaaaagaagagcaacccaaacgtgagccaacatcggtgccaccgcacacagctgtctttggggcggcctcgactgccagccccccatcggatggcacatcaagtgagcactccgatgatcccgggagccccatgggaccaaacggcagtgcattcaccagcgcggggcttcccctgcactccacatatgctgcagttggttggtcactatcagaggaccaaagccgttatgatccagatctaaagatgatgaccgactgatgggtgccgtttcgcagcttccttgttagcagttgacttagctgagtaggctcaataactaaggaatcctgagagtggtaaaaccttcaggaaggagtagatcacgagtaataattagtaccagtgcatgcctttgtcttgttatatcgtagttagcagtttgtatttgtatggtttcactgtcagaaagtctatgcagcattccttctggtttccatctgtatccacgtagtgcaacaattctcatccatggattggtattgctcaccccacatcatcgtatgcttgtattgcaaaaaaaaaaaaaaaaa

SEQ ID NO: 972 - DNA, 1739 bp, Zea mays
  Predicted polypeptide sequence is orthologous to G597
attcggctcgaggaaaccatgagttctaggtttgctgaaatctccctggatctttaatctgttcatctccttgcgtgagtctgtggcgttagcgtgatgccttctcctagttcatgaacttccttccggttcgcaatccctagtcgtcttgtcctgatcttacttgagtgctcgtgagctctttccagtggctaaagagtgcagatttgagttctggcccaagaaccgcgtgctagcccgccatggaggtgaggtccgagcaagggctgatggcggggagggatctattcggcatgccgaagagcccgccggcgcccgcgccgccgtcgtccgccgccatgcagagcgtgcgcatggcgtacaccgcggacggcaccgccgtgttcgctccggtgagctcttcgcctgcgacgccgtcttaccagccgcagggcgcagcccacggcgctagcatgtccgcggcgacggtcgttggaggcaatggcgctccagctgcgccgagcatgggtgagccgctggccaagaagaagcgcggacgaccaaggaagtacgggcccgacgggtccatggcgctggcaatggtgcctgcttcggcggcttcagggtcgccggcgacagggcagggtttttctgggccgttctcaccgcctgcgttaaatccggcgagctctctggtggtggcgtcgccagacgggttcaagaagcggggccggcctaagggttctaccacaagccacgcgtggacgctgctgggtcatcaggagctggatttacacctcatgttatcacagttcaagctggggaggacgtggcatcaaagattatgtcattttcccagcatggaacacacggagtttgtgttctttcagcaaatggctccatatcaaatgtaacgcttcgtcagactgctacatcaggcagaactgtaacatacgagggtcaattcgagatactgtcgctgtcggggtcattcttcctggctgaggatggtgtccagcgcagccgaaacggaggcctcagcgtgtcgctggctggtcctgatggccgtctgttgggtggtggggtcgcaggacttctagtagcggcttcaccggttcagatagtactgggaagcttcaattctggaggcggaaaggagccacaaaagcaggctccttcagaacccacatcggctccaccgagggttgctccgacagccgggatgggaggacccagcagcccttcttcaagaggcacattgagcgagtcatccggtggcgctggaagcccaccgccactgcatcgagccatggctgctagtgctagcaatagtaaccagccaccgttcttgtccagcatgccttggagatgagtttgcagcttgcattctcttggccaattccaggcaggatgtagcaatctgcgctttcagtagcgcccgttgtgtgagtagctgtgtgtagtacaagccagaagcttgggtgggaatagaattgcgtctggtaaatctgtagctctgttgtaggttccaccctgaattcctgtgctaggtgtgttgagctgtgtaagcaatgtaatcctttcagcgttatcaaatgctatttagttaaatgtttctaccaaggcatgtcgatttgaatcataagatatcaatttgctgtttgcgtcaaaaaaaaaaaaaaaaaaaaaaaaaaaaaaaaaaaaaaaaaaaggaaaaaaaaaaaaaaaaaaaaaaaaaaaaaaaaaaaaaaaaaaaaaag

SEQ ID NO: 973 - DNA, 1775 bp, Zea mays
  Predicted polypeptide sequence is orthologous to G597
ccacgcgtccgcgtgctttacttccgcttccaatataccttttttctgcgacaaaaatcatttttgttaattgcgaaaaggaaagagcccgtgtgaacaggaggggtgaggagaagagggggaaaagagagagaaatcggagggcattagcaagaaaccatgagttctaggttcgcaatccctagtcgtcttgtcctgatcttacttgagtgctcgtgagctctttccagtggctaaagactgcagatttgagttctggcccaagaaccgcgtgctagcccgccatggaggtgaggtccgagcaagggctgatggcggggagggatctattcggcatgccgaagagcccgccggcgcccgcgccgccgtcgtccgccgccatgcagagcgtgcgcatggcgtacaccgcggacggcaccgccgtgttcgctccggtgagctcttcgcctgcgacgccgtcttaccagccgcagggcgcagcccacggcgctagcatgtccgcggcgacggtcgttggaggcaatggcgctccagctgcgccgagcatgggtgagccgctggccaagaagaagcgcggacgaccaaggaagtacgggcccgacgggtccatggcgctggcaatggtgcctgcttcggcggcttcagggtcgccggcgacagggcagggtttttctgggccgttctcaccgcctgcgttaaatccggcgagctctctggtggtggcgtcgccagacggattcaagaagcggggccggcctaagggttctaccaacaggccacgcgtggacgctgctgggtcatcaggagctggatttacacctcatgttatcacagttcaagctggggaggacgtggcatcaaagattatgtcattttcccagcatggaacacacggagtttgtgttctttcagcaaatggctccatatcaaatgtaacgcttcgtcagactgctacatcaggcagaactgtaacatacgagggtcaattcgagatactgtcgctgtcggggtcattcttcctggctgaggatggtgtccagcgcagccgaaacggagggcctcagcgtgtcgctggctggtcctgatggccgtctgttgggtggtggggtcgcaggacttctagtagcggcttcaccggttcagatagtactgggaagcttcaattctggaggcggaaaggagccacaaaagcaggctccttcagaacctacatcggctccaccgagggttgctccgacagctgggatgggaggacccagcagcccttcttcaagaggcacattgagcgagtcatccggtggcgctggaagcccaccgcccctgcatcgagccatggctgctagtgctagcaatagtaaccagccaccgttcttgtccagcatgccttggagatgagtttgcagcttgcattctcttggccaattccaggcaggatgtagcaatctgcgctttcagtagcgcccgttgtgtgagtagctgtgtgcagtacaagccagaagcttgggtgggaatataattgcgtctggtaaatctgtagctctgttgtaggttccaccctgaattcctgtgctaggtgtgttgagctgtgtaagcaatgtaatcctttcagcgttatcaaatgctatttagttcaatgtttctaccaaggcatgtcgatttgaatcataagatatgaatttgctgtttgcgtctcgggcaacttctgttctagagaacgttctactcactgaaatttgagcctgttgccaagtttgaaaacaaaaaaaaaaaaaaag

SEQ ID NO: 974 - DNA, 920 bp, Zea mays
  Predicted polypeptide sequence is orthologous to G597
cattgggtacctcgaggccggcctaagggttctaccacaagccgcgcatggatgctgctggatcgtcaggagctggatttacacctcatgttatcacagttcaagctggggaggacgtgtcatcaaagatcatgtcgttttctcagcacggaccgcgtgcagtctgtgttctctcagcaaacggtgccatatcaaatgtgacgcttcgtcagactgctacatcaggcggaactgtaacatatgagggtcggttcgagatactgtcactgtcggggtcattcctcttggtggaggatggtggtcaacgcagtcgaactggagggctcagtgtgtcgttggctggtcccgacggtcgtgtgctgggcggtggagttgcagggctcctcgtagcagcttcgccagttcagatagtactgggaagtttcaattctggaggcaaaaaagaggcaaaaaagcatgctccttcagcacccacaccagcgccactgaaggtcgctcctccgacaacaaccaggatgggacccaacagcagcagccctccttcaagaggaggtacattgagcgagtcatccggtggcgccggaagcccaccaccgccgctgcatcaaggcatggctgctagcagtagcaacgaccagccgccgttcctgtccagcatcatgccatggaaatgatcctcttatgtagtagtataagtcagaagctttgagtagggaggtaaatttgtagctctactgtaggtttaaacctgaattcctgtgctacgtaggtgtattgagctgtaacggatgtgatcatttgagagctaccaagtgttgtttagttaaatgttttaccaaggcatgtcgatctgagccagaagattcttgctatgaatttgttgtttgcgcgaaaaaaaaaaaaaaaaaaagggcggccgc

SEQ ID NO: 975 - DNA, 1810 bp, Zea mays
  Predicted polypeptide sequence is orthologous to G597
cattgggtaccgtggggccgcccgagcctgacagagctgatccgacccctcaggccaggcaaagactctccgccctcccactcccacctcgccacctcctccttcctcgctcccaattttcttttttcccttccccttcggcgcggcaggattttctccatctgctttccccatttccgccgtattttattcgatttcgaggtcggttttctgttgcacagggagaaaggtcacgtccaaccgccgcgaactgcgcatgtgaactgtgcccgacgaggcgcgctgcggcacgggtgaggggagctgcgccggagcaccagccctagggttttcaccgccctgccgcgagatggacgtccgggacctgcaccagcagccgcagcagcagcaggctccgccgcgcgtgggatccccgccgcaggccggcgccggcggtgtcatgatgcagcatgccgccgcgttcggcgcggcgccgccgccgtccgggttgccgcaggcctcggcggccaacgttatgcacgggatgtcccttgcctttaaccctatggcttcgccggacgcctcgtcacccataagcagcatgaagattgtggacatgccgctggggtctatgtaccgccctgattccggcgcgacgggcttgcagcagcagcagcccggctccggtggcgttggtgccagcggtggtgctatcgtcgccgtcagcggcggggaccttgtgaagaagaagagggggaggccgaggaagtacggcccagatgggagcatcggcttgggactcaagaccgccgcggcgggggtcactgaagcgacgggtgcccagtccggtggaggcgggtctacccctaaccccgacggcaagcgtagagggcgtcctcctgggtcaggcaaaaagaaacagctggatgctttgggatcttcggggacgtcgtttactccccacataataactgtgaagcccaatgaggatgttgcgtccaaaataatggctttttcccaacaaggcccgcgcactacatgcataatttcggcaaatggtgctctgtgcacggcaacactgcggcaaccagcaacctctggtgggatagtgacatatgagggccacttcgatatactctctctttcgggctcattcttgcttgcagaggatggtgacactcgcagcagaacaggtggtttgagcgtggcactggctggaagtgatggacgcatagttggaggttgtgttgctggaatgctgatggcagcgacacctgtgcaggttgtagttggcagtttcattgctgaagctaaaaagccaaaagaagagcaacccaaacgtgagccaacatcggtgccaccgcacacagctgtctttggggcggcctcgactgccagcccccccatcggatggcacatcaagtgagcactccgatgatcccgggagccccatgggaccaaacggcagtgcattcaccagcgcggggcttcccctgcactccacatatgctgcagttggttggtcactatcagaggaccaaagccgttatgatccagatctaaagatgatgaccgactgatgggtgccgtttcgcagcttccttgctagcagttgacttagctgagtaggctcaataactaaggaatcctgagagtggtaaaaccttcaggaaggagtagatcacgagtaataattagtaccagtgcatgcctttgtcttgttatatcgtaggtagcagcctgtatttgtatggtctcactgtcagaaagtctatgcggcattccttctggtgcagaaggcatatatcacatatttcaaaccaaacaaagg

SEQ ID NO: 976 - DNA, 1393 bp, Zea mays
  Predicted polypeptide sequence is orthologous to G597
  misc_feature (60)..(60): n is a, c, g, or t
gcggccccggcggcagcctcgtcgcccgccgcgtccatgcccggcggggtgcgcctttcnttcgaccggccgcgcagacttcaaagacgggagcatggctctggcgctggcccccatctcctccgcctccgccggcggcggcggcggcgccgcagcccccgggcagcagcagcaccgcggcgggttctccatcggcagccccccgtccgaccccagcgccaagcgccgcggccggccccccggctccggcaagaagaagcagttcgaggccctgggttcctggggcatcgctttcacccctcacatcctcgccgtcaaggcaggcgaggatgttgcttcaaaaataatgacattctcacagcaaggccctcgcacagtctgcatcctctcggcgaatggcgcgattagcaacgttacgcttcggcagccagccacatctggtggactagttacttatgaggggcgcttcgagataatctcgctgtccggttctttcctgctcgcggaggatggtgacactcgcagcaggactggtggcttgagcgtcgcgctcgcgggatctgacggccgagttcttggagggtgtgtcgctggaatgcttatggctgcaactcctgtccaggtcgtggtggctagttttatcgcagaggggaagaaatctaagccagccgaagcgcggaaggtcgaaccgatggctgctcccccgccgccgccgccacagatggctgccttcgtgccggctccggtggccaccagccctccgtcggaggggacgtccagcgcgtcgtctgatgactccggcagcccgatcaaccacggtgcgatgccgttcagccactccagtcagcaccagcaccctcaccagcaccagcagcacatgccgcctgcctacgcgtccgggggctggtccctctcggtgcaccagcagaacaggcatgattctgacatgaagatgatgtcgaactaacaggcgccccattcgttggtgtttgggctggagaggaaggaaaggaacctgctgatggttaggttggtactgctgctatgaaacggtcctcttgcgcgtcgtctgtgctctggtcagtgacgacgtgtcgatctgctacttaagctaagctagctaggagagttagggttcatggtctcaccccccgctgttgtgcccctgagtaagattaatttaatttgaattagtcgctctcataatgctgcgagttgtgatggtttcctgatcagatcttcaccttctaggctagttaaaatatcatttctctagtactatggatcatggatttacttggatacttgggtttaattcaggaatttgatcgtaaaaaaaaaaaaaaaaaaaaaaaaaaaaaaaatcgagagtaaaaaaaaagggtttttaaaa

SEQ ID NO: 977 - DNA, 1789 bp, Zea mays
  Predicted polypeptide sequence is orthologous to G597
cgacaggaccactgccactgtgaagcacagcgtcagcggcgacaagacgaaggggcggaagctgccaagccgatagatctacgcaaatggagaccaaggacgtgtcgccgctcgccgccgccaccaccaccaccgcggcgcccgtgcctgcaccgacctctcaaccgcctccgccgccgccggccccttcttctatggcgccgccgcagcaccagcaccagcaccatccgccgccgccgttcgcgcagcaggcggccccggttccgtcgcctgccgcgtccatgcccggcggcatgcggctctcgttcgaccagatgtccgggaaggcgcccggggagcagcaccaccactccgcgcccatgctgtacacggtgccaccaccgcagtccgccgcgggcgcgggcgcaccgggggccaatgtgctgggcatgggcgagctgatgcgcaagaagcgcggccggccgcgcaagtacgcgcccgacgggagcatggctctggcgctggcccccatctcctccgcctccgccggcggcgccgcagcccccggacagcagcagcacggcggcgggttctccatcagcagtcccccgtccgaccccaacgccaagcgccgcggccggccccccggctctggcaagaagaagcagttcgaagccttgggctcctggggcatcgccttcacccctcacatcctcaccgtcaaggccggcgaggatgttgcttcaaaaataatgacattctcacagcaaggccctcgcacagtctgcatcctttccgcgaatggtgcaattagtaatgttacacttcggcagccagccacatctggtggactagttacttatgaggggcgctttgagataatctcgctatctggttctttcctgcttgcggaggatggtgatactcgcagcaggactggtggcttgagtgtcgcacttgcaggatctgatggccgagttcttggagggtgtgttgctggaatgcttatggctgcaactcctgttcaggttgtggtggctagctttatcgcagagggaaagaaatcaaagccagcggaagcacggaaggttgaaccgatggctgctcctccaccgcagatggctacctttgttccacctccgctggccaccagccctccatcggagggaacatccagcgcatcatctgatgactctggcagcccaatccaccacagtgcgatgccgttcagcaactccagccagcatcaacaccctcaccagcaccagcaccagcacatgccgcctgcctacgcatccgggggttggtccctctcagtgcaccagcagaataggcatgattctgacatgaagatgatgtcgaactaacagtgctcaacctaggcgtcccatttgttggttgggctggagaggaaggaagctgctgatggttggtactgccgctatgaaatggtcttcttgcgccgtctgtcctgatcagtgaccccgtgttgctctggtcaatgacggtgtgtctgctatagctaagatagctaggaaggattagagtttatgggctcacttgctgttgttcccctgggtaagattaatttaatttgaattagccgctgttgtaatgctgtagccagtgtcctgaagtcgcttatcagtcagtccctgacgcgagctgtgatggttgcctgatgagatcttcacctcctagtcctaggctagttaaaatatcatttctctagtactatgaatcatgaatttacttggatgcttcggtttgattcaggaatttgatcgtattatgtttcgttttgttcccc

SEQ ID NO: 978 - DNA, 1295 bp, Zea mays
  Predicted polypeptide sequence is orthologous to G597
ccacgcgtccgggtggcgcgcccgtgcactcgggtggcgcgggtgagccggggaccaagaaaaagcgtggccggccaagaaagtacggccccgacggctccatgtcgctggcattggtgcccgcatccatggctggggagccggcgccggcggctcttggagcttccggtcctttctcgcctaacggcccgaaggcgccgaacactgcgccgtcagcgtcgccggacggcgcgaagcagcggggccggccgaagggctccaccaacaagaagcacgtggctgcgctcgggccagcgggggcaggttttacgcctcatcttatttttgtaaaagccggagaggacgtatcggcaaagatcatgtcgttctcgcagcacgggacacgcgcggtctgcatcctttcagcaaacggcgccatatcaaatgtgacgcttcggcaatctgccacttcgggtggaacggtgacatacgagggtcgtttcgagatactgtctctgtccgggtcgtttcttctgtcagagaacggtggccagcgcagtcgaactggtgggctcagcgtttcgctagcaggccccgacggccgtgtcctgggtggctgtgttgccggactcctgacggctgcttcaccggtacagatcgtagtggggagcttcgacgccggtggaaagaagcagccgaagcagcagcagcagcagcagcttgctccgtcaccggcgccactaaatctcgcgccgacgggcgtggcggcagggccgagcagcccgccgtccagaggcacattgagcctaagcgagtcgtccagtggcgccccgccgagcccgccgcacgcaggggccagcggtggccatgggcagcagcagcagcagccacagccaggtggcttctccggtctgttctggaaatgacgagacccccggacaccgtctgaccgtggtagaactggcagaaaggactaaaggcgcgtgaggcactcgtcgaggccgaagctcactcggtgagaagcagcggtagcttgtaggtggtgtcaagactgtgtagctcttgctgttgctgtaggtgtaaatcgtgcgttgtgattgtgaggtggttgcttattgtctgtcgtctggaatggatgccgtgtactgaacctgtgcccccaatgcagcatgtcggaagttcttggtttcttctgcttgggtgcatcggcttgccgcacgatatgcatccatgcccataataatacgtgtatagatccaccttgttgtgaaggtcacaccaactccaaaaaaaaaaaaaaaaaaggcgacgcggcc

SEQ ID NO: 979 - DNA, 973 bp, Zea mays
  Predicted polypeptide sequence is orthologous to G597
tgggtacctcgaggccggccgaaggctccaccaacaagaagcacgtggctgcgctcgggccagcgggggcaggttttacgcctcatcttatttttgtaaaagccggagaggacgtatcggcaaagatcatgtcgttctcgcagcacgggacacgcgcggtctgcatcctttcagcaaacggcgccatatcaaatgtgacgcttcggcaatctgctacttcgggtggaacggtgacatacgagggtcgtttcgagatactgtctctgtccgggtcgtttcttctgtcagagaacggtggccagcgcagtcgaactggtgggctcagcgtttcgctagcaggccccgacggccgtgtcctgggtggctgtgttgccggactcctgacggctgcttcaccggtacagatcgtagtggggagcttcgacgccggtggaaagaagcagccgaagcagcagcagcagcagcttgctccgtcaccggcgccactaaatctcgcgccgacgggcgtggcggcagggccgagcagcccgccgtccagaggcacattgagcctaagcgagtcgtccagtggcgccccgccgagcccgccgcacgcaggagccagcggcggcggtggcggccatgggcagcagcagcagccaggtggcttctccggtctgttctggaaatgacgagacccctggacaccgtctgaccgtggtagaactggcactcggtgagaactgagaagcagcggtagcttgtaggtggtgtcaagactgtgtagctcttgctgttgctgtaggtgtcaatcgtgcgttgtgattgtgaggtggttgcttattgtcgtctggaatgcatgccgtgtactgaacctgtgcccccaatgcagcatgtcggaagttcttggtttcttctgtgtgggggcatcggctttccgctcgatatgcatccatgcccataataataggtgtatgtatctaaaatacatggt

SEQ ID NO: 980 - DNA, 917 bp, Zea mays
  Predicted polypeptide sequence is orthologous to G597
  misc_feature (896)..(896): n is a, c, g, or t
gggctcacacacaagaagcacgtggctgcgctcgggttcgcgggggcaggttttacgcctcatcttatttttgtaaaagccggagaggacgtatcggcaaagatcatgtcgttctcgcagcacgggacacgcgcggtctgcatcctttcagcaaacggcgccatatcaaatgtgacgcttcggcaatctgctacttcgggtggaacggtgacatacgagggtcgtttcgagatactgtctctgtccgggtcgtttcttctgtcagagaacggtgggcagcgcagtcgaactggtgggctcagcgtttcgctagcaggccccgacggccgtgtcctgggtggctgtgttgccggactcctgacggctgcttcaccggtacagactgtgcagatcgtagtggggagcttcgacgccggtggaaagaagcagccgaagcagcttgctccgtcaccggcgccactaaatctcgcgccgacgggcgtggcggcagggccgagcagcccgccgtccagaggcacattgagcctaagcgagtcgtccagtggcgccccgccgagcccgccgcacgcaggagccagcggcggccatgggcagcagcagcagccaggtggcttctccggtctgttctggaaatgacgagacccctggacaccgtctgaccgtggtagaactggcagaaaggactaaggcgcgtgaggcactcggtgagaagcagcggtagcttgtaggtggtgtcaagactgtgtagctcttgctgttgctgtaggtgtaaatcgtgcgttgtgattgtgaggtggttgcttattgtctgtcgtctggaatggatgcccgtgtactgaacctgtgcccccaatgcagcatgtcggaagttcttggtttcttcaaaaaaaaaaatncagtggcgggcgggcggggag

SEQ ID NO: 981 - DNA, 448 bp, Oryza sativa
  Predicted polypeptide sequence is orthologous to G634
gcagaattggccataaaaatgcattcttttgcacaagcacaggagaagaaaaaaagatggaatttttactccccccctgcagcattctctctagtctcttcttgggatttgattcatcctagtttagctagctattgctgcatgtatgcacacaccttcctttctttatcttttccgatgggtgcccaaatcgagtaaaattctactccatgcatgcaactttcctgaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggc

SEQ ID NO: 982 - DNA, 381 bp, Oryza sativa
  Predicted polypeptide sequence is orthologous to G634
gcggtggcgccggagatgtcgtcattcttgctctgcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcggtggggaaccggtggccgcggcaggagacgctggcgctgctcaagatccggtcggacatggacgccgcgttccgggacgccaccctcaagggcccgctctgggaggaggtctccaggaagctggggaggagggttacccgaggagcgcgaagagtgca

SEQ ID NO: 983 - DNA, 469 bp, Oryza sativa
  Predicted polypeptide sequence is orthologous to G634
  misc_feature (405)..(405): n is a, c, g, or t
ttgtttgcggcggcggcggtcggcgaggagggagccagctgttgcgcggtggggaaccggtggccgcggcaggagacgctggcgctgctcaagatccggtcggacatggacgccgcgttccgggacgccaccctcaagggcccgctctgggaggaggtctccaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcggcgccatcgccggtgacgtcgctggccccgccgccggcgacggctgtgggggtgtccggcggngtgcgcgcccccgacgagccgtcgtccgcggtggtgatggggaacgtgatgagcttttcgacgt

SEQ ID NO: 984 - DNA, 660 bp, Zea mays
  Predicted polypeptide sequence is orthologous to G634
gactagttctagatcgcggcggccgctcgcgatctagaactagcccacgcgtccgcggacgcgtgggcggcgcacagcaggtggagatgccgccgccattctcgccggctggcggcgccgggcagcggatctcgctggcggaggcgccgtcgcccatcagcagccggccgccggcatcgacgccggcgaagcagtacgacgagctcggcgcgtccggcgccggcgccgtgggcttcgacgccgagggcctggccgccgcagcagctggcgaggagggcgccagcggcggctcggcgggcaaccggtggccgcggcaggagacgctggagctgctcaagatccggtccgacatggacgccgccttccgggacgccaccctcaagggtcccctctgggagcaggtctccagtcccaccactacgctgccaagaacggaggcaccgggaacgggaacggcggcggcgcatcagagcacggctccagaggcatgcaaacgcaggcgagcaacggcagcgttggagccagcaggttcgtcggcgaaggcggcggcgcggcctcggcggcgaagaagccagaggacattatgaaggagatgatggagcagaggcaggcgccgcagcagcagcagcagcagacgcaggcggtgggtcagtggctata

SEQ ID NO: 985 - DNA, 649 bp, Zea mays
  Predicted polypeptide sequence is orthologous to G634
  misc_feature (545)..(545): n is a, c, g, or t
aattcggcacgaggagcctccttcccttctccactcttatccctctctgagtggtaacacacctggcgacgtgcacgagtgcgcgtgtgcgggagcagtagctgtactgtaagcatgcagcagcagcagcacgggggaggcggcggagcaagcggtggaggcccagcgcagcagttctgcgcacagcaggtggagatgccgctgccattctcgccggtcggcggcgctgggcagcggatctcgctggcggaggcaccgtcgcccatcagcagcgccgggcgcggcgcccggcgccggctcagcagtatgacgagctcggcccgtccggcgccggcgcagtgggctttgacgccgagggcctggccgccgccgcagctggtgaggatggcgccagcggcggctcggcgggcaaccggtggccgcggcaggagacgctggagctgctcaagatccggtcggacatggacaccgccttccgggacgccaccctcaaggcccccctctgggagcaggtctccaggaagctggctgagaaagggtacaanccggagcgccaagaagtgcaaggagaagttcgagaacgtgcacaagtactacaagcgcacaaaggagagccgcgccggccggaacgacggcaagacgtaccgat

SEQ ID NO: 986 - DNA, 750 bp, Zea mays
  Predicted polypeptide sequence is orthologous to G634
cattgggtacctcgaggccggccgggaagactatcagaaggtgaaggagagcaacaagaagcggcccgaggactccaagacctgcccatacttccaccagctcgaggccatctacaacagaaagcacctccgcagtctcacaaccgcggcgggtcgtcgggcgcgtccagcaaccggtggccgcgggaggagacgcaggcgctcatcaggatccggtcggagatggacgcaaccttccgcgacgcgacgctcaaaggccccctctgggaggacgtctccgggaagctcgccgacctgggctacaagaggagcgccaagaagtgcaaggagaagttcgagaacgtgcacaagtactacaagcgcacaaaggaaggccgcgccggcaggcaggacggcaagagctaccgcttcttcgacgagctggaggccttgcacgcagccgcgccgcagccgccgccgccgctcctgccgccgcccagcaccgccccgcagttgcacgccctcgccgcgccagtatccccgccgccccagcagcagttgccggcatccagcgccgccccgccgttgcacgccttccccgcgccagtatccgcgccgccgccgctcctcgtcccgcctacccagatcagctgaacccgagcaggcaagagatagaggggaagaacatcaacgatgacaagagggacaacggtggatcaggtggaggcacgcaggtgccgaccagcaatggcgagacagcgacgacgacga

SEQ ID NO: 987 - protein, 186 aa, Oryza sativa
  Orthologous to G634
MGLTWTPHISVPRHHPLFTIFSPFLLLSLSQSCLCRPPAGGEEAGGELLLRDRELRGRTRRRGRRVPPHLLNSHHSFYDGLYVGGVADARIRPALRTLKQNMSLLLSVLIDRVQPVAQPLVAGVGDGKGAAQRELLEHNGLLGGEEGDRSGSRAGNRWPRQETLALLKIRSEMDVAFREAVLKGPL

SEQ ID NO: 988 - protein, 737 aa, Oryza sativa
  Orthologous to G634
MQQHQGGGSQYGAVPPDMGPFSPTHHASAPAPLPLSTATAAALSQPPPPQQQQQQPRTSYDELAAATSAGAGGFPDDDMLGDAGGSGGGGGSGAAGNRWPREETLALIRIRSEMDATFRDATLKGPLWEEVSRKLAELGYKRSAKKCKEKFENVHKYYKRTKEGRAGRQDGKSYRFFTELEALHAAAPQTPQPQQQQQQQLPPVTSSAPAMHAFAPPVPAPPPMSAMPPPPGPIQPAPISSAAPAVPLELPPQPPINLQGLSFSSMSGSESDDESEDDEMTAETGGSQDRLGKRKQAPAAKGWRLSSRGSSSKSSTGRRRCSGGFWRLWRSERRTHGREEAWRRQEVARLNREQEQLAQERAAAASRDAAIISFLQRIGGQSVQVPPAATVIQMPTPVQLQTPPPVKQPARQHQPQPTPPPPQAAPIPAAPLQQQPPQPQHKETIHHEAVTPRRAPPTSGSSLELVPAAEQHVESGLGGGEGGSASSSRWPKTEVQALIQLRMELDMRYQETGPKGPLWEEISSGMRRLGYNRSSKRCKEKWENINKYFKKVKESNKKRPEDSKTCPYFHQLDVIYRRKHLTGGGGGGASAANVAATAIEHQNPNRHEIEGKNINDNDKRKNGGGGGAQVPTSNGDTAPTTATFDVDSGMKKPEDIVRELSEQPPREFTTDETDSDDMGDDYTDDGEEGEDDGKMQYRIQFQRPNPGGANTAPPPATTPASAVPTSTPTSTFLAMVQ

SEQ ID NO: 989 - DNA, 2267 bp, Glycine max
  Predicted polypeptide sequence is orthologous to G635
gttattacaacccagtttgcgtcaaatctacatcggcttggtagtgtgaaagctgctgctgatttaactggcagaaagttggtatttgttggcatgtctttaaggacttatttagatgcagcttggaaggatggaaaggctccaattgatccatccactctggtgaaagcggaggatattgatgcttatgcgccaaaggatctgcttattgtgacaacgggttctcaagcagaaccacgtgctgccttgaacctcgcatcttatggaagtagtcatgctttcaaactagccaaggaagatgttgttttgtattcagctaaggttatccctggtaatgagtctcgtgtaatgaaaatgctaaaccgcatatcggagattggatcaacaattgttatgggaaaaaatgaaggtttgcacacatctggccatgcatatcgtggagaattggaagaaatacttagaatagtgaagccacaacattttcttcccatccatggagaacttttgttcctgaaggaacatgaattacttggaaaatcaactgggattcggcacactgctgttattaagaatggagagatgcttggtgtttcacatttgagaaatagaagagtcctttctaatggtttcatttcccttggaaaagagaatttacagttgaaatatagtgatggtgatagagcatttggtacatctagtgatctcttcattgatgaaagattgagaattgcattagatggcatcattgtcattagcatggaaatatttcgccctaaaattttagatggttcagctgaaaacaccttgaaagggaagataaggattaccacgagatgcttatggcttgacaaggggaagctgatggatgcactctacaaagctgcccgtgcagctctttcaagctgccctgtaaagagtccactggctcacatcgaaagaattgtgtctgaggtattgaggaagatggtgaggaagtacagtggtaaacggcctgaagttattgccattgccatagaaaaacctgcggccattcttgctgatgagataaacacaaaattgtctggcaaatcccatgtgggtcttggaatgtcaacattaagtaaagcagtggatggacatgggaagggaaatcagtccactgcactgcaggttaaagatgatagtattgataatgcaagtggagctgagggtgatttatctgaggaagacaacactgcaagtgggcctgagggttatttatctgaggaagacaacactgcaagtggagccgagggtgatttatctgagtcagaggattcagatgaattttggaaaccattcattacatcattaccagttgagaagtcaatcaatgctgacaatggttatgtttcaccaaaggagcaaaaatccaatttgaagaaagatgagtctgaagacattgatgaagccaagtcagaagaaacatctaattctgaagccaagtcttcaaaatcggttaagagaaataaatggaaaactgaggaagttaagaagctaattggtatgcgtgaggaactaagtgaaagatttcaagttgtgaagggaaggatggccctctgggaagagatttctcaaaaattgttggctgatgggatctgcagaagtcctggacagtgcaaatctctgtggacatctttggtagtcaaatatgaggggatcaagaatgaggataggaagaaaagttggccatacatagaggacatggaaaggataatgtctgataaagaagcccctgcaaaatgattggaaatatggtggacactggacaggataagaaatattttggagaaccatctacattaaaattgttgataagtttgagtgtggtgaccgggaagataatccatgacttgcatgacattgaagatccctagtgttttttagggctgagggatagacagcataaaggggttggctttcatactggcacgggaatgtctgagtttatgggacgatttattctccacctccaatgcctgtccccgtttttttattacatttgtgtcataatttataatatttgttggtggcacatattgggtgccctaagcaaccatggaaatgtctacctcttttccagacattgaacactgaaaagaaagttttcatacttttacttgcgagtgccaacttaaaaaaaaagtgtgtttgaatgtgcatttggagctccaaattttttagaatgagtcaaatatgatttttgtattgaccaatatgtttggatgtgggcttgaaacacgattctg

SEQ ID NO: 990 - DNA, 1380 bp, Glycine max
  Predicted polypeptide sequence is orthologous to G635
ggctcgaggtgcatggaaatatttcgccctcaaaatttagacagtccagttgagaacaccttaaaaggaaaaataagaattaccaccagatgcctgtggcttgacaaggggaagctgttggatgctctccataaagctgctcatgctgctcttgcaagctgccctgtaagctgtccactggctcatatggaaaaaattgtgtctgagatgttgagaaaaatggtgaggaagtacagtggcaaacggcctgaagttattgccattgccatagaaaatcctgcagctgttcttgctaatgagataaacacaaagttgtctggaaaattaaatgtggatgggatgtcggcattgagaaaagtggtggatggacatgagaaagagaatcagagaaccgaaatgcaaataagagatcgtattgatgtaggtggtctactacctacaaaagacaatgctatctcaagtggagctgaggatggcttgtctgatgcggaggatccaaatgattattttaaaccatttgttgaatcctctccagttgagaagtcaattaaaactaacaatggttatgttccacgaaaggagaagtcatccccattgaaggatgactgttctgaagacactgaagaatgcaattctgtaaatacatcagattctgaacccaaatcttcaaaatcagcaaagagaaataaatggaaacatgaagaagttaagaagctgattgatatgcgtggggaactgaatgacagatttcaagttgtgaagggaaggatggccctctgggaagaaatatctcagaatttgttggctaatgggatcagcagaagtcctgggcagtgtaaatctctgtggacttctttgttacagaaatatgagcaggaggtgaagaatgaaaagaagaacaagaaaaaatggccgtattttgaggacatggaaaggattctagctgataacaagacactagaaacaaaatgattataaaggtgatgcaccagacaagaaaaatttgcaagagttttctgcattatgattggtaatatgtctgagcatggtcgctgggaaggtaatccatcagttgcattattcttgcatcttgaactccttcattgaatatccatagttttgtgaggagatggacagcgttaaatgcattgacattttacattaacacaagttaatgagggagactatgctggttcaggggatgatttatccccttcctcaaaaggtaactacctacccagtgacagcattttagggtcattttgatgatattgattgacatattgaacaactattttaatgatagtgaagggttaatataatgtaacgagaccaaagtacattttttctgttacttataattaatttcattattttgtt

SEQ ID NO: 991 - DNA, 1794 bp, Oryza sativa
  Predicted polypeptide sequence is orthologous to G635
cgggctgcaggtgttctcgctttggctcgtgggtagctcaattgaaagccttcggattagcatttggtgtcttcttacaccaaaaataatagcacaacaaaacttagctattcaattacttaatctagtatagttgatcaaataatatcagctatccctagccctgtagcacactcatggtgaatacgtagcagcttagtcattccaagtgcctgcctcccttttcgtggaatgaattatggcatgtatattctctggagaagaacacgctgcagccatctcatcctgccacttgattgattatgccatcactctccaaaattacaaccactaaactacggccttgggatcattgggttgccatttccccttggcttgataaaaccctgtccatgtccaagaaatacggccacgtctttacgctttcctcatctttcttgctctcctcatatttctgaaccaatgatgtccatagagacttgcactgtgctggtgtacgacttatcccctggctcaacatgctagaagatatctcttcccacagaaccattctccctttcacagtctgaaattgctcattcatttcgccacgcatctgaattaagctcttaatttcctcaggcttccacttgttctttttagaagatttaactggagcagaagaaggatcgctagagtccttacccactatgctgatcttgccaatctttgatttactcccttgagctgaaccatggacaattcttgcaatttttacagctgtaggggatttgaatgagtcccttaaatgctctagtgttttaggctatatgcaaatctgaggagaaaaatgcttcgccattggagcttgtggttgcatcatcacgtgttgttctcaggacatcaggaagattttctttagcctctccctctgtattctctgggcatgatttatcactttcttcaagactcctacctgaactcctgctcgaatgcctaggagctgagaaagatccaaactttccagatgatttagtttctgagtcttctacaaaactcactgttgtgttctctgtagcaaccgcaatgacatcaggcctcttcccactatacttccttaccattttcctcaagatttcagataccatcctctccatgtgactaagtggacaattcactggacaacttgataatgcagcatatgcagctttgtaaagtgcatctaatagtcttccattatcaagccataggcatcttgttgttattttgaacttccctttcaatcctgactgtgatgaagcaagttccttctgaggtcggaagatttccatgctgacaaaaataacgccatcagatgcaatccttaatctctcatcaatgcagagatcagtggatgttccaaaagctttatcgccatcactatacattagccgcaaatcttccttccctaatgcaacaaacccattagacaaaactcttctgtttcttaaatgtgacacgccaagcatctctccatttttaattacagtggtgtgccttatgccagtagatcttccaagtaattcatgttctttaagaaacaggagttctccatgaacaggcaagaaatgctgtggtttgacaatctgtaggacttcctcaagttcatcgtgataggcatgcccagaggtatggagaccagcatcctttcccatcacaatttttggaccaagctcagtaaggcgatttaacatcttcattacacgtgactcatttccagggataaccttagcagaatacagaaggacatcctcttggatagttaagcatcctcag

SEQ ID NO: 992 - DNA, 633 bp, Oryza sativa
  Predicted polypeptide sequence is orthologous to G635
ggagtcttgaagaaagtgataaatcatgcccagagaatacagagggagaggctaaaggtactattcgcaaagtatcttaatcttacctttgaaaatgtggcggtctaaccctatattattatctgtattaagtgtcccatcatactgattttcttgttcactgttcagattcatgaaattctgtgcatttgattccatgccttttgtgctgtctaagatgtatcgacactgtcgttactttgttacacagaaaatcttcctgatgtcctgagaacaacacgtgatgatgcaaccacaagctccaatggcgaagcatttttctcctcagatttgcataagcctaaaacactagagcatttttgggactcattcaaatcccctacagctgtaaaaattgcaagaattgtcaatggttcagctcaagggagtaaatcaaagattggcaagatcagcatagtgggtaaggactctagcgatccttcttctgctccagttaaatcttcaaaaaagaacaagtggaagcctgaggaaattaagagcttaattcagatgcgtggcgaaatgaatgagcaatttcagactgtgaaagggagaatggttctgtgggaagagatatcttctagcatgttgagc

SEQ ID NO: 993 - DNA, 2332 bp, Zea mays
  Predicted polypeptide sequence is orthologous to G635
ttttccatactggtgactggaaaattgatgaatcaccagtggatggaaaaaaatttgaccgacaagcattggaggagctctccaaagaaggtgttactcttatgatgagtgactcaacaaatgttctttcccctggaagatcaatcagcgaatctgttgttgctggttcattgctgcgacatatttcggaagcaaaaggaagagtaattacgacacaatttgcttcaaacatacatcgaattgggagcatcaaagctgctgcagatttaactggtcgaaaaatggtgtttgttggaatgtcactcaggacataccttgaagctgctttcaaggatggaaaggcaccactggatccatcaaccttgatcaaggtagaggatatggatgcgtatgcccctaaagatcttttggttgtcactacaggttcacaaggagagccacgtgcagctctgaatcttgcatcttatgggggaagtcacgctcttaaactatcaaaagaggatgtccttctttattcagctaaggttattcctggaaatgagacacgggtaatgaagatgatgaatcgtctcactgatcttggcccaaaaattatcatgggtaaagattctggcctgcatacctctgggcatgcctaccgagaggagctggaggaagttcttcggattgttaaaccacaacatttcttgcctgttcatggagaactcctatttctcaaagaacatgaatcacttggaagatcaactggcatacggcacacaactgtaataaaaaatggagaaatgcttggtgtatcgcatctaagaaacagaagagttttgtccaatgggtttgtttcattagggaaggaggatcttcagctcatgtatagtgatggtgataaggcttttggtacatccactgatctctgcgttgatgagagactaagaattgcatctgatggcattatttttgtaagtatggagatcttccgacctcagaaggaacatgggttagcgcagtcaggtttgaaaggaaaatttaagattaccacaagatgtctatggcttgataatggaagattattggacgcgctctacaaagcagctcatgctgcattgtcaagctgtcctgtgaattgtccacttagtcacatggagaggatggtagctgaaatcttgaggaaaatggtacggaagtatagtggaaagaggcctgacgtcattgctgttgctacagagaacaccacagcaggtttctcagaacacctcgacactaaagcatctggaaattttggaccgtcctcagctactagccacctgagcaggagtccagctacgagtcttgaaggcagttataaaacacacccagacaacccagaggtggatgctgaagaaatccttcccgagactgtgagaacaacacccgacgatgcaaccacaagctccaatggcgaagcattattctcttcagatttacatcagcctaaaacattggagcacttttgggagtcattcaaatcccctacagctgtcaaaattgcacggatcgtcaatggggggaacaaacaaaatttcggcaagattggcataatgggtcaggactcattaatccagtcagctcctgctccagttaaatcctcaaaacggaacaagtggaaacctgaggaaattaagagcttaatacagatgcgtggcgaaatgaatgagaaatttcagagtgtgaaaggaagaatggtactgtggaaggagatttctgataccatgttgaaccaaggagtaagtcgtactccggcacagtgcaaatctctatggacatcgctagttcagaaatatgaggaaagcaaggatacggaaagcatgaagacttggccgtatttctcggccatggataagattctatcgcagcaaggggagatggcaaccaaaggatagaaaaaggcttgtagcttagtggtagaaatttagaatattgattggtatgttgcagcagagcccagtcagtctagtaatataaagatgaaatatctgtctacaggtacagcacctggcgatttattgggatcggattcttttgttttgtgtaagacatgcagtagcacaagatcgagatgcatcgactggcttggaattaagcttcagggcccgtggactcagagcggggtagccaggagcgctctattcttagcaacaggcagacatgtgtggttttatctgccagataacgtttgtaactcctataatgtaatagcctacacggtaggcgaacggcgaacccctaaaagacaactgatgtatcatatgttttgaggagttatgtaatcgcctgcacggcatatacgtgactttttttc

SEQ ID NO: 994 - protein, 422 aa, Oryza sativa
  Orthologous to G635
EEVLQIVKPQHFLPVHGELLFLKEHELLGRSTGIRHTTVIKNGEMLGVSHLRNRRVLSNGFVALGKEDLRLMYSDGDKAFGTSTDLCIDERLRIASDGVIFVSMEIFRPQKELASSQSGLKGKFKITTRCLWLDNGRLLDALYKAAYAALSSCPVNCPLSHMERMVSEILRKMVRKYSGKRPDVIAVATENTTVSFVEDSETKSSGKFGSFSAPRHSSRSSGRSLEESDKSCPENTEGEAKENLPDVLRTTRDDATTSSNGEAFFSSDLHKPKTLEHFWDSFKSPTAVKIARIVNGSAQGSKSKIGKISIVGKDSSDPSSAPVKSSKKNKWKPEEIKSLIQMRGEMNEQFQTVKGRMVLWEEISSSMLSQGISRTPAQCKSLWTSLVQKYEESKKDEESVKTWPYFLDMDRVLSSQGEMATQ

SEQ ID NO: 995 - DNA, 2438 bp, Glycine max
  Predicted polypeptide sequence is orthologous to G636
ttgaattcccgggtcgacccagcgtccgcccacgcgtccgggtggatcaaataattcgggggacgatgagaggggtagaatcgaagaaggtgaacgtagcttcggcggtaaccggtggccgcgacaagagactttggccttgttaaggatacgctccgatatggacgtggcgtttcgagatgcaagtgtcaagggtcccttgtgggaagaagtatccaggaagatggcagagcttgggtatcacagaagctccaagaagtgcaaagagaaattcgagaacgtgtacaagtaccacaagagaaccaaagaaggccgaagtgggaaacaagatggcaaaacctatcgtttctttgatcaactacaagcccttgagaaccactctccaacaccccattctcccaacccttcaccaaaacccccacaatcagcaccatcaagagtagtagcatcatcggtgtcactaccaattgcaacaacaacaacagtgtcactaccaattccaacaccaacaacagtgccaatgcagcctatattgtccaacaacgctatactcactagtagtgtccccaatatcactgttccatcaacaacaccactccctataaccattcctcaacccattctcacctccccatcaataaacctcacaatcccttcttaccctccaacaaaccctaccaatttcccaccaccaccaaaccctaccctaccatcctctttccccaccgacaccttctccaattccagctcctcctccacctcctccgaggaaacattggaagggagacgcaagaggaagcgcaagtggaaagatttcttcgagagactaatgaaagaagtgatcgagaagcaagaggagctacaaaagaagttcctggaagccatagagaaacgcgaggacgacagaatagcaagagaagaagcatggagagtacaagagatgaaaagaatcaatagggaaagagaaatcttagcacaagaaagatccatagccgcagccaaagacgcagccgttatgtcattccttcaaaaaatagccgaacaacaaaacctcggtcaagtatcgaccaacatcaacctcgtacaacaaccacaacctcaattacaaccgcagccaccactacaacaacaagtgacacaacctagtattgcagcagcacaacctcccgtacaacagccaccgcccgtggttgttacacagcccgtggtgctgccagtggtgtcacaagtgacgaatatggagatagtgaaagccgataataatagtaacaacaataataacggcgagaatttcttggcaccaagttcttctcggtggccaaaagtggaggttcaggcattgataaagcttcggacgagcatggatgagaagtatcaagagaatggaccaaagggtcctctctgggaggagatctcagcctcaatgaagaagctcgggtacaaccgaaacgcgaaaaggtgcaaagagaaatgggagaacatcaacaagtacttcaagaaagtgaaggaaagcaacaagcggagaccggaagattccaagacgtgcccttatttccaccagctggacgcgctgtacaggcagaagcacaggggcgaagagagccccgcggcggtggaggcgaagccggagagcgcggtggcgccgttgatggtgcagccggagcagcaatggccacctcagcagcagcagcaggatagggacatcacaatggaagacatggagaacgaagatgatgaatatgaagaagagagggaaggagaggaagaattagaggatgatgaagatgaagaggatgaagaaggtggtggtggtggtgggaactatgagatagtggcaaacaaaacaagtggtggtggtggtgcttctgctgcttcagtgggggcttcaacggagtagtagtgtgaagaaaccaggtttagcgtgggggtgggtcagagagagtgcaggggttgtcggaggtggccattgtggtggagaaattaagaatttgaatattcacgtacggtgaagttacacatggcaatggttatggtatcgacctgtggtggaaagatgaggtttgctttggttggttggtactttgttgtagcatatagtcagtaagattatatgtttcttttttctgttttataaaaaaagttgtttattttttgggagaataaataaaagtccgatcagagagggaatttaagatagagaccaataaagaagaagaggggccttaattaaggttgtatttttttttttttttatcttcatcttgttttttatgttcgttcctggtgctgtaaatgggaggagagattaattcgggttttgtccttttcttatctctttaagttttgacatcttgttactcttcaaatgactgacattgacttctctttcaaaaaaaaaaaaaaaaaaaaaaaaaaaaaaaaaaaaaaaaagggcggcc

SEQ ID NO: 996 - DNA, 1338 bp, Glycine max
  Predicted polypeptide sequence is orthologous to G636
cggcttgagcgaacaacaaaacctcggtcaagcgttgaccaacatcaacctcgtacaaccacaaccacaactacaaccacaaccaccggtacaacaacaagtgacaccacctaatatagtaccagctcctatgcaacaaccactgcctgtgattgttacacagcctgtggtgttgccagtggtatcacaagtgaccaatatggagataatgaaagccgataataataacaacaataacaataataacaactgcgaaaatttcttgccaccgagttcttctcggtggccgaaagtggaggttcaggcattgataaagcttcgaacgagcatggatgagaagtatcaagagaatggaccaaagggtcccctctgggaggagatctcagcctcaatgaagaagctggggtacaaccgaaacgcgaaaaggtgcaaggagaaatgggagaacatcaacaagtacttcaagaaagtgaaggaaagcaacaagcggagaccggaagattccaagacgtgcccttatttccaccagctggacgcgctgtacaggcaagaagcacaggggcgaagagagccccgcggcggtggaggcgaagccggagagcgcggtggcgccgttgatggtgcagccggagcagcaatggccacctcagcagcagcagcaggatagggacatcacaatggaagacatggagaacgaagatgatgaatatgaagaagagagggaaggagaggaagaattagaggatgatgaagatgaagaggatgaagaaggtggtggtggtggtgggaactatgagatagtggcaaacaaaacaagtggtggtggtggtgcttctgctgcttcagtgggggcttcaacggagtagtagtgtgaagaaaccaggtttagcgtgggggtgggtcagagagagtgcaggggttgtcggaggtggccattgtggtggagaaattaagaatttgaatattcacgtacggtgaagttacacatggcaatggttatggtatcgacctgtggtggaaggaggatgatgaggtttggttggtactttgttgtagcatataatcagtaagattagatttttttttttcttttctgttttataacagtttgtttattttttgggagaataaataaagtccgatgagagagggaatttaagatacagaccaataaagaagagagggaccttaattaaggttgtattttttcttttcttttatcttcatcttatttttttttaatgttcgttcttggtgctgtaaatgggaggagagattaattcgggtttaaaaaaaaaaaaaaaaaaaaaaaaaaaaaaaaaaaaaaaaaaaaaaaag

SEQ ID NO: 997 - DNA, 869 bp, Glycine max
  Predicted polypeptide sequence is orthologous to G636
  misc_feature (784)..(784): n is a, c, g, or t
  misc_feature (833)..(833): n is a, c, g, or t
cggctcgagcggctcgagcggctcgagcggctcgagaaaaaatttgaaagaattcaccaccctttttgctctgtttatatttttaatttttctcctgctctcagctgctgtaagtaattgttgcggtgctgttttggcaaagagggagagagagagagacccaaaagagactatgctcggggactcagctctgttgggaggaggaggaggagaaggtggtgcctccgccgatgtagtggcggcgaccgccacgcatgatgcgacaacgacgacgacgaccggaggaggcggtggcggatcaaataattcgggggacgatgagaggggtagaatcgaagaaggtgaacgtagcttcggcggtaaccggtggccgcgacaagagactttggctttgttaaggatacgctccgacatggacgtggcgtttcgagatgcaagtgttaaaggtcccttgtgggaagaagtatccaggaaaatggcagagcttgggtatcacagaagctccaagaagtgcaaagaaaaattcgagaacgtgtacaagtaccacaagagaaccaaagaaggtcgaagtgggaaacaagatggaaaaacatatcgtttctttgatcaactacaagcccttgagaaccactctccaacaccccattcccccaacccttcatcaaaaccactacaatcagcaccatcaagagtagtagcaacaacaactgcatcatcaatgtcactaccaattccaacaccaacaacaacagtgccaatgcagccaatattgtccaacactatnacccacaagtagtgtccccaatatcactgttccatcaacaacaatactncctataaccatacctcaacccattctcaccacccca

SEQ ID NO: 998 - DNA, 1546 bp, Glycine max
  Predicted polypeptide sequence is orthologous to G636
ggctcgagaaacttgtcagtaacaataatggtttggtagaagtagtagtcgcccttgaaacaggacaaacgatacgaactttccccaactcaaaacaacacacagactccagttactgaaattgccctgtttcatttttctcccctaaatttcaccgacgctgtcttttttctcttttgccctcacccttttgagagcatcatagctgtaacttgggcgttaccgatgctggaaatctcaacttcacaggaaaccccgctagagaacgcggacggcggctccgcggcggtctcggacgggtcgaaagccgagcacggcgaggacgatgaccggaatcccgccgcgaaccggtggccgacagaggagacaatggctttgctcaagacaaggtccgtaatggacgttgcttttcaaagaacgcacaccctcaaagccccctctctgggaaacaagcctcaaggaaattatcggagctaggatataatagaagtgctaagaagtgcaaggagaaattcgagaacgtttacaagtaccataggagaaccaaagaaggtcgttttggaaaatcaaacggtgcaaaaacttatcgatttttcgagcagttggaagccttagacggaaaccactcacttcctcctccgacaacaaccgacgacaccgacaacaacaacaacgttggtgatgatgttgttatcctgaacgcggttccgtgttcggttagtgcggcggcgcacgagcactcgagttcgacgacgtcgtcttcggggaagatgaagaggaagctgacgcggtttctggaggggctgatgagggaagtgatagagaagcaagagacgctgcagaggaagttcgtggaagtgttggataagtgtgaaaaagatcgaatggcgagggaggaagcgtggaagaaggaggaactcgaaaggatcaagaaagaacgcgagcttctggctcaggaaagatcaattgctgctgccaaagacgaagctgttcttgcttttcttagaaagtttgcagaagcagaagacacggtgcagttactcgagaaaattcaggttcaaaacgacaaacagaaaaacatgaaacaaaatggcggtaatgataatgctaatggaggtggtggtgtcgcagttgtcactgatatggataaacaagaatgtggaaataatggtgttagtgttgggaattttgtgcacatgagtagttcgcggtggccgaaggatgaagtggaggctttgataaggttaaggactgagtttgatgtgcaggcacaagggaataataataatagtaataatgggtctaaagggcctctttgggaggagatatctttggctatgaagagcaccggttatcgcccgaagtgcaaaccggtgtaaagagaaatgggagaacataaacaagtacttcaagaggatcccggcggtcgtcttctcgaaacctcaggattccaagacgtgtccttattatcaccaccttgaggctttgtacagtaagaagcctaagaaggtggtggatcatgggaacgagttgaagcctgaggagc

SEQ ID NO: 999 - DNA, 2165 bp, Glycine max
  Predicted polypeptide sequence is orthologous to G636
  misc_feature (2147)..(2148): n is a, c, g, or t
  misc_feature (2161)..(2163): n is a, c, g, or t
ggctcgaggctgtaattgcatagggacacaacatctctatagctatatgcagctaggagactcaagtgtgttggagatctcctcccatacccagcctgagatggcggtgacggcagcagtgttgccaccagaagaagtagcccatgatggcagcgacaacagtggtggtggtggtggtggtgagatgattgggatggacttggatgcaaattcaggtgaaggaaatgaaggtaataataagatgagctttggagggaaccggtggccccgccaagaaactttggctctcttgaagataaggtcggatatggatacagtttttcgagattcaagtcttaaaggtccactttgggaagaagtttcaaggaaattggcagagcttggatatcaaaggagtgcaaagaagtgcaaggaaaaatttgagaacgtgtacaagtacaacaagagaaccaaagagaacaaaagtggcaaatcacatggaaaagcctataaattctttgatcaattacaagccctcgagaaccaattcacagtctcttacccgccaaaaccacaacctacttctactttgactacaacaaacacattgacaagtgatcatggtaacaaagttatctcttatgtcacaccttttccttccacaaaccctactctcattccaccttctccacaaaccaacaccaccaccaccaccaccacaacaacaacatccactaccgaccctagagactcatcaccaccacaaaccaacaacaacaataatagtgtcacacactctttgccaaacatgaacacctctttctctaccaccactgcctccacctcatcctccacagcatcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggagcatgagattcttgttcaagagagatcaacagcagcagccaaagatgctacagtcattgcattattgcaaaagatgtatggccaacaaaaccccacacaacaagttgaagtagagccaccaccacaacagaagcaaacaattccccaatcgctgcctccaatattaatgccaaacaataatttcgaggtcaagaaaataaataatggtcacagtgttactagtactactactggtactgttgctactgctactactactactacttcgccggtgaattcttcttcttctcggtggccgaaggcggaagttcatgctttgataaggataaggacaagtctagaaaccaagtatcaagagaatggaccaaaagctccattgtgggaagatatctcaattgcaatgcaaaggctagggtacaaccggagtgcaaagagatgcaaggaaaaatgggagaacatcaacaagtacttcaagagagtgagggagagtagcaaagaaaggcgtgaagatagcaagacatgtccctatttccacgagcttgaagctctatacaaagaaaagagcaaatcgtccaagaacccctttggcatcttccagaatatgaagcctaatgagatgatgctgatgatgacggagccactgatggtgcaaccggagcaacaatggaggcccccacctcaatcattggaagagggtgtagggatggagaatgcaagtgaagaatatcatgaaaatgaagaaaatggtggtgacgatgatgataatattgaagaagatggagatagtgtggaagatgcaggaccaaacccgtgtgagattgcgacaaataattaaacgtgcttcagtggacaccgttgaagtagacaagataaggaattttctgaatggagaaaaatttacgtgtgtgcttaatttacttttacttatttcggaaaaaaatagtcctttattttttttatcattttattaaacttcaaaatgtgattatttcttaaggaaaacaattgttgggtatagtatagtcaatcaggttttatttttcttatggggtcgtaagttgtaacacctgcaaaaaaaaaaaattgtcataaattgttgacattaaagacanngcacaaacacctnnnct

SEQ ID NO: 1000 - DNA, 1676 bp, Glycine max
  Predicted polypeptide sequence is orthologous to G636
gacaatagggagagacgacaagtggctcaacaagaggcttggaggatccaagaaatggcaaggatcaatagagaacacgaacttcttgtccaagaaagatcaactgccgcagccaaaaatgctgcagttattgcttttttgcaacagttatctggtcagcaccaaaattccacaacacaagccaatttccctcaacaaccacctccacaaaaagttacaatagtacaaccaccaccacaacaagctccacaaccacaagctccattggtgttgtcaaatagtgacaacatggagattcagaaaatgaataatggtcacagtgttgttactgctactgttactgctactgctactcctactcctactactactttcgttgctgctgctactgctattactactactccttcttcattgagttctttatcttcttctaggtggccaaagacagaagttcatgctttgataagactgaggacaagtcttgaaaccaagtaccaagaaaatggaccaaaggctccattgtgggaggatatatcagcaggaatgctgaggctcgggtacaacaggagtgccaagagatgcaaagagaaatgggagaacatcaacaagtacttcaagaaggtcaaggagagcaacaagcaaaggcgcgaggatagtaagacatgtccctattttaatgaacttgaagctttatacaaagaaaagagcaagactcagaacccctttggcgcttcgttccacaacatgaagccacatgagatgatggagccattgatggtgcaacccgagcagcaatggagacctccctctcagtacgaacaaggtgcagcgaaggagaacaataataatgaaagaaaagaaagagccggggaggaagaagatgaagaagaagaagaagaagaagaagaggatgaaaatgaagagggagatctagagagtgtggaagatgaaggaggtaaccgttatgagattgcgacaaataaactttcttcagtggacaccgttgaatgagacaagataaggaagtttctgattggatggagagttttaattttaattttaattttaattttaattttaatatatatttttttcttcttctgggggatggatttttaattattatgtaagttgattttaatttttccaaaattggggttaggagatgtcactgaaagggcatgatgatggcacaaacaccggcactataaaattcaattctttaataatgaatgacccatctaaaagcatggtggtgcagaagcagaagcagaagcagaagcacaaggtacctatctgacacactttctgatcatgggccagcttaaaagcagatcattggagctgtgggtcacattccggccgccatgaactgggatcagagatcgttaattaacactaagaaacaacagttcacatgggccagcaaagcagaagcatagctatagtgggtgtacatgtttttgcgctcataaatttatgtgtaaagtgtaaattgaagatgagagagagagagagagaaaaaaagaatacgaggtcccatagcagtttaatgaaatgaaataaaataaaaaagtcacatgcatgatgcaactcttgtaattttcctttactttcattatatatcacggaacccactgtgtggtactgctttcaaaaaaaaaaaaaaaaag

SEQ ID NO: 1001 - DNA, 1830 bp, Glycine max
  Predicted polypeptide sequence is orthologous to G636
attcggctcgaggaagtttcaaggaaattggcagagcttggatatcaaaggagtgcaaagaagtgcaaggaaaaatttgagaacgtgtacaagtacaacaagagaaccaaagagaacaaaagtggcaaatcacatggaaaagcctataaattctttgatcaattacaagccctcgagaaccaattcacagtctcttacccgccaaaaccacaacctacttctactttgactacaacaaacacattgacaagtgatcatggtaacaaagttatctcttatgtcacaccttttccttccacaaaccctactctcattccaccttctccacaaaccaacaccaacaccactaccaccacaacaacaacatccactaccgaccctagagactcatcaccaccacaaaccaacaacaacaacaatagtgtcccacattctttgccaaacatgaacgctcctttcttaaccaccaccacctccacctcttcctccacagcatcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggaacatgagattcttgttcaagagagatcaacagcatcagccaaagatgctgcagtcattgcattattgcaaaagatgtacggccagcaaaaccccacacaacatgttgaagtagagccaccacagcaacagaagcaaacaatgccacaatcacagcctccaatattaatgccaaacaataattttgaggtcaagaaaatgaataatggtcacagtgctacaagtactactactactactacttctccggtgagttcttcttcttcttctcggtggccaaaggccgaagttcatgatttgataaggttggcgccaggtcttgaaatcaagtatcaagagaatggaccaaaggcttccattgttgggaagatatgtcaattgcaatgcaaaggcttgggtccaaccggagtgcaaagagatgcaaggaaaaatgggagaacatcaacaagttcttcaagaaagttagggagagtagcaaagaaaggcgtgaagatagcaagacatgtccctatttccacgagcttgaagctctatacaaagaaaagggaaaatctcagaacccctttggcatgtttcagaatatgacgccaaatgagacgatgatgatggagccatttgatggtgcatccggagcaacaatggaggcctccacctcaatcattggaagagggtatagggaaggataatgccagtgaagaatataatcaagaaaaagaagaagaagtagaagaaaatggtggtgatgatgatgataatattgaagaagatggagatagtgtggaagatgcaggaccaaacccgtgtgagattgcgacaaataattaaacgtgcttcagtggacaccgttgaagtagacaagataaggaattttctgaatggagaaaaatttacgtgtgtgcttaatttacttttacttatttcggaaaaaaatagtcctttattttttttatcattttattaaacttcaaaatgtgattatttcttaaggaaaacaattgttgggtatagtatagtcattcaatttttatttttcggatggggttgtaacatgctactgaaaaaaattgtcatagattgatgacattaaagacgaaaaaatttaaaatttcgaactattaaaaagcggcgctctagaggatc

SEQ ID NO: 1002 - DNA, 2149 bp, Glycine max
  Predicted polypeptide sequence is orthologous to G636
attcggctcgagcaaaatttcgatatgtgatgtggttttctgacagtcattttgatacatacatggtgtgttttccaaataagttaccaaatcaaattggttcttcaaaagcaacattttcttcctcccttatttcggttacccactcttggttgggaatgaatgaaggaagctggcagagcttggctacaacagaaatgccaagaaatgcaaagagaagtttgagaacgtttacaagtaccacaagagaaccaaagaaggacgaagtgggaaatcagaaggcaaaacttatcgcttctttgatcaattacaagcccttgaaaacaaccctgcaattcatggaaagcaatctccaacacctccaaagccgccaccacaaacaacagcactatcagcaacaccagtgtcaatagtggtaacaacaactacaactacaccatcatcaataataatgccacttccattgccaccagtgtctaataacaacaacaacaccactgttccatccacaacatcacttcctatgcctcaaagcattctcaacataacaccaccatcaacactgaacatcacaatcccttcttttccaccatcaaaccctacaacatacttcccaacacaaacaccaaaccctactagcaacaacaacaacaaccctccaagcaccatcaccccaccttccttccccaatttccccgccgatctcttgtcgaattcgagttcttcatcgacttcttcggaggaaacaccgacgacggaggccagagggcgcaagaggaagaggaagtggaaggacttctttgagaggctcatgaaggaggtgatagagaagcaggaggagctgcaaaggaggttcttggaggccatagagaagagagaacaagagcgtgtggtgagagaggaagcgtggagaatgcaagagatgcaaaggatcaacagggaaagggagattctagcacaagagaggtccattgccgcagcaaaagatgctgctgttatgacatttttgcaaaagatagccgaacatcagcaacaagaaactatcaatcttgaaccagcattgaataacaacagcatcactgttgttccacagcaaccagtgccacaagcaacaccaacatcaactccaacaccacaacaagcacaaacaacaacagttcctgaggccccacaagtgcagccattggtcccacaactacaacaacaacaacaaatagtggtgagtaatgtggaaatcaacaaagctgataataacggtgagaatttgatgatggaagcaagctcttcaaggtggccaaaaatggaggtacaggcactgataaacctaagaacaagcctggaaacaaagtaccagagaaagtggaccaaaagggccactgtgggaggagatctcagcgttgatgaggaaaatggggtacaaccggaacgccaaaaggtgcaaagagaagtgggagaacatcaacaagtacttcaagaaggtcaaggaaagcaacaagaagaggcctgaagattcaaagacatgtccctattttcaccagttggaggctctatacagggagaagaacaagggagaggggcagatgaagccggagagcatgatggcgccgctcatggtgcagccggagcaacaatggcctcctcaaacaacgcttgtggtaccgccagaagtaaccatgggagacacccagaatgaccccatggaccggcagtaccatgaggagaatgaggatgacgaggacgacaaggaaattggagatgaagacgaggatgaggacgacgaaggaggtgataattatgagatagttgcgagcaaaccagccacagctgatgcttccggagagtgagaggaaaaaatattgaccaaaaagggcatcaattaaagaatgatggatcaatttgaattcacatattgtcggaaaaatggtggtgttgggatgaaatttggtattgatggtggatggtgatgtgattgtattgaagattttgaaaatgcacgtacttcagaatgacacatgggtataggggtagccagtagggtgggggaatctgggttggaagtacttggtacaatagcagcatatagtcagtaagattatatgttttttttgttttgaaagaagaaataattaattattttttgagctcaaaa

SEQ ID NO: 1003 - DNA, 277 bp, Oryza sativa
  Predicted polypeptide sequence is orthologous to G636
acgcccacgcgttcgcgctgatgctgatgcggacattgctgaaggataagtagcaggatccaccgctgaggggcccgctgtaggaggaggaaatcgcgcgcatggaagtcgccgtctaccagctgcacgcgtaaaggtgcaaggagaagagggagaacatccacacgtacttccgcaagggcaaggaaagcggcaagaatcggacggagcacgccaagacgtgccgctactgtgacgagctcaaccgcctctacttccgatacgtctactgcagctg

SEQ ID NO: 1004 - DNA, 985 bp, Oryza sativa
  Predicted polypeptide sequence is orthologous to G636
cgccgcaggccaccaagtcgccattgccggcgacgccgcagacgcaaagcagcatggacattgtcatgacggccgccgaggcgcacgacgcgggggtccgccgggccggcggcggcggggggcagccgtcgtcgtcgcggtggcccaaggcggaggtgcacgcgctgatccagctgcggagcaacctggacaaccggtaccaggaggccgggccgaagggccccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccgggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctcc

SEQ ID NO: 1005 - DNA, 1260 bp, Oryza sativa
  Predicted polypeptide sequence is orthologous to G636
  misc_feature (824)..(824): n is a, c, g, or t
cccgggctgcaggacggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagccagaagacattgtgagggacccgcgcgtcccgccgccccgggagttcacaacggacgagaccgccagtgacgacatgggcgatgactacaccgacgacggcgtaggaaggcgaggtacgacgccaaaaatccagtacaggatacagttccagaggccgaacccgggcggcgccaacaccgcacactccgccggcagacaaccccggcggtccgcggtgccaacctcgactccgacgagcaccttcctcgccatggttcaataggcgcgcgaacgatgcatcaccaagtacgtacttgttcaaagaaaaaaaatcaaagcatcgccatcaccatcgcatcctctcactacaccaccaccatacacctaacaccatgcatgcatcagccatcagcaaccactctccttcgagttgggatctctcctgcaatgcatgtgcggtaagtgccanatgacatgtgggcccggaataggtgggacccacatgccagtgacaccagtacagcagtggatttgcatccctctccttcaccttgtaattctcccgtgccattccattatttattgatttctctgtgtaataagagccctccctgatctcaccttaacccgaggaagcagagggggtggtagagaaaatgagtccgggtaactttatctctataggtcacctcgtcgtggtaaaggaagaattgtacatcgatgtaacagtccctgatgtctctgttttttttttctctctctctttttctccttcccctccggcgacggcggtatacaagtttgtatacgggtatacaacaattacatacatttccagcaatttggagcagaaaaaaaaaaaaaaaaaaaaaaaaaaaaaactcgagactagttctccctcgtgc

SEQ ID NO: 1006 - DNA, 747 bp, Oryza sativa
  Predicted polypeptide sequence is orthologous to G636
atcgccgccgtgccaccgccgccgctgcagcccacgccggtggcttccgctgcaccaccaccaccgattcaggttcagccgcaccacataatgccgatgacgccgcagccccagctgcaaccaccgcagccgcagagcaaggaggccaacaccgtcgtccgggcggcgccgccgccgcaagagcagcacgacacggcggcgtccggcggcggcggcggcgcgtcgtcgtcgaggtggccgaaggcggaggtgcacgcgctgatccagctgcgcacagagctggagacgaggtaccaggactcggggcccaaggggcctctctgggaggacatctcggcggggatgcggcggctggggtacagccggagctccaagagatgcaaggagaagtgggagaacatcaacaagtacttcaagaaggtgaaggagagcaacaagaagcgccccgaggactccaagacatgcccctactaccaccagctcgacgcgctctaccgcaccaaggcggccaacgccgccgccgccgcctcagcctcgccggctccggcgaccaccaccgtgcttgccccggtgccgatctcccagacgccgccgcacgtcgaccacggcggcagcaacggcaatgggaatgggtgggcgagtgccaacaacggcggcggcggcagcagctccggaggcatgcaaacgaaagctagcaacaatggcacggcgaccgccggcgggctgcccgtcgtttcggtcgccggc

SEQ ID NO: 1007 - DNA, 741 bp, Zea mays
  Predicted polypeptide sequence is orthologous to G636
cctctgggagcaggtctccaggaagctggctgagaaggggtacaaccgcagcgccaagaagtgtaaggagaagttcgagaacgtgcacaagtactacaagcgcaccaaggagagccgagccggccggaacgacggcaagacgtatcgattcttcacgcagctggaggccctgcacggcaccggggcggctcccgcgtcggtggcggcgtcgcaggtgccccctgcgatctctggcggggtgtccggggcagcggggccgttagccgtgcgcttgcctgccgagccaccgcctgcggtgtcgggcggcgtggggatgccgatgacgaccgtgggctacccgagcttctcgacgtccaacacggaggactacacggacgaggacgactccgacgacgagggcacagaggagctggtgggtggcggcgggaacgagcgcgggaagaggaagagggtgtcagagggcggcgcctcggtcgccggcggaggcagcgggaagatgatgaggttcttcgagggcctgatgaagcaggtgatggagcggcaggaggcgatgcaacagaggttcttggaggccatcgagaagcgtgagcaggaccgcatgatccgcgaggaggcgtggcggcggcaggagatgacccgcctcgcgcgcgtagcaggagatcctggcgcaggagcccgccatggccgcctcacgcgacgcttgcgtcctctcctttatacagaagatcaccggacagacca

SEQ ID NO: 1008 - DNA, 1853 bp, Zea mays
  Predicted polypeptide sequence is orthologous to G636
  misc_feature (28)..(28): n is a, c, g, or t
gcgttctggtcgcccgcctcaaccgcgnagcggggcggcgcgctcaggagcgcgccgccgcgggctgcaggacgccgccatcatcgccttcctccagcgcatcagcgggcagtccgtgcagccccctaccgccgttgttgtcccaatgccggcaccggtgtcagtccataccacgccgccggagcagccggggcgccagcagcagcaaccgccgccgccgtcgccccaggcgacaccgcagtcgaagccaatctcagccgcgccgctccagcagcaaccgccacagcagcaaccgaaggatacgtcgcagcaggacgccggcacgccgcgcagcttgcccccggcgtctggccagtcactcgagctggtgcccttcgccgccacggagcatcacgtcgattccgggctaggaggaggggatggaggtgcggcgtcgtcatcgcggtggcccaagacggaggtgcacgcgctcatccagctgcgcatggacctggacatgcgctaccaggagacaggtcccaagggtcctctctgggaggatatttcgtccgggatgcggcggctgggatacaaccggagctccaagcggtgcaaggagaagtgggagaacatcaacaagtactacaagaaggtgaaggagagcaacaagaagcggcccgaggactccaagacctgcccatacttccaccagctcgaggccatctacaacagaaagcacctcagcagcctcacaaccgcggccacatcgtccaccgccgccgccgccgccgctcctcgtcccgcctacccagatcagctgaacccgagcaggcaagagatagaggggaagaacatcaacgatgacaagaggaacaacggtggatcaggtggaggcacgcaggtgccgaccagcaatggcgagacagcgacgacgacgacgacgacgcccgtcgcgttcgacgccgacaccggcatgaagaagccagaagacatcgtcagggagttgaacgagcacccgcgtcgggagttcacgacggaggacgagacggacagcgacgacatgggcgacgagtacaccgacgacggcgaggaaggcgaagacgacggcaaaatgcagtacaggatacagttccagaggccgaacccgggcggcaccaacaccgcgccagcaccggcagcagcgacgacggctgcgccagcggtgccgacttcggctccgaccagcaccttcctcgccatggttcaataggggcgcgggcggcacccctctcaaaccgtacgtacgtatatgcgtccaaaccaaaaacctgcgcgcatcaccgtcacctcctcctttactttaccagtccaccaagcatgcaccatcagtccatcacactgttctcttgttcatcctgtaatcccccgtgccattccattatttattgatttgtttcgtgtataataagatccccaccgttgcggaggatgcagagtgaggctgcggtggtagagcaaaaaggaagagtccagtccctcagtaataacttatttataggtcatcgtcgatcgcgttaaacgagaactgtacatcgatgtaacagtcagtccatgatgtttttcctcccttttttttttagttactcccttcccgggacggcagtatacaagtttgtataagggtatacaagaattacagacagttcaagcaacctggagcttgcggaggtgagaaggtgtttttgccgttgggaatctacatattttttttttgtcgatgcctttcttttaacagtggatataattaaatcctgttacttgttacagtgtacattaatcgtgttgttattccagtactctgccctttgtggcaaatatacatgagcagttttacc

SEQ ID NO: 1009 - DNA, 1324 bp, Zea mays
  Predicted polypeptide sequence is orthologous to G636
gccgccacagcagaagccgccaatgccgcaacagcaaagcatggacattgtcatggtgccggccgagacgacgccgcacgccgacatcccggtgcacgaggggtccagtggcggcgcggcgtcctcccggtggcccaaggcggaggttcacgcgctgatacagctgcggagcaaccttgacacccggtaccaggaggttgggcccaaggggcccctctgggaggagatctccgccggcatgaggcggatgggttacaaccggaacgcgaagcggtgcaaggaaaagtgggagaacatcaacaagtacttcaagaaggtgaaggagagcaacaacagccggatcgtctttcctgggcacggtccagtgatcgatccgtctgcgcgcacccaggcattatcccccggtgactctcatcctcctccacttctccatggcttcttttctttctctcgctcgcatgtgacatttgtgtctacccacctgtcgcctccatgcatgctcgtccatatctctagttctctacacctctaaaccaaaaatcacaagaactatctccctcagctcctccatgctccggcaattctccattcctcatatatgcacctagcaacacctcgatccatgtcgtgtcgtcgtcgctgctgcatgcctacccccctttttttgattcgttgctgtgttaattatagtggtcgcctctttagatgttacagtaaaaaaatattggcggtgatgcggttatttattgatttgttctggtaattaataagaaccctcaagctttggggtgttcacggagaggttgagttgatgcggtgaaaacagcacgtgaaagggtaatgagagatcgatcgcgcggttaaggagacaaggtgacaagaaaggcagatgacgcagtgggtgtttgcactgttactgcggtaaattttgtgcatgcggctactactctacagtgggctagtttgttgcaagggagctgcggaaaaaaatggaaaagaagagcttgctcgtcatgtgccatgaagaacagtcagtttgatgcatgcgggatttttatatttatccttgttttcccctctttttcatttttcaccatttcttttatgttctgcaacaagtaaactgtccattaagtattacctaagttttttctttctttctttctttctcaaactgctgttaccgaaatttacagtgtatacttgagaaatgttatatgttaaaattcttgctgttaattatatatagtattgcaattgcgcgcccgtgggattttttcaaaaaaaaaaaaaagggcggccgccaccgcggtggagtctccag

SEQ ID NO: 1010 - DNA, 716 bp, Zea mays
  Predicted polypeptide sequence is orthologous to G636
tctggccggcagccgcaccgccccgcagttgcacgccctcgccgcgccagtatccccgacgccccagcagcagttgccggcatccagcgccgccccgccgttgcacgccttccccgcgccagtatccgcgccgccgccgttgagttcaataccactgctgacagggccgatgcagccagcgcccatatcatcggcggccccagccccggcaccggtggatctgctcggggcccaccagccccataacctgcaaggcttcagcttctcttccatgtcggacgcgggggccgtcgacgagcccccggccgacgacacgacggcggagacaggcggaaaccaggaccgcctcggcaagcggaagcgcggcgacggcggcggcagcggcagcaacaagatgatgtctttcttcgaggggctcatgcagcaggtcgtcgacaggcaggaggaaatgcagcggccgttcctggagaccatggagaagcgggaggcggagcgcacggctcgggaggaggcgtggcgcaggcaggaggtcgcccgcctcaaccgcgagcaggagcagctcgctcaggagcgcgccgccgccgcctccagggacgccgccatcatcgcctttctccagcgcatcagcgggcagtccgtgcagccccctaccgcctttgttgtcccaatgccggcaccggtgtcagtccataccacgcctccgaaacaaccttatc

SEQ ID NO: 1011 - protein, 682 aa, Pisum sativum
  Orthologous to G636
MLGDSAVLGTGGGGGSSGDAAGASASGGAYHDGGDTVGGGGGSISGDDERGGGSRNEEGGDRNFGGNRWPRQETIALLKIRSEMDVTFRDASVKGPLWDEVSRKMADLGYHRNSKKCKEKFENVYKYHKRTKEGRGGKSEGKTYRFFDQLQALENNPSIQSPRTQTQLNISTLPPTTPSSSSSLPISTTSTTLTTTNPLLLPPSLLNSTSPITIHTPSITTTAAATTVPLTTTITPPIPMSLPQVQNTVSQSNPTYFPPIPSTTTATNPTNTNNPLPQITITPPPSSFPNTSTDFFSNSSSSSTSSEETMTMEGGGNRRKRKRKWKDFFERLMKEVVEKQEELHKRFLEAIEKRELERGAREEAWRLQEMQRINREREILAQERSIAAAKDAAVMAFLQKIADQQQEQQQNIVVPVALNTNIVPQQQQALQEPTSTPTPAPASTPTPAPTPVPAPALTSAPAPMQTPTPMPLPMPIQSQQQVQTPTSAVQVQQTAPVISQALPLAQPQQAQVQVQQQATNMDIVKSDNNGESLMQASSSRWPKTEVEALIRLRTTLDMKYQENGPKGPLWEEISGLMKNLGYNRNAKRCKEKWENINKYFKKVKESNKKRPEDSKTCPYFHQLDALYREKNKGEGSSASRPEGTMMAPLMVRPEQQWPPQPQPPPVTRADVTMEDAENDRPP

SEQ ID NO: 1012 - DNA, 998 bp, Glycine max
  Predicted polypeptide sequence is orthologous to G638
ataggccaagtgatcataggagggtgagaaaaagctggagaacaaaagtggaggagatagtggattcccacatgaggaagatcatacagactcaagatgcttggatggagagaatgttgagtgttgttgagcaaagagagcaagagatggcatctagggaggaagaaaggaagagaaaagagtcaatgtggtttgaccaacaggtgcatgaactgtgggccaaagagaaagcatgggttgaggcaagagatgctgcattgatagaggttgtgaggaaacacattgggatagggataggacttgaagcattgccattggtcgaagaagaatcaccgaataagaataagagccagggaagtattgatgccaatgagtttccctctgagggtgttgatcctggtagaagtagtagtagtaggtggacagaaatggagatttcaaatttgatgcagctaaggactagttttgagcaaagattcagagaaaataataatgggtacatggagaatggggtttgggatgaaatagcagcaaaaatggcttgtttggggtttgataggagtgcaagtgagtgcaagcaaatatgggaagagatcagcatctctctcagaaggacagtggatgagtgtgatgatggtgcaaaaagaaggccttggtatttgggactttagctgacggatgatgatctttgacacattcttgttctaaccgaaggcatcgatcagagagattaagtatatatgacactttgcttttgatgagttctgagcgtggaaggaaacttgtgggagaaacaagctagggcttgagagggttattaactaggatgtaacaagtttggatcattagcgaatcacaaggtattctaggccacgtgtttaactatatatttaattaatataacgtatgaggactcattcttgagtgtaagcattgactttgttgtttattattaattttatccatgcatgcatcagatgctagagtcatcagttatt

SEQ ID NO: 1013 - DNA, 1730 bp, Glycine max
  Predicted polypeptide sequence is orthologous to G638
gaaggatcatgtcctcgagccgaatcggctcgaggagtgggaaaaagtgcagggagaagtttgagaacctgtacaaatattacaagaagacaaaggaaggaaaagctggaagacaagatgggaagcattacaggttctttcgtcaacttgaagccttatatggtgaaaacagtaaccaagcctcggtgccagaaaccaattttggcagtggtagccttcgtttccacacaagcactcgagccgattcggctcgagaaacaaatcaagaaatgtttcagtctcagaagcattgtgacagcctaagcctcaccaacttcactgatttggacacttcatcatcggatgacaatgatcaaaatagcactggcagggaactcaacaaggacaatgactccatggagaagaggagaaagagggtgagtggaagaagctggaaggtgaagataaaggacttcattgactcacagatgaggaagctggtggagaagcaagaggagtggttggataaactcacaaagacactggaacagaaggaaaaagagagagtgttaagagaagaagagtggaggagacaagaatctgtaaggttggagagggaacacaaattttgggctaaagagagagcatggattgaagcaagggatgctgctttaatggaggctttgcacaaattaacacgaaatgagataatgaagagtactcattctcacgagggtctaatggtaactggaattcagaaccacagtgaaaaccagaatgaagatgggagtgaaatactaaatagcactactgccagaggtgctgaaagctggacagaatctgagattgcaaggcttcaacagttgagagctgagatggagacaaggtatatgcaaagtgggtgttcagaagaggttatgtgggaggaaatagctaccaaaatggcttgttttggttacgaaaggagtgctgtggtcttcaaagagaaatgggagagtataagcagcaactatgcaaggagtgccaaggatggaagcaagaagcgcaaggaagactcaagaagttgtttttacttcgataacagtgaccaatcttctctgtataaccaaggaggtgcctattgtgatatcaacgatcaaaggcacaagactgggaggctgcaaacaaatgatggctcttcaccttccaattcaaatgttggaaatgcagttgcgggtgataactgctttcccttcttgatgactgagggtggaaatttgtgggagaactatagcttaaaggttaataaagcatgccaaaaccagtgatgagagtgaaaaaaagtttgacacttgtaagaggcaagaaaatttcacagccttttatcagatgatctcacattatgtaagcaagagctaactgatgagggtcgtttatgtatagagactgatgatgataaggtgatcaatcttattatatttatgggaatcaaagtgaaaaataatgtgttcaagtcacgtacgtaagtttaatgagggagactagacattggcaaaatttcacaggtgagtatgacactaattcaggtgagtttctcttgtagcagatttcttttatgcgtgcaaaatggaatttgcaattttatattacttcacatgttgcatcttcaatgatgtttatatatcattagttgttaaccctcaaaaaaaaaaaaaaaaaaaaaaaaaaaaaaaaaaaaaaaaaaaaaaaaaaaaaaaaaaaaaaaaaaaaaa

SEQ ID NO: 1014 - DNA, 1221 bp, Glycine max
  Predicted polypeptide sequence is orthologous to G638
gaattcggctcgagggtaactggaattcagaaccacagtgaaaaccagaatgaagatgggagtgaaatactaaatagcactactgccagaggtgctgaaagctggacagaatctgagattgcaaggcttcaacagttgagagctgagatggagacaaggtatatgcaaagtgggtgttcagaagaggttatgtgggaggaaatagctaccaaaatggcttgttttggttacgaaaggagtgctgtggtcttcaaagagaaatgggagagtataagtaactatgcaaggagtgtcaaggatggaagcaagaagcgcaaggaagactcaagaagttgtttttacttcgataacagtgaccaatcttctctgtataaccaaggaggtgcctattgtgatatcaacgatcaaaggcacaagactgggaggctgcaaacaaatgatggctcttcaccttccaattcaaatgttggaaatacagttgcgcttgataactgctttcccttcttgatgactgagagtggaaatttgtgggagaactatagcttaaaggttaataaagcaagccaaaaccagtgatgagagtgaaattatatggttgacacttgtaagaggcaagaaaatttcgcagccttttatctcagatgatctcacattatgtaagcaagagctaactgatgagggtcgtttatgtatagagactgatgatgataaggtgctcaatcttattatatttatggaatcaaggtgaaaaataatgtgttcaagtcacgtacgtaagtttaatgagggagactacacattggcaaatatcactgaattgttggggtgtgagtatgacactaattcaggtgaatttctccattagctgatttcttttatgcgtgcaaatggaatttgcagttatattacttcacatgtcgcatcttccgataatgttcatatcattcattagttggtcaccgtctttctcctagtttccaccttccacacctatcttgccttttttttaattaattttttgggatatttatactgtgctggccttttgtgtttgtgtactgaaaggtagcaatttactttggtatttatttattggtcaatagttttatgaaccgggagaaagtgatgtattgatggatattgttgaagcatcggacattgttacaagcataaaaaaggccagattttctttaaaaaaaaaaaaaaaaagggcggccgccg

SEQ ID NO: 1015 - DNA, 516 bp, Glycine max
  Predicted polypeptide sequence is orthologous to G638
ctcgagccgtatcgcctcgaggagtgggaaaaagtgcagggagaagtttgagaacctgtgcgaatattacaagacgacaaaggaaggaaaagctggaagacaagatgggaagcattacaggttctttcgtcaacttgaagccttatatggtgaaaacagtaaccaagcctcggtgccagaaaccaattttggcagtggtagccttcgtttccacacaagcagccacaataataacccttctcaaacaaatcaagaaatgtttcagtctcagaagcattgtgacagcctaagcctcaccaactccactgatttggacacttcatcatcggacgacaatgatcagaatagcactggcagggaactcaacaaggacaatgactccatggagaagaggagaaagagggtgagtggaagaagttggaaggtgaagataaaggacttcattgactcacagatgaggaagctggtggagaagcaagaggagtggttggataaactcacaaagacactggaaca

SEQ ID NO: 1016 - DNA, 654 bp, Medicago truncatula
  Predicted polypeptide sequence is orthologous to G638
ctcatggaaatggaagaccataatcaacactatgatagtaatagtatcactgatcttagacaactcattaatattgttccaagatcaactaccaacaatttccctacggcggagctattccccgccggcaacccacatcaacaacactatgagatgatgatgtttggtagacaagtagcagatataattcctcgttgtcttcatgattttgtttcaacagattcacctgctgttgctactactgccactcctaccaacactaccactagtgcttcaactccttcatttagtggtaatttagaagctgaaactactgctttcattgctgttgatgcttcaactggaagatggcctagacaagagactcttacacttcttgagattagatctcgtcttgatcctcaattcaaagaagctactcaaaaaggtcctctttgggatcaactttctaggataatgtgtgaagaacatggctatcaaaggagtgggaaaaaatgcagggagaagtttgagaatctatacaaatactacaaaaagaccaaggaaggaaaagcaggaagacaagatgggaagcactacagattctttcgacaacttgaagccttatatggagaaaacaataacccttcttcatcttcactcccacaaaacaat

SEQ ID NO: 1017 - DNA, 487 bp, Glycine max
  Predicted polypeptide sequence is orthologous to G652
aagaattcgcggccgcaggaatttttttttttttttttttaatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcc

SEQ ID NO: 1018 - DNA, 860 bp, Glycine max
  Predicted polypeptide sequence is orthologous to G652
ggctcgaggaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagcctcgccgaaggagagtccgttgagttcgccattgaatctgaatctgacggacgcgctaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggtggaggcggtgcttgctacaactgtggtgaatcgggacatctggctagggattgcagtggaggcggtggtggggacaggtaccgaggaggtggtggtggcagatatggaggcggcggtggcgggaggtaccgtggtggaggcggcggcggcggcggcggcggaggaagctgctacagctgtggagagtctgggcattttgccagagattgcccatcaagtgctcgttgaatttactgttagggttgtttatgttttgcggattgttttaagttttcactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgttatcaatt

SEQ ID NO: 1019 - DNA, 992 bp, Glycine max
  Predicted polypeptide sequence is orthologous to G652
  misc_feature (978)..(984): n is a, c, g, or t
  misc_feature (987)..(987): n is a, c, g, or t
cccactcgtccgcccacgcgtccgaagggtttgtaagagaaagaaaaaagaggcgcaagatgagtggtagggtttctgggaaggtgaagtggttcaacgatcagaaggggtttggattcataacccctgacgatggcagcgaggaactcttcgttcaccaatctcagatcaaatctgacggtttcccgaagcctagctgaaggagagtccgttgagttcgctattgaatctgaatctgacggacgcgccaaggctgttgatgtcactggccccgacggcgccagcgtccagggaaccagacgcggcggtgatggtggccgaagctatggcgggggacgaggaggtggtggaggtggatatggcggtggcggcggctacggtggtggcggtggctatggtggaggcggtggctacggtggtggtgggcgaggcggtggtggcggggcttgctacaactgcggtgaatcgggacatctggctagggactgcagccaaggaggcggtggagacaggtacggcggaggcggtggtggtggtggcaggtatggaggcggcggtggcgggaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaatctgcaaacaaaatctgtttggacctacattttgctataatgaattggatgattgttatcaaaaaaaaaaaaaaaaaaaaaaaaaaaaaaaaaaaaaaaaaaaaaaaaaaaaaaaaaaaaaaaaaaaaaaaaaaaaaaaaaannnnnnnaanaaaaa

SEQ ID NO: 1020 - DNA, 906 bp, Glycine max
  Predicted polypeptide sequence is orthologous to G652
ggctcgaggtgagaacaagaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagcctcgcccgaaggagagtccgttgagttcgccattgaatctgaatctgacggacgcgcgaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggtggaggcggtgcttgctacaactgtggtgaatcgggacatctggctagggattgcagtggaggcggtggtggggacaggtacggaggaggtggtggtggtggcagatatggaggccggcggtggcgggaggtacgttggtggtggaggcggcggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatcaattattgttgtgatttgctatgaagattgaattgtat

SEQ ID NO: 1021 - DNA, 795 bp, Glycine max
  Predicted polypeptide sequence is orthologous to G652
tgttagagaaagaaaaaagaggcgcaagatgagtggttgggtttctgggaaggtgaagtggttcaacgatcagaaggggtttggattcataacccctgacgatggcagcgaggaactcttcgttcaccaatctcagatcaaatctgacggtttccgaagcctagctgaaggagagtccgttgagttcgctattgaatctgaatctgacggacgcgccaaggctgttgatgtcactggccccgacggcgccagcgtccagggaaccagacgcggcggtgatggtggccgaagctatggcgggggacaaggaggcggtggaggtggatatggcggtggcggggcttgctacaactgctgagaatcgggacatcttgcttgggactgcagccaaggaggcggtggagacaggtacggcggaggcggtggtggtggtggcaggtatggaggcggcggtggcggcaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaatctgcaaacaaaatctgtttggacctacattttgctataatgaattggatgattgttatcggtt

SEQ ID NO: 1022 - DNA, 704 bp, Glycine max
  Predicted polypeptide sequence is orthologous to G652
tgtgagaacaagaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagccctcgccgaaggagagtccgttgagttcgccattgaatctgaatctgacggacgcgcgaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatc

SEQ ID NO: 1023 - DNA, 840 bp, Glycine max
  Predicted polypeptide sequence is orthologous to G652
aattaagccgtccgttgcgcttcaatcttcatattcaagaggaggaacaagcctaatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcccctcccaccgccgccgccgcgaaatcctccgggaagacgagatctaacggctgaggtgacgtcgacggccatggtgcggccgtcgtcgccgtaatcgaggagaaactcaacggactgaccgtcggacaaagaacggtagccgtcggatcggatggaagtgaagtgcacgaagagatcatcggttccatcttggggagttatgaatccgaaacctttgtgcgcgttgaaccacttaacggtgcccgtggatctccgagtctcggccatggtggctcctgaaagaaaagaagtttctggaagattcttatttgggtttgggaaagttacgctgaattgagg

SEQ ID NO: 1024 - DNA, 1056 bp, Glycine max
  Predicted polypeptide sequence is orthologous to G652
attcggctcgagaaagaggagaaggtatagactatagagagagagagagagagagatctgatccggagcgatgagtgagagtgagaagcagagggtaacggggaaggtgaagtggttcgatgaccagaagggttttggcttcataaccaccgacgacagcggcgaggaattcttcgtccaccagtcctccatccgatccgacggcttccgcagcctcgccctcggcgagtccgtcgagttccttattgactccgatcccgaaggccgcaccaaggccgtcgacgtcaccggccctgacgaatcgccagtccagggcacccgcggtggcggaggaggaggaagaggaagctatggtggaggtggcggaagaggtggctatggtggtggcggacgcggcggaagaggtggatatggaggaggcggcggaggctatgggggaggtggctatggcggaggcggtggttatggtggaggtggcggcggcggcggcggagggggatgctataagtgtggcgagactggtcacatagctagggactgcagccaaggtgggggtggcggtggaaggtacggcggtggtgggggtggcggcggaagctgctacaactgtggggagtccgggcattttgccagggactgcccttccagtgctcgttgatacaatagtacgggggtgtggccttgcttttgtgttctgtggttcttttgttttcttttttctaaatctgaatattaccctttagaaatagggttagctagggtgtggcttctttgcgttttcttttttcttttttcgggtttacattataagcaattagcttatgattagctcttggatttattggtttgctttttgggcttagggaaatgagagttttggtgaggttctgaaaccatcgactaaatactctgtttcctgtcgtgaacgtaatatgctctgccttaccttattttgttgaaatctttgaatatatcatggtatcatggtcctgctgttcggatggatggttgtgtatattttgaatatattgtgcaggaaatattgatttgttgtcg

SEQ ID NO: 1025 - DNA, 655 bp, Oryza sativa
  Predicted polypeptide sequence is orthologous to G652
  misc_feature (1)..(1): n is a, c, g, or t
  misc_feature (7)..(7): n is a, c, g, or t
ngagcgnccgctcgcgtagcgagacgaggggaaaaaaaaatcaatcaaaccctaatcagatcagggagaggcgagggctagggtttcgactcctcggcgggcgatccatggcggcggcggcgaggcatcgggggacggtgaagtggttcaacgacaccaaggggttcggcttcatctcccccgacgacggcagcgaggatctcttcgtccaccagtcctccatcaaggccgacggcttccgctccctcgccgagggcgagcaggtcgagttcgccatctccgagagcgaggacggccgcaccaaggccgtcgacgtcaccggccccgacggatccttcgtcaagggcggcgccggcggcggcggcggtggcgggggaggcttcggatcgcgcggtgggggcggatctggcggtggcggccgcagctatggcggtagctggggccgggggaggagatccggcggtggtggacccggtgggggctgcttcaagtgtggggagtctggccacatggccagggactgcttcaacggcggcggtgtcggcgttggtggaggcggtggcggcggcggcggcgctggtggtggctgcttcaagtgcggcgagatgggccacatggctagggactgcttcaacagcggtggtggtggaagtgg

SEQ ID NO: 1026 - DNA, 635 bp, Oryza sativa
  Predicted polypeptide sequence is orthologous to G652
gatccccgggctgcaggaattcggcacgaggcaaaccctagccatcgaatcgcgagagcggaagccaccgaggcggaggcggaggcggggaggagggcgcaatggcggggaaggaggagggccggatcttcgtgggcggcctgtcgttccacaccgacgagcgcaagctggccgacgcgttccgccgcttcggcaaggtcgtcgacgcccagatcatgctggagagacacacccaacgccatcgtggttttggcttcgtgacattttcagatccagaggcagttgatagcgctattaaagaaatgcactgtcaagaattagatggcaggactatatcagtgaacaaggctgagcctaagatgaatacagatgacacaaggtatgaaagtggtggtggacgaggagagtatcgtggtggtagaggtgatggaccacccccaggcaattgctttgagtgtggccgtgctggtcattgggctcgtgattgccctaatcctggtggtggtcgttctgcgcgatactcttcttctaagttcagcgctggtggcagaggagaccgtttttctggatcagataggtttggagaccgttacatggatgatcggtatgatggtgggtaccgggaaccctgtgat

SEQ ID NO: 1027 - DNA, 469 bp, Oryza sativa
  Predicted polypeptide sequence is orthologous to G652
gagagtcatccatggcttccaccgtcgccctcaagggccgcccgctcgccaccctcctcaggcagctcctcgccgccgacgcgccgcccgccgccaccgggaggcccgtcgccgccgctcccgccgcctccgggaagcccgtgaccgcccccgccgccgcgaccgccaccaacgccgcctcccgccgcctgtacaacaccgagggcgcgccgctccgccgctacgacgtcgtcgacgagtccggcaccgacagcggcgacgagtacgacgccaccgctacggcggtgaccgcggctacggcggcggcggcggcggctacggcgggggcgaccgcggctacggaggcggcggcgggtacggcggcggcggcggaggcagccgcgcgtgctacatgtgcggcgaggagggccacatggccagggactgctcccagggaggaggcggcggcggtggctaccgtggtggtggc

SEQ ID NO: 1028 - DNA, 1377 bp, Zea mays
  Predicted polypeptide sequence is orthologous to G652
cccacgcgtccgccattagctttatctactccagagcgcagaagaacccgatcgacaccatgagggtgttgctcgttgccctcgctctcctggctctcgctgcgagcgccacctccacgcatacaagcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctagcgccgacggcggaggcggctatggcggaggcggctacgggggcggcggctacggaggaggaggaggaggcggtggctgcttcaagtgcggcgagcctggccacatggccagggactgctccagcggcggcggcggctacggcggtggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcgtaagaggatcccgtccgccgttttcagatttcgttcggttcgtagaagaactctcaagttaagttaagttatcatggtgtgtgcttggtcgtcgtccgtcgttcgtcgtcgtcgttaaggttttaagagatgatttggtcctgtgttgccgaggggaagtccaatctgcttttcttttcttttttgtggtttgttccatcagactgaggaaggagatgagatgattattctcccagattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 1029 - DNA, 1408 bp, Zea mays
  Predicted polypeptide sequence is orthologous to G652
cgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggccggagatccgcgcccgacgccgctttcggctccgtcctctccggcaccgccggcgacgccgcccccagcgaccagtggttcgtcgacgcgctcaacgcccccgcgccgcaccccatcgagcgcgtccgatccgagtcctcctcgatcgtctccgacgtccccgactacctcttcagcctcgacagcccgtccgacgaccccagccccggcccctcggcggctcgcgccaagtccgacgccacggagactccgcaccaccacggcgacgacgtgccgccttccgctcgacagataccgcacgtcgcaggaggagcgtcatcgtggcccgccccgccgccgccgtacatggcgcagcctatgtactacttccccgtgccgccaccggtccactatctcgaccagtctgcgcagagtggctacatgcctcgcccgatctaccacattgtcggtggcggaggaagcgaggcgcctggcggagatcttcacgcggccggcggagtctacggcgtctcgcaccacatgcaggggttcccgccgatgatgtacgcgccgccgcgcgcggtcatctacaactacaagtcggaggggatgccatcgctgcctccggaaggtggggcacactcttcctaggcgcatcgactacttcacatctctgaatcctgattattgttgcagatgcctaagctaaggagttttgcgtggtattttttttatcgattcgtctaagtcttgttcgttgttttgtatagatggaggggttgatggtgatggatagatattaatgcagctttcgtctagtggaaatatattcgtgaaatgtatatcatactaaatagtatagcatttggtgtgattaattagtattctagttaatgtaatgtgggattcatataatctaggtggttctggtcttatagaaaccatttttgggcattttatatttacataaactggatgttgggtgaatgttctaagcagtatgtgctgtgttgaacctcaatcacttatgagtggttactaaatttgaatttgatgtcttc

SEQ ID NO: 1030 - DNA, 1186 bp, Zea mays
  Predicted polypeptide sequence is orthologous to G652
gcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggccggagatccggcggcgggggcggtcctggcgcgtgctacaagtgcggcgagcccggccacatggccagggactgccctagcgccgacggcggaggctacggcggaggcggctacgggggaggcggctaccgaggaggaggaggcggcggcggcggtggctgcttcaagtgcggcgagcctggccacatggccagggactgctccagcggccggcggcggctacggcggtggcggcggcggtggtggtggcggctgctacaactgcggccaggccggccacatggccagggactgcccaagcggtggcggcggtggcggagggaggttcggcggcggcggggttggaaggcaaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcctctcatgcgtaagaggatcccgtccgccgttttcagatttcgttcggttcgtagaagaactctcaagttaagttaagttatcatggtgtgtgcttggtcgtcgtccgtcgtcgtcgtcgttaaggttttaagagatgatttggtcctgtgttgccgaggggaagtccaatctgcttttcttttcttt

SEQ ID NO: 1031 - DNA, 1287 bp, Zea mays
  Predicted polypeptide sequence is orthologous to G652
cccacgcgtccgcccacgcgtccgcagcgagagacgggcaggggagaggaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagcctacggtggtagctggggcggcggccggagatccggcggcgggggcggtcccggcgcgtgctacaagtgcggcgagcccggccacatggcaagggactgccctagcgccgacggcggaggcggctatggcggaggcggctacgggggcggcggctacggaggaggaggcggcggcggcggtggctgcttcaagtgtggcgagcctggccacatggccagggactgctccagcggcggcggcggctaccgcggtggcggcggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcgtaagaggatcccgtccgccgttttcagatttcgttcggttcgtagaagaactctcaagttaagttaagttatcatggtgtgtgcttggtcgtcgtccgtcgttcgtcgtcgtcgttaaggttttaagagatgatttggtcctgtgttgccgaggggaagtccaatctgcttttcttttcttttttgtggtttgttccatcagactgaggaaggagatgagatgattattctcccagattaaaaaaaaaaaaaaaaaag

SEQ ID NO: 1032 - DNA, 656 bp, Zea mays
  Predicted polypeptide sequence is orthologous to G652
gtggaggcggtgaccgcggctatggcggcggcggcgaccgtgtctacggtggtggaggtgaccgcggctacggccgcggcggcggaggcggctacggtggtggtggcggcggcggtcgcggctgcttcaagtgcggcgaggagggccacatggcaagggactgctcccagggcggcggcggcggcggctacggaggtggcggcggcggtggttacggaggtggcggcggtggccgcgagtgctacaactgccaccaggagggccacatctcccgcgactgccccgagaagatgcgctaggcgcggcgccaccgtcgcgtcggatccggcggagtcccatgtcgtctctcgcccgcttccctacccgctcaaggtatcgctcggctgactctgcctgaagtcgtcggagccagttatctatcagtagtagcagtgtcgtgtttcgttctcgtcgatgctatcgtatcgtaggtggtggtagcaagaaaagcaagccgtatggggctatctttagtagtttggatctgtgttggagcagtatcagtttctttctgttggaatcgtcagttgtatggcagccattttcatggatggctctgcctaatctatcagtcatgaactatctataatatatcaatgcaatcgtgtcggttggcc

SEQ ID NO: 1033 - DNA, 534 bp, Zea mays
  Predicted polypeptide sequence is orthologous to G652
tcgttccacacccctcaccgcgtccgcctcccctaccatctagggtttctagggttttccaggaggaggaaatggcgtctgatagggtgctcgggactgtgaagtggttcaacggaaccaagggcttcggtttcatcacccccgacgatgggagtgaggacctgttcgtccaccagtcatccatcaagtccgacggctaccgcagtcttaacgacggcgatgccgtcgaatacaccgtcggcagtggcaacgacggccgcgccaaggccctggatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggag

SEQ ID NO: 1034 - DNA, 1273 bp, Zea mays
  Predicted polypeptide sequence is orthologous to G652
gggtacctcgaggccggccggggttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacgggtggaggtggcgaccgcggctacggcggcggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttaggcgcggcgccaccgtcgcgtcggatccggcggagtcccatgtcgcctctcgccgcttccctacccctccaaagtacccctccaaaggtatcgctcggccgactcttgcgtgaagtcgtcggagcaaactatctatcagtagtactagcagtgtcgtttcgttttggtctgtcgtggtggtaagaaatgcaagtagtaggtgtgaatgcaagtgagcagcaccagtatctttccgtttgaatcagttgtaaggcagtcatggtcatggttggctctgccggatctatctgtcatgaactatctatattatatcattatcaatgttgaaatatatatacttcatagactcgataggttccgatgcacgtaccctgacggtcagaatatcgcgtcccacatctacaaaggctgcatgctcatgtacccgtgcatgctggtgtagcatgctgcgatacgaccgctatcgttcgcttctggaagtacagctcaactagctctctcattggaagcccatgacgttctctagattagccgtccggacgatgtac

SEQ ID NO: 1035 - protein, 1433 aa, Oryza sativa
  Orthologous to G652
MALVPAGAGADPARGSSGSAFSYPQLTATNYTSWCIRVQAMMEDQGVWDAIEPVAGVAVDPRRDKKARSHLLQSLPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRLKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAVTEDVPERASCGLVVREQRVWPKLLLADAGGHAGDVWFLDNGASNHMTGDRSKFRELDESITGRVKFGDASTVQIKGKGSILFSCKNGDQWLLQDVYYIPSLQCNMVSLGQLTETGHRVVMDEDVLEVFDKSPWRLVMKVRRTVNRLYRIELKLAHPVSLLSSLDDPAWLWHARLGHVNFQAMKLLVDKEMAGGVLAIVHPNQLCQSCLVTKQARAPFPAAAHFRAEEPLELLHIDLCGPITPSTMSGNRYFFLIVDDYSRWMWVFVLKTKDQSLDAFVKFKPLAENTAGRRVKTLRSDRGGEFLSGEFAQVCEEAGIQCHLTAPYSPQQNGVVERRNRTVMAMARSLLKGMRVPGRFWGEAVRHAVHLLNRLPTKAMGDRTPFEAWTGRKPQLGHLKVFGCTAHAKNTQPHLKKLDDKSAPYVYLGVEEGSKAHRLFDPRRGRIHVSRDVVFEENVPWEWTSAAGQEPTDFAMEEEPGEQLPSPATAAGVVPSYQAPSPGRRTGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTAGEIIKHKAWLVAKGYVQKQGVDFEEVFAPVARLDTVRVVLAVAADRRWQVHHLDVKSAFLNGELEEEVYVAQPEGFARSGKEHLVLKLHKALYGLWQAPRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYAVGVASRFMERPTVMHFKAVKQILRYIKGTMDYGLVYAAGTGALKITGYTDSDLAGDLDDRRNTGGMAFYINQSLVAWSSQKQKTVALSSCEAEFMAATTAACQALWLRVLLAEVAGVEEKAVKLFVDNRLAIALMKNPVFHGRSKHIDTRYHFIRECVDGGQIVVEFVRTEEQRADALTKGLPAAKLATARHLLGVRSLGPRQN

SEQ ID NO: 1036 - protein, 405 aa, Oryza sativa
  Orthologous to G652
MSFPDEEEDEAFLLAVAATEEAALASSDSSKRRRLSMTSSTSSSPTSATPPPAAVPEGPYLAALKGSHSSAWKQQQETLSQARKRPGGSQTLATPGSGSGSGGAQVARGGACFKCGDSCHWARECPQSVPATGGGGGGGAFGGSGGGGGGYGDAGGAVEEKACPCGAGSCLVLTSNTPRNPGRKFYRCPMRDNGGCNYFEWCDNPSPGPANVSGNTVFQSDTSVAHMLCPCGAGACLILTTKTGKNVGRQFYRCPANQGISYLFLNVRSGHISREVALVAISSGVMNNSLGQLLHCKLQHNIILMLLQVAKFPARGAPPPASNAGKRTIGQRTAQINLQILILTKVGEHLLLQALPMRVSSVVRAGTGPVIAPPQIVVLVPSPAMSSPLLLWAHGTATDTDSRYL

SEQ ID NO: 1037 - protein, 1322 aa, Oryza sativa
  Orthologous to G652
MALVLATSDPARGSSGSAFLYPQLTATNYTSWVIRVQAMMEDQGVWEAIEPAAGAAVDPRKDKKAKSHLLQSLPEDLLMQVAKKRSAKETLKGKFGAMVMEPGETLDQYAGRITAMSVRHSVLGSTLTDAAMVKKLFDTVPEKFVSLVAGIEQFYNVDDMPFEEAVGRLKAYEERAEWEARFKKDGGESSSPQKGKASGEGAKGGQSGRERGRGRGAGGRGGAARGNSASGSGGGGRDKSHIKCFNCEEYGHYSNQCPHPKKKKGEAHLAQAEDAGAVLLLRVTEDAPARATQEMVVPQGCGAMAGNVWYLDNGASNHMTGDRKKFRELDESIPGSVRFGDASSVQIKGKGSILFSCKNGDQWLLQDVYYIPSLCCNMVSLGQLTETGHRVVMDEDVLEVFDKCPWRLVMKLCQACLVAKQIRASFLVVVNYRAEEPLELIHIDLCGPISPATMAGNKYFVLIVDDFTRWMWVFVIKSKDQAVEAFTKFKPLAENVAGRRIKTLRSDRGGKFLSGEFAQVCESAGIQRHLTAPYSPQQNGVVERRNRSVMVMARSLLKGMSVPGRLWGEAVRHAVYILNRLPTKAMGNRTPYEAWTGKKPHLAHLRVFGCTAHAKITTPHLKKLDDRSAPYVYLGVEEGSKAHRLFDPRRGRIHVSRDVIFEENAVWQWLGDAGEQVSVEFDVEEIVESPAGSATSLPGAVPRYQAPSPGRRLGKEPVVVEEEASSPAGTAEASPSLPTTPATPIGEQSTPHSAGEIDTDGAPVRYRHIADILRDAPRVDLVDDEQDGEALLAETEEPSAYREAAGHSAWEDAMAMEMDAIERNGTWELTTLPAGHRAIGLKWVYKLKKNTAGEVIKHKARLVAKGYVQRQGVDFDEVFAPVARLDTVHHLDVKSAFLNGELEEEEQAVYTWGIGSGGVIVGVYVDDLIVTGENPVELKMFKEQMMGEFEMSDLGLLSFYLGIEVDQGENGTTLKQTAYARKVLSQFGMLECNSTSIPIDPRMQLNKDADGHPVGYYWVYRQRPAGDVDDRRSTGGMAFYINGSLVAWSSQKQKTVALSSCEAEFMAATTAACHALWLRALLVEIVGGPAKVVKLFVDNKLAIALMKNPVFHGRSKHIDTRYHFIRECVDGGKVVIEFVRTEEQQADALTKVATVEGISLRLLADANDAVIESEEDRVGSVRDAGLQQRQEHERAHAGHVAGRGGVEPCHGGARGDLGVDVEEKAAAVERWSRQVVIARVAIDRSVEARRLYQTVFFEGFGERSGTVLMRIVNVGLVQLAVATKKAIVVRDSGAGKWWGRSMSRACLHEMNLYSLLQSMKPF

SEQ ID NO: 1038 - protein, 1409 aa, Oryza sativa
  Orthologous to G652
MALVPAGAGADPARGSSGSAFSYPQLTATNYTSWCIRVQAMMEDQGVWDAIEPAAGVAVDPRRDKKARSHLLQSQPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRLKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAVTEDVPERASCGLVVREQRVWPKLLLADAGGHAGDVWFLDNGASNHMTGDRSKFRELDESITGRVKFGDASTVQIKGKGSILFSCKNDDQWLLQDVYYIPSLQCNMVSLGQLTETGHRVVMDEDVLEVFDKSPWRLVMKPRRPGLAVACAAGTRKFSSNETAGGQGDGGGVPAIVHPNQLCQSCLVAKQARAPFPAAAHFRAEEPLELLHIDLCGPITPNTMSGNRYFFLIVDDYSRWIWVFVLKTKDQSLDAFVKFKPLAENTAGRRVKTLRSDRGGEFLSGEFAQVCEEAGIQRHLTAPYSPQQNGVVERRNRTVMAMARSLLKGMRVPGRFWGEAVRHAVHLLNRLPTKAMGDRTPFEAWTGRKPQLGHLKVFGCTAHAKNTQPHLKKLDDRSAPYVYLGVEEGSKAHRLFDPRRGRIHVSRDVVFEENVPWEWTSAAGQEPTDFAMEEEPGEQLPSPATAAGVVPPYQAPSPGRRAGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTAGEIIKHKARLVAKGYVQKQGVDFEEVFAPVARLDTVRVVLAVAADRRWQVHHLDVKSAFLNGELEEEVYVAQPEGFARSGKEHLVLKLHKALYGLRQAPRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYAVGVASRFMERPTVMHFKAVKQILRYIKGTMDYGLVYAAGTGALKITGYTDSDLAGDLDDRRSTGGMAFYINQSLVAWSSQKQKTVALSSCEAEFMAATTAACQALWLRLLLAEVAGVEEKAVKLFVDNRSAIALMKNPVFHGRSKHIDTRYHFIRECVDGGQIVVEFVRTEEQRADALTKGLPAAKLVTARHLLGVRSLGSRQN

SEQ ID NO: 1039 - protein, 205 aa, Oryza sativa
  Orthologous to G652
MADVEEYRCFIGNLSWSTTDESLKDAFGKFGNLTEAKVVFDKYSGRSRGFGFVTFDEKKAMEDAIEGMNGLDLDGRAITVDKAQPQGPGRDRNGDRDYDRDRGSRYDRGRDFGGGGRAPRGSGGGGDCYKCGKPGHFARECPSGDGGGRGDRYGGRDDRYGGGGGGGGRYGSDRGGDRYSGRSRDGGGYGGGGGDRYSRDRSGPY

SEQ ID NO: 1040 - protein, 1433 aa, Oryza sativa
  Orthologous to G652
MALVPAGAGADPARESSGSAFSYPQLTATNYTSWCIRVQAMMEDQGVWDAIEPAAGVAVDPRRDKKARSHLLQSLPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRPKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAMTEDVPERASCGLVVREQRVWPKLLLVDAGGHAGDVWFLDNGASNHMTGDRSKFRELDESITGRVKFGDASTVQIKGKGSILFSCKNGDQWLLQDVYYIPSLQCNMVSLGQLTETGHRVVMDEDVLEVFDKSPWRLVMKVRRTVNRLYRIELKLAHPVSLLSSLDDPAWLWHARLGHVNFQAMKLLVDKEMAGGVPAIVHPNQLCQSCLVAKQARAPFPAAAHFRAEEPLELLHIDLCGPITPSTMSGNRYFFLIVDDYSRWMWVFVLKTKDQSLDAFVKFKPLAENTAGRRVKTLRSDRGGEFLSGEFAQVCEEAGIQRHLTAPYSPQQNGAVERRNRTVMAMARSLLKGMRVPGRFWGEAVRHAVHLLNRLPTKAMGDRTPFEAWTGRKPQLGHLKVFGCTAHAKNTQPHLKKLDDRSAPYVYLGVEEGSKAHRLFDPRRGRIHVSRDVVFEENVPWEWTSVAGQEPTDFTMEEEPGEQLPSPATAAGVVPSYQAPSPGRRAGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTTGEIIKHKARLVAKGYVQKQGVDFEEVFAPVARLDTVRVVLAVAADRRWQVHHLDVKSAFLNGELEEEVYVAQPEGFARSGKEHLVLKLHKALYGLRQALRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYVVGVASRFMERPTVMHFKAVKQILRYIKGTMDYGLVYAAGTRALKITGYTDSDLAGDLDDRRSTGGMAFYINQSLVAWSSQKQKTVALSSCEAEFMAATTAACQALWLRVLLAEVAGVEEKAVKLFVDNRSAIALMKNPVFHGRSKHIDTRYHFIRECVDGGQIVVEFVRTEEQRADALTKGLPAAKLATARHLLGVRSLGPRQN

SEQ ID NO: 1041 - protein, 197 aa, Oryza sativa
  Orthologous to G652
MASERVKGTVKWFDATKGFGFITPDDGGEDLFVHQSSLKSDGYRSLNDGDVVEFSVGSGNDGRTKAVDVTAPGGGALTGGSRPSGGGDRGYGGGGGGGRYGGDRGYGGGGGGYGGGDRGYGGGGGYGGGGGGGSRACYKCGEEGHMARDCSQGGGGGGGYGGGGGGYRGGGGGGGGGGCYNCGETGHIARECPSKTY

SEQ ID NO: 1042 - protein, 309 aa, Oryza sativa
  Orthologous to G652
MAEKEVGRIFVGGLSWDTTERTLERAFSEYGKVIETQMVVLERDTGRSRGFGFVTFSEPRAVDAAIRGMHNGELDGRTISVNKAQPRMNTDDGYGYGGGGGGGGTYSSGARGGYRGGGDAVPSANDDCFKCGRAGHWARECPYSSGGGGGRTGRYSPPSRYGSGTGGGRGDRFGGSDRFANRYVDDRYDGGRYVDDRYGGGGRDRYATDRYPPTADRFTGDRYGGSDRYASSGFTRERSYERDGGRSGGSYYRDEPRGSGGYDKGGMRMGSGDRYGTGGPARFAGSYRDRPAPYDRPSRAAARTYDDRY

SEQ ID NO: 1043 - DNA, 976 bp, Glycine max
  Predicted polypeptide sequence is orthologous to G663
acgtaagctcggaattcggctcgaggaagtagaggtcttaagagtttgagaactgagaagagatgggtggtgttgcatggacagaagaagaagatcacttgctcaagaaatgcatacaacaatatggagaaggaaagtggcatcgtgttcctttactggctggtttaaacaggtgccggaagagttgtaggctaagatggctgaactatctccgtcctaacatcaagagaggaaattttgcggaggaagaagtggaaatgataatcaaactccataaattactaggcaacagatggtcgttgattgcaggaaggctaccaggaaggactgccaatgatgtgaaaaactattggaactgtcatctgagcaaaaaactaaatgtaatagaagctgaagatagaccaataacaagagatgttcaagtcattaggccccagcctaggaacattgttggttcaagctcagtgaaaagaaggggtcaaaatgagtctccaactgacaaaggagttcaacaagagagtagcatgtcctcactgacgtttgatactgctgatggacagaaccatatgcttgattcacagcaagacaacaacatatatgcatgcctggaccaacagggcattgttagtgagttgtcaatggattttcagttcgaaggatttggagcaatgatgaatggggagggtagtagcagccaatgggattggggtgatttgctcttagacatggacttgtacaagtgaattaattttcttcttagttattgctcctgttgatgtggggatggcaatgttggtctcataccttggctacgtatcaatatcgaagttaagtgtttcgatggaaatggtagctaagttggttgtgtatcatgggtatgtcataatcataattaagatctagtgggtttcatcttttgacccctgtagatggtccatctcactaccatgagccatttataaaatcatcttcagtc

SEQ ID NO: 1044 - DNA, 486 bp, Glycine max
  Predicted polypeptide sequence is orthologous to G664
acgagggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccatagcctccttggcaacaagtaagcatatctataactataactattcttcatactcctatctttctcatcatcacattcctcaatcataggtggtctctaattgctggaagattgccgggtagaacggacaatgagataaagaattactggaatactcacataagaaggaagcttctgagcagaggaattgaccctgccactcacaggcctctcaacgatgacaaggtattggaacgctg

SEQ ID NO: 1045 - DNA, 1337 bp, Glycine max
  Predicted polypeptide sequence is orthologous to G664
ggccactctctctctttaacctgcctcaccaactcgcatctagaagcaattatagggtctttctctcttctctctctatgttctgtcccctctactttggagtcaaaagcctataaaaccacacccaaacttcctcttgagctcgagccgaatcggctcgaggctagccaatcctaattcctattctcctatcctttttactacataactctaaagtaagtaagaaaaatagagcaatttcacaacacaactcttataattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggtcttctccggtgcggcaagagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcttctgctgcaactgttacaactaatatatcttttggcaaacaacaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaccggtacagttgaacatttttgcccaattttcccttttgttgttactcttcactttcttttcttccggcaattgatggtagtcataaagaaaaaaaaaaaaaaaaaaaaaaaaaaaaaaaaaaaaaaaaaaaaaaaaaaaaaaaaaaaaaaaaaaaaaaaaaaaaaaatgg

SEQ ID NO: 1046 - DNA, 1265 bp, Glycine max
  Predicted polypeptide sequence is orthologous to G664
caacagccactctctctctttaacctgcctcaccaactcgcatctagaagcaattatagggtctttctctcttctctctctatgttctgtcccctctactttggagtcaaaagcctataaaaccacacccaaacttccgctcgagcccgcgccgtatcggctcgcggctagccaatcctaattcctattctcctatcctttttactacataactctaaagtaagtaagaaaaatagagcaatttcacaacacaacacaactcttagaattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgtttatttttgaattttctctcctattttttcttttttttcttctcttatttgtataaataattagtcgctgatatgcataatttttagtaacggtacagttgaacatttttgccccccaaaaaaaaaaaaaaaaaaaaaaaaaaaaaaaaaaaaaaaaaaaaaaaaag

SEQ ID NO: 1047 - DNA, 923 bp, Glycine max
  Predicted polypeptide sequence is orthologous to G664
gtggtgggcataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatgaaatcatattactgaaatctctctctttctttctttctttcttttcttctctaatataatttcttacttacttacttacttacttacttacttgttaatggttgcaaatgataaaaaagttccagccagtacagttgaacaaaaaaaaaaaaaaaaaaaaaaaaaaaaaaaaaaaaaaaaaaaaaaaaaaaagggcggccgc

SEQ ID NO: 1048 - DNA, 887 bp, Glycine max
  Predicted polypeptide sequence is orthologous to G664
gtgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcattcgccccctcgaagaagaccaactcatcatcaaactccatagcctccttggcaacaagtggtctctaattgctggaagattgccgggtagaacggacaatgagataaagaattactggaatactcacataagaaggaagcttctgagcagaggtattgaccctgccactcacaggcctctcaacgatgacaaggtattggaacgctgccctgacttgaaccttgagctaaccattagtcctccccgtcaacctcaatctgatcagcatcacttgaagcccgttgggagaaactcaaacctttgctttgcctgcagtttgggtttgcaaaatagcaaagatcattgtagctgtgcgctcaacactgccaacgctgcttctggccatgatttcttggccttgaaaaccagcgttttggaaatgaaatgagtcaaattcattttggaatctttcttccctaattaattagttgttaatggatgcaaatgattgcctgcccaatttcctcgtggagccctttctattattcctatgttcatgtacatgtgcgtaagactacaaactttcttgtttatacgattggttctttccaaatagaatacaactatatatttttgttatttctataacaaaagttcaattcatcacttcgatcgatggtagagagaattaccacaatcatt

SEQ ID NO: 1049 - DNA, 858 bp, Glycine max
  Predicted polypeptide sequence is orthologous to G664
attcggctcgagcatatacattttttagccttttgttagccccaaacacccacacgggcacacccctgcaggtacaaaagggggagttcacaacaaaaagaaaacaatgagaaaaccttgttgtgacaaggaaaacatcaataaaggtgcttggtccaagcaagaagaccaaaagctcattgactacatccaagtccatggtgaaggctgttggcgttccattcctaaagctgctgggctgcatcgttgtggcaaaagctgtaggatgagatggttaaactacttacgaccaggcatcaaacgtggaatctttgctgaagatgaggaagacctcatcatcaaactccatgccctccttggtaacaggtggtcactcattgctggaaggttgcctgggaggacagacaatgaggtgaagaactattggaattctcacatccgaagaaaactaataaagatgggaattgatccaaatagccataagccacaccaaagctttcctcgtcctcatgtttcttctgctgatcatcagggtgcatcaacatctgagtccatcaacaacaacaaagtccctttcttcaattcccgtggttcagctgccactgatcatcataagatttcgttcactaaagaagaaacatcaattatttcatcaccccctttgaatcttgatcttacaatttctttaccttcgcctgtggaagaaaacaaaaattctgatcatgagtccgccaagacatgtgacgtggatatagatctcaactgttagtacttttagttgttggcaagagtattaattaccagcagtagtacttcatgtttgttacaaattaattttggagaaataatcagtttttc

SEQ ID NO: 1050 - DNA, 1256 bp, Glycine max
  Predicted polypeptide sequence is orthologous to G664
ccacgcgtccgctccattcgcgaaaggctcgcagcaaaaccacgccatcgatcgccgccaccagtccagcatcctccgatcgactacgtactcccacccactccggcagcagcgaggcctctctgtctgtgcgcggcgtggctgtcgtcgatctctgcctggcgggcggccggcatggggaggtccccgtgctgcgagcaggcgcaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctcgaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtctgcggcgacggcagctcctcctcctcctcctcgcactcccactcccactcccaccaatgggctctgaattttttacaggcggcggcgccctgctacagaggccaatagtgtagtaagagcgatcagtgacatcattaaaatgggagcgttattacgatcgagactgagggtgagggaggggggcagagctgagcagggatagtagttaactacagctagtagtagtagtagtacgtaaaagacacacatgcttaggctttaacaagtctctgaaacacgcatcatgggttatgagttgtgctctaaaaaaaaaaaaaaaaaaaag

SEQ ID NO: 1051 - DNA, 1177 bp, Oryza sativa
  Predicted polypeptide sequence is orthologous to G664
ccgggctgcaggcgacgacgacgactcgccgccggccgagaccaacagcgatggggaggtcaccgtgctgcgagaaggagcacaccaacaagggcgcgtggaccaaggaggaggacgagcgcctcgtcgcctacatccgcgcccacggcgagggctgctggcgctcgctccccaaggccgccggcctcctccgctgcggcaagagctgccgcctccgctggatcaactaccggcgccccgacctcaagcgcggcaacttcaccgccgacgaggacgacctcatcatcaagctccacagcctcctcggcaacaagtaactacgcttctcttttcttgccttctgcctcacctcgcctctcttccatccatcgattgctcatcgattttcatcatccctcgcgtccgctctgatcgcggcgaggctgccggggaggacggacaacgagatcaagaactactggaacacgcacatccgccggaagcttctcggcagggggatcgaccccgtcacgcaccgccccgtcaacgccgccgccgccaccatctccttccatccccagccgccgccaacgacgaaggaggagcagctcatactcagcaagccgcccaagtgccccgacctcaacctggacctctgcatcagcccgccgtcgtgccaggaagaagacgatgactatgaggcgaagccggcgatgatcgtgagggcgccggagctgcagcgccgccgcggcggcctctgcttcggctgcagcctcggcctccagaaggagtgcaagtgcagcggcggcggcgccggcgccggcgccggcaacaacttcctcggcctcagggctggcatgctcgacttcagaagcctccccatgaaatgaaatgatcctgcaaaccaatccatgatcgttacactttctcttctcttttgggttcttgatttcttagctagctttggttactgcttagtgttagtccttcttaattaggatcagatagaggaatacttcctttggggagatgatcagtgatcttgttgatcacttcctccattttgtgtaaatactgttccactcatacttagttcagttgatgatatggttatttaggttgttggatgtaaatttgttctcggtctgaaaatctatggtatttgtcatgccttgccgagaaaaaaaaaaaaaaaaaa

SEQ ID NO: 1052 - DNA, 496 bp, Oryza sativa
  Predicted polypeptide sequence is orthologous to G664
cttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggcc

SEQ ID NO: 1053 - DNA, 1070 bp, Oryza sativa
  Predicted polypeptide sequence is orthologous to G664
cgccatggcgccaccatgcatataaactcgagctccctctcctcctcttcttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgttacgcaccgcccgctcaatgccgccgccgccgtcgccggccaccaccacctcgcgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgccggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgcatcagctagcaaaatcatcataatcatcatc

SEQ ID NO: 1054 - DNA, 1200 bp, Oryza sativa
  Predicted polypeptide sequence is orthologous to G664
gcacgaggaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagcatggggaggtccccatgctgcgagaaggcgcacacgaacaagggagcctggacgaaggaggaggaccagcggctcatcgcctacatcaaggccaacggcgagggatgctggaggtcgctccccaaggccgcagggttgctgcggtgcgggaaaagctgccggctgcgatggatcaactacctgagaccggacctcaagcgaggtaatttcaccgaggaggaggacgagttcatcatcaagctccatgagcttctaggcaacaagtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctcctttccagccgcaggatcagaccagcgagccgatgaaccaggaggagggcgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcgggggcgccccctccatgcaggccagcacacacatgtttagattcatcacgccgctaggaggaagccccccccccagtagtagcccaccaatgacataattaattaagttgagggaggagatatatataccctacttaattcgcaattaaaacccagccccacatgcttagctctttgtaatattcatcaggaaaggtgatctctttctcttttttttttt

SEQ ID NO: 1055 - DNA, 1274 bp, Zea mays
  Predicted polypeptide sequence is orthologous to G664
ttgggtacctcgaggccggccgggggctccttgcctttgttctgttctccattcgcgaaaggctcgcagcaaaaccacgccatcgatcgccgccaccagtccagcatcctccgatcgactacgtactcccacccactccggcagcagcgaggcctctctgtctgtgcgcggcgtggctgtcgtcgatctctgcctggcgggcggccggcatggggaggtccccgtgctgcgagcaggcgcacaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctccaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtttgcggcgacggcagctcctcctcctcctcctggcactcccactcccactcccaccaatgggctctgaattttttacaggcggcggcgccctgctacagaggccaatagtgtagtaagagcgatcagtgacatcattaaaatgggagcgttattacgatcgagactgagggtgagggaggggggcagagctgagcagggatagtagttaactacagctagtagtagtagtagtacgtaaaagacacacatgcttaggctttaacaagtctctgaaacacgcatcatgggttatgagttgtgctctta

SEQ ID NO: 1056 - DNA, 1305 bp, Zea mays
  Predicted polypeptide sequence is orthologous to G664
ccgggtcgaccccgcgtccgcggacgcgtgggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtagggccgccgcgcgcctctccctctccctcctacccctcgtcattcgtttcgtttcctaaactggccgggtacgttacgtgcaggtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggacgagaggaggaggagcgcaacaaggcgacgatggtcgtcggccgcgaccggcagagccagagccacagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctgggactccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctctctctctgtatctctgtaattaccatcgccaaatgatcatgggggcaatatcatgctaggtctctggaaaaaaaaaaaaaaaaaaagttgacgctaatcccgtttccagg

SEQ ID NO: 1057 - DNA, 1014 bp, Zea mays
  Predicted polypeptide sequence is orthologous to G664
  misc_feature (32)..(32): n is a, c, g, or t
gaggccaacccttttcaccactctaaagagcnctcgcgatccagtcaagtgcggtatggcggcccgccccccggcccggctcccacccttgcgcgcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgctccattaattctgtctctctctctctctctctcgctatgtaaattagcatcaccaactgattgattgatcatgggcaattaataatacttgttgctgctgcaaattgacattaaaaaaaaaaaaaaaaaaaaaaaaaaaaaaaaaaaaaaaaaaaaaaag

SEQ ID NO: 1058 - DNA, 1334 bp, Zea mays
  Predicted polypeptide sequence is orthologous to G664
cattgggtacctcgaggccggccggggattcctcagtcaagtgcctatgcctatctatggtaccctcccccgcctcccggcacacccttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggacgagaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcggttttgttttgccacacctcacatggatgatgaattgatgatacgtgggtggttagttttttcgtaggtgaaaaatacgcgatggtgagcgagtgaaagagagattgtgtgccctgggtcctgctcgctgctctctgttgctgctgcattgtgcctcgctgtgggctctgtgtctctgtgtgtgtggggagtgtgtgtgtgattctgtgggtgg

SEQ ID NO: 1059 - DNA, 1315 bp, Zea mays
  Predicted polypeptide sequence is orthologous to G664
cttttttttttttttttttttttgagcagactgcaatgaatcatatcctcaagaggataaaaaaactattacctcctgtgcagggcatcagcgacaggaaaagagagatgaatgaacgaacctaatccatccatcagcagcgtaaccaaatcaggcacaggtttgagtattaaaccagtggaagtgatgagctgggagcaggcctaacccttttccaccaactctacaagagctcccgcgatccagtcaagtgccctataaaatccagccccgcttggcttcacccacccttgggctcgcaatcgcagcaacgatggggagatcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaagtaggcagcccgaccgacctcaagcactaaggcacccactaaggcactaactgtgttgtctgtgtatgatctgtttgttgggtcacagatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgcccacgcgtccgcggacccgcgcccctgataacacgcaggagtagtagtcaccaactgatttgtcgctccattaattctgtctctctctctctctctcgctatgtaaattagcatcaccaactgattgattgatcatgggcaattaataatacttgttgctgctgcaaattgacattaaaaaaaaaaaaaaaaaaaaaaaaaaaaaaaaaaaaaaaaaaaaaaaaaaaaaaaaaaaag

SEQ ID NO: 1060 - DNA, 865 bp, Zea mays
  Predicted polypeptide sequence is orthologous to G664
  misc_feature (13)..(13): n is a, c, g, or t
  misc_feature (717)..(718): n is a, c, g, or t
gcccgggcccgtnagcacttagcccccaacaacaacaacagcaccaacttccactcctgcaaacccaacccaacccaacccaccaccgagcacaagaaaaaggagagccatcggcggcggcagaccatcgtctaaaggcaaaggccctgttcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacatccggcgcaagctgccgggccgcggcatcgaccccggtcacccaccgccccgtcaacagcgaccacgccgcgtccaacatcaccatatccttcgaggcggcgcagagggacgacaagggcgccgtgttccggcgagacgccgagcccaccaaggcagcggcagcggcgatcacccacgtcgaccaccatcaccgtagcaacccccaccaccagatggactgnnggccagggaagccgctcaagtgcccggacctgaacctggacctgtgcatcagccccccgtcccacgagggacccatggtggacaccaagcccgtcgtgaaagaggaggccggcgccggcggtcggcgtcgtgggcctctgcttcagc

SEQ ID NO: 1061 - DNA, 1239 bp, Zea mays
  Predicted polypeptide sequence is orthologous to G664
gtgcggacgctcgaggccggccgggttgcgaggcctaacccttttccaccaactctacacagagctcccgcgatccagtcaagtgccctataaaatccagccccgcttggcttcacccacccttgggctcgcaatcgcagcaacgatggggagatcgccgtgctgcgagaaggcgcacacgaacaagggcgcgtggaccaagaaggaggacgaccgtctggtggcgtacatcaaggcgcacggcgaagggtgctggcgctccctgcccagggccgccggcctgctgcgctgcggcaagagctgccgcctccgctggatcaactacctccgccccgacctcaagcgcggcaacttcaccgccgacgaggacgacctcatcgtcaagctccacagcctcctcggcaacaagtggtccctcatcgccgcgcggctcccgggccggaccgacaacgagatcaagaactactggaacacgcacatccggcgcaagctgctgggcagcgccatcgaccccgtcacgcaccgccgcgtcgcggggggcgccgcgaccaccatctcgttccagcccagccccaacaccgccgtcgccgccgccgcagaaacagcagcgcaggcgccgatcaaggccgaggagacggcggccgtcaaggcccccaggtgccccgacctcaacctggacctctgcatcagcccgccgtgccagcatgaggacgacggcgaggaggaggaggaggagctggacctcatcaagcccgccgtcgtcaagcgggaggcgctgcaggccggccacggccacggccacggcctctgcctcggctgcggcctgggcggacagaagggagcggccgggtgcagctgcagcaacggccaccacttcctggggctcaggaccagcgtgctcgacttcagaggcctggagatgaagtgaacgaaacgaagcccacacgtcctttcttctccttttgttgtcggttttagtcttggcttgttggatttggatagagctagttggttactagttgttagttagaagatagtgcaggatgatcactagctactggctacctcaacacagtagctgctcccttcttctcttccattctatgtaaaccccccccaaaaatacttagtacctggttgatgaactttaggaataatcatgtgtactttcttctgactccgggttgcttcccggattctttgtgttgtaatgtaactactactactacaagtagtagg

SEQ ID NO: 1062 - DNA, 1027 bp, Zea mays
  Predicted polypeptide sequence is orthologous to G664
tgttgtaggaaggtggggcgcgagtcgcacctcgcagcagcagcagcagcagcaacaacaacctccactgcgcgcaacccaccgagaggcgagagcggcggcaaaaggacgatacaaaagcagccagggttgctggcaacagcgtcggggggtgtttttttttttccatggggaggtcgccgtgctgcgagggggggcacaccaacaagggcgcgtggaccaaggaggaggacgagcgcctggtcgcgcacatcagggcgcacggcgaggggtgctggcgctcgctgcccaaggcggccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgcaacattctgtctctctctctctctctctctctctctctctctctctctcgctatgtaaattagcatcaccaactgattgatcatgggcaattaataataaaaaaaaaaaaaaaaaaa

SEQ ID NO: 1063 - DNA, 1152 bp, Lycopersicon esculentum
  G3509  Predicted polypeptide sequence is orthologous to G664
cacaacaaagccaaaaaaacttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaagctgaattcgttgaaacaagcaaagaatcagataataatgaaataattcaagaaaagtcatcatcatgtcttcctgacttaaatcttgaactcagaattagtcctccacatcatcaacaactcgatcatcatcgtcatcatcaacgatcaagctctttatgttttacatgtagtttgggaattcaaaatagtaaagattgcagttgtggaagtgaaagtaatggaaatggatggagtaataatatggtaagtatgaacattatggctggttatgactttttgggcttgaagactaatggtcttttggactatagaactttggaaactaagtgattcgattcgattcgaatttatgcataaatcatcttaatttgatgtatatgtagaaaagaaaaagagtttgaggatattatttcttctagctaataattttctcatggttgtaaactttgcaatatagtaattacatttaattcaaagcagtaaaaatatagcactaatgattctatgaagataatttttctttttcctctaaaaaaaaaaaaaaaaaaaa

SEQ ID NO: 1064 - protein, 287 aa, Oryza sativa
  G3506  Orthologous to G664
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHAAAPSNASFARSAASPPSEDGHSSSGGSSDAPRCPDLNLDLDLDLSMSLPSSPPKTPAAASSTTASRHHHHQQQKTICLCYHLGVRNGDVCSCKAAAPSPAGPRAFRFLRPLEEGQYI

SEQ ID NO: 1065 - protein, 243 aa, Oryza sativa
  G3504  Orthologous to G664
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 1066 - protein, 2359 aa, Oryza sativa
  Orthologous to G664
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVEMDRQWMYADRRSKEFIDGVHYFLRVAEANRQRGFICCPCNKCKNQKEYSASRTIHFHLFESGFMPSYNCWTSHGEQGVEMEEDEVEDDNIPDFAQYVGFEGNQTGEEEIAADGNDVADDLGQMLQDAREDCESEKEAHKLDKMLEDHRNSLYPGCEQGHKKLDTTLELLQWKAKNGVSDKAFGDLLKLVKNILPGGNKLPETTYEAKKIVCPLGLEVHKIHACPNDCILYRGEEYENLEACPVCKALRYKIRRDDPGEVNGQLTKKRIPAKVMWYFPIIPRLRRLFRNKGNARMLRWHAEERQQDGMLRHPADGSQWRNIDRKFKEFGKDARNIRFGPKQPGNDIDVYLRPLVEDLKQLWKKEGVPVWDEDKQEEFNLRALLFVTINNWPALSNLSGQSNKGYKACTHCMDETESTYLKHCRKVVYMGHRRFLAANHPVRKKGKHFEHKADHRTKPKHRSGKTVFAMVKDLKVVFGKGPGSQHIESEDGHAAMWKKNSIFWELPYWEFLDVRHAIDVMHLTKNLCVNLLGFLGVYGKSKDTLEARNDLKHMEQRGDLHPEPKEKGSHYLSPASYTLSKAEKESMFECLESIKVPSGYSTNIKRIISTKEKKFTNLKSHDCHVLMTQLLPVVIRGILPDNVRATITKLCAFMNAISQKVIDPDRLEALQNEVVQCLVSFELIFPPSFFNIMTHLLCHLVKEIRILGPMYLHNMFPFERYMGVLKKYVRNRARPEASIAKGYGTEEVIEFCVEFIEDLRPIGVPESRHEGRLRGKGTLGRKAIMTVDNNLFRKAHFTVLQHSSLVAPYIEEHLALVRARNIGKSDAWITRHHIDTFPAWLRQHLMGNESINQQLAFLARGPSGSIATFQGYEINGYTFYTRAQDMKSTNQNSAVRVDAMGHDGTTATYYGAIEDIWELDYGPLKVPLFRCQWVRLTGGGVMIDDSGMTTVDLNKVGYSDEPFVLANDVTQVFFVKDMSSKGKKGRGPDEPKRQVVLPGKRKIVGVEDKTDEDYDQLDGQPPFTVTIDPSILLSNEDTPYSRSDHKEGTIMADRDEEQILYDTIAEGSSQYWNEEEGNEDPNQYLNEEGNVERDAEGNQQGHVERDVEGNQEEEASGSQPSVGQKRARGQRGAAKKLEGRHIITEVEEDGRPSAPAEAAKNYVRHSGWVVRDNVPVSTVYWRRTRARGDHESFVQDSEKEMLWTTMLETFTLPAGTEDKVKRWTLKKMAEQFQSFKGDLYQKYILKGQTPNFDTFPKLRDHWDEFVAYKTGEQGKAMMERNKENAAKKKYHHHLGSGGYSVAMPKWEQMEASLIERGIEPATANWPERSKFWYYAHGGTLNPADGSLVFGYQIQEAVRRLTDAVEASSQGTFRPDRDRDELTLALQTPEHPGRTRGKGVIPWKIGFKEDIHTYRSRIRSKRDTEAKIADLEFRVSSYELNMQEEVARKVDERMAAHRSHDPQPTIPPAMVSPSGNRSSCASTGQVGSQSMDAMQTQDESTCPVDDITQRTPCELHIPFKNLSIKVASGMAIPTDPSGTYHCRPIPAGYSKVEVELVEGAYEDLELDYPGGDGETHLRDTCHAIILWRRRYIILPGRQAASRAPSPPAPPSPPQDPAPSPPHAPPAPSPPQAPASTPQDPAPTPPRAPTPTPPQAPVPAPSKSRAPPAPPLAHTRATKKAKVDAAKNKDPGYDCTQEELDAYVASEVKRQFKPRSPEKKIPIDPSVRNFFRGMSASVKEAIKLSDYEQTLKKASSGKSKPVPQLGEQPNQEIEPLVTGKEMTIEQFITDTGLTTDQLLGVAPIEKAEVKYMYELGKPLVKPELLQSLPTQMYKFHQLYMEMSATGREMIGARIRDTDFLQGDDILWINFRGIYELYQLDALDVSIMSCWILMEIQRARRRRVFDTGFIDPRKVNVAMLDQYPQETEDNLVHLLKAQHYKTFILLPYNTEFHWVLLLIDLEACTVNVYDSMDKKESTFDKVFELIDRAWYRFRHLVRGKWRERLRRKFKFPCAKQKQGTNLCGYYVCEYCHCLADQIITTRELDFIRMRDNLTTHKEFIAAVQEQLMGFINEEILDPKGEFYYDGNTIHRSLASELAASTTTSKS

SEQ ID NO: 1067 - protein, 261 aa, Oryza sativa
  Orthologous to G664
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEPRPE

SEQ ID NO: 1068 - protein, 251 aa, Oryza sativa indica
  G3503  Orthologous to G664
MGRSPCCEKAHTNKGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPVTHRPINDSASNITISFEAAAAAARDDKAAVFRREDHPHQPKAVTVAQEQQAAADWGHGKPLKCPDLNLDLCISLPSQEEPMMMKPVKRETGVCFSCSLGLPKSTDCKCSSFLGLRTAMLDFRSLEMK

SEQ ID NO: 1069 - protein, 260 aa, Oryza sativa japonica
  G3505  Orthologous to G664
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKAAPPPPHPISVPAKAAAAAIFAVAKPPPPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 1070 - protein, 266 aa, Oryza sativa japonica
  G3507  Orthologous to G664
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKLLARGLDPLTHRPLNAAAAVAGHHHLAAGGSSCSPDATSGHSSCSDGDEYRGGIDLNLSISPPSSSSQPSSPPPPPHEAEARRAGATASYTYHHHYSETREKICLCLNHLGLHGGDECSCGGSSASSSSSPPPATASSRAFTFANASSSTV

SEQ ID NO: 1071 - protein, 295 aa, Oryza sativa japonica
  G3508  Orthologous to G664
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVCSCGRGGAPSMQASTHMFRFITPLGGSHHNSSSTTMT

SEQ ID NO: 1072 - protein, 273 aa, Lycopersicon esculentum
  G3509  Orthologous to G664
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 1073 - protein, 267 aa, Hordeum vulgare subsp. vulgare
  Orthologous to G664
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 1074 - DNA, 1531 bp, Oryza sativa
  Predicted polypeptide sequence is orthologous to G680
cactctcagaaagattttcttgatttggatcaggagtattgccgttctactgtaggccagtacgatgctgcaagcctggcagctgcatggattgcagggtttgacaacaatgtggagacaagcatgctggagaaggtggatgacatattggcaaaagatctgtaggcatcttggttgcagtggcattgcatcattggtgcaaaggctgcatagttgtgaggaaagggctgtgctgcggcattgccgtcgaattttggatccacaggaagtgttggatggatgcattgattcatagttccgctggctcctcccatttgatcacttgtttgatcaggatggcttccttcagttccagtggcttgaaagccagtaaccccatttctgtccatttggtagtgtgaagcttttgcagcagaccaatccacatatgttgtctccacagagtttgattttggcttaaattgttggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagccccctggatgcaccatgatttgaagagcttttgttaactgaagaaaatgatgccgatgggacttctcgaaagagattaagaacttcggagcaacttcctttttcagatatctcctttctttgaagtttctcccttcctggaagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgccaggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctacttcacccgcgccccgtgctcccgctctactaaatcctcagctgcagttggtctgtgcacacaaaaaccaagtcagcagagttcacccttgctcctttcgttatcttcaactctagaatcagattaaaactcgcagttctcaa

SEQ ID NO: 1075 - DNA, 1310 bp, Zea mays
  Predicted polypeptide sequence is orthologous to G680
cctgccgggcttctattcgtcttcctcctcttccacccatcctgcctgctcacttccgttccgtagtccagctagatccccgggcaaccgatccaccgagaagcttgtggttgtggcggcggcggagagggaagcggggagcgggaggtcggaggtaggcgcggatgccactgttgtgccggcgccggcggggccggtgatgcccgcttgagctgggcctccgtgcgtcggaggtggacgagggagcgaggcggcgccagaccgaggttgcgtcgggctcgatttctactgggctgctgtctgctgagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggtagcggtggactgaggctgaacacaaacggttccttgaagccttgaaactttatggttgagcatggcagcgcatagaagagcatgttgggacaaagacagccgtgcagatcagaagtcacgctcaaaagttcttcactaagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccccataattgatttcttcaaagttatatttacatctaagctactatagggcttcagatcctgcaatgcagtgcttccttaaaactcaatctgttgtgtgctgtattttaatgcttgtcaagcaggcccctaggctgctttaaaaccttatctcgtagactttgatttaagcatcatgcaactatcaaacttttttttggtcaaaaaaaaaaaaaaaaactcgagggccatcgatgagcgctgtcctcaagatgctggaggaggagatcttgtccccctgcatgagcgagctgtgctacgagcagcacctggagctctgagctgaggaggaagatggtgctggctgcgtgcgtgaagcgtcatggatgagact

SEQ ID NO: 1076 - DNA, 882 bp, Glycine max
  Predicted polypeptide sequence is orthologous to G682
  misc_feature (430)..(430): n is a, c, g, or t
  misc_feature (871)..(871): n is a, c, g, or t
tctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttctttttttttttggtctctgtgaattattttgtatattnttagtctcttgtctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttctttttttttttggtctctgtgaattattttgtatattnttagtctcttg

SEQ ID NO: 1077 - DNA, 574 bp, Hordeum vulgare subsp. vulgare
  Predicted polypeptide sequence is orthologous to G682
cagctcatactgtaaccccccacccacaaccgtcgctacactcacaagctaacctgaccatttgagcaagcatatgagcagcaaaagcttgggcaagaactccaagatcatgagtggccgtgaaagaaaagaagttaatagcaacgcaaagcattttgttgatttcacggaggcagaggaagatcttgttttcagaatgcacagacttgtcgggaacaggtgggaacttatagctggaagaatccccggaagaacagcagaagaagtagagatgttctgggcaaaaaagcaccaggaccaatgaaagggaaagcaggatgcatccagtaaaactagattgacatatagggtgctttttcctgtccatcaaaaacctgtgttgatcttactcgtcctatcttctcacccatgctaaaagctgttaggaataagcaacttgtattcccatgaggccataggccgatatatatacatgtacaggtgatgggctatatgcaggaaaacaccttatatattgggataaatacaaaagggtacatgacttatattataaaaaaaaaaaaaaaaaaaaaaa

SEQ ID NO: 1078 - DNA, 356 bp, Populus tremula x Populus tremuloides
  Predicted polypeptide sequence is orthologous to G682
tctttcaacttaattatggctgacttggatcactcctctagtgatgacaactctgttgattctagagaggaaaccagccaagattccaagcttgaattctcagaagatgaggaaactcttatcaccaggatgtacaatctggttggtgagaggtggccattaattgctgggaggattccaggaagaacagcagaagaaattgagaagtactggacttcaagatctctacgagtcagtaaatcagggttgtccaagatgattgccctatctgatgtactagagtagcaaaattttgggtggtttgtagcgtcttctaagacctgcaatatgggtgggttgggtgtgacaagatattg

SEQ ID NO: 1079 - DNA, 819 bp, Triticum aestivum
  Predicted polypeptide sequence is orthologous to G682
  misc_feature (389)..(389): n is a, c, g, or t
  misc_feature (416)..(416): n is a, c, g, or t
  misc_feature (515)..(515): n is a, c, g, or t
  misc_feature (524)..(524): n is a, c, g, or t
  misc_feature (541)..(541): n is a, c, g, or t
  misc_feature (559)..(559): n is a, c, g, or t
  misc_feature (570)..(570): n is a, c, g, or t
  misc_feature (580)..(580): n is a, c, g, or t
  misc_feature (585)..(585): n is a, c, g, or t
  misc_feature (613)..(613): n is a, c, g, or t
  misc_feature (621)..(621): n is a, c, g, or t
  misc_feature (629)..(629): n is a, c, g, or t
  misc_feature (666)..(666): n is a, c, g, or t
  misc_feature (685)..(685): n is a, c, g, or t
  misc_feature (694)..(694): n is a, c, g, or t
  misc_feature (701)..(701): n is a, c, g, or t
  misc_feature (703)..(703): n is a, c, g, or t
  misc_feature (712)..(712): n is a, c, g, or t
  misc_feature (726)..(726): n is a, c, g, or t
  misc_feature (743)..(745): n is a, c, g, or t
  misc_feature (752)..(753): n is a, c, g, or t
  misc_feature (758)..(759): n is a, c, g, or t
  misc_feature (768)..(768): n is a, c, g, or t
  misc_feature (772)..(772): n is a, c, g, or t
  misc_feature (785)..(787): n is a, c, g, or t
  misc_feature (792)..(792): n is a, c, g, or t
  misc_feature (794)..(794): n is a, c, g, or t
  misc_feature (801)..(801): n is a, c, g, or t
  misc_feature (806)..(806): n is a, c, g, or t
  misc_feature (811)..(811): n is a, c, g, or t
  misc_feature (813)..(813): n is a, c, g, or t
  misc_feature (815)..(816): n is a, c, g, or t
  misc_feature (818)..(818): n is a, c, g, or t
ggaagaaataaggtgcagcgcctcatagtgtacccccaccaccaccaacgctacactcacaagctaacctcaccatttcaggaagcatatgagcagcgaaagcttgggcaagaactccaagatcatgggtggccgtgaaagaaaagaagttaatagcaccgcaaagcattttgttgatttcacagaagcagaggaagatcttgttttcagaatgcacaggcttgtcgggaacaggtgggaacttatagctggaagaatccccggaagaacagcagaagaagtagagatgttctgggcaaaaaggcaccaggaccaatgaaaatgaaaacaggatgcatgcagtaaaactagattgacatataggatgcacatgtccatcaaaaacctgnggtggatctactcgtctatcttctagncatgctaaaagcaacttggttctgtccaacatgggatgtacataagaaacctcaagaaaaaggaggaacatgtgctaaataacaaaaatatgaattcgntttgtccangattattctacatttcnactaatacatacatgttnaatggcccagngctattaagncccanattgccaaaaagagacctgggtgattcntaactttngttttggnggggactaatccaatgtaatcctaacatgcttaaganaattccactgcagaacatnggggatgcntctgggnanaagattttnttggcaaataaaanatgctgtgtctggaaannnaccgctnnagganngctttaaanttcnggaaagttcgttnnnaaatnangtaaaanctccngtccnangnncnt

SEQ ID NO: 1080 - DNA, 506 bp, Gossypium arboreum
  Predicted polypeptide sequence is orthologous to G682
ggaatccagtgaagattccaagcttgacttctcagaagatgaggaaaccctcattattagaatgttcaatttggttggagaaaggtggtctttgatagcagggagaatccctggaagaacagctgaggagattcagaagtattgggcttctagattctcttacaataatccaatgcccaatctgagttaggattacatccaagtgtttgggttttgcattgggtgattgtttcagttttggtttgcagcgtatatatatatataaaagcaaatgcctgggttttgtacaatgcctcatggttgctatttgctttagtatgataattccgaggttgatttctctttttctttttgaaattatcttcacttttggtgttaatattatgaatttcttgattgctttgcctagttcactggatcaccacagttaccattggacttattttgagaattcttaaatggattaatatatacttttccctaaaaaaaaaaaaaaaaaaaaaaaa

SEQ ID NO: 1081 - protein, 83 aa, Oryza sativa
  Orthologous to G682
MDSSSGSQGKNSKTSDGCETKEVNNTAQNFVHFTEEEEDLVFRMHRLVGNRWELIAGRIPGRTAKEQYTEGEIWCLETFPRRM

SEQ ID NO: 1082 - protein, 79 aa, Oryza sativa
  Orthologous to G682
MESSGGSQLGKNSKTSDGRETKEVNSTAQNFVHFTEEEEDIVFRMHRLVGNRWELIAGRIPGRTAEEVEKFWAIKHQAT

SEQ ID NO: 1083 - protein, 73 aa, Glycine max
  Orthologous to G682
MTDIDRSSDNVSSDSIEKSSQVSDVEFSEAEEILIAMVYNLVGERWSLIAGRIPGRTAEEIEKYWTSRFSTSQ

SEQ ID NO: 1084 - protein, 80 aa, Glycine max
  Orthologous to G682
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 1085 - protein, 74 aa, Glycine max
  Orthologous to G682
MADIDRSFDNNVSAVSTEKSSQVSDVEFSEAEEILIAMVYNLAGERWSLIAGRIPGRTAEEIEKYWTSRFSTSQ

SEQ ID NO: 1086 - protein, 74 aa, Glycine max
  Orthologous to G682
MADIDRSFDNNVSAVSTEKSSQVSDVEFSEAEEILIAMVYNLVGERWSLIAGRIPGRTAEEIEKYWTSRFSTSQ

SEQ ID NO: 1087 - protein, 75 aa, Glycine max
  Orthologous to G682
MADSDLSSSQISTHSTDSGNRGSSKVEFSEDEETLIIRMYKLVGERWSIIAGRIPGRTAEEIEKYWTSRFSGSSE

SEQ ID NO: 1088 - protein, 75 aa, Glycine max
  Orthologous to G682
MADSDRSSSEVSTHSTDSGKRGSSKVEFSEDEETLIIRMYKLVGERWSLIAGRIPGRTAEEIEKYWTSRFSGSSE

SEQ ID NO: 1089 - protein, 78 aa, Zea mays
  Orthologous to G682
MDSSSGSQDKKFRDNDRPEAKEANSTAQHLVDFTEAEEDLVSRMHRLVGNRWEIIAGRIPGRTAEEVEMFWSKKYQER

SEQ ID NO: 1090 - protein, 67 aa, Zea mays
  Orthologous to G682
MQLYPFTIIAEANSTAQHLVDFTEAEEDLVSRMHRLVGNRWEIIAGRIPGRTAEEVEMFWSKKYQER

SEQ ID NO: 1091 - DNA, 1063 bp, Glycine max
  Predicted polypeptide sequence is orthologous to G715, G1646
cccacgcgtccgatcgggtctcccacacacactctttctctctctctctttcccggatcatcaaaatcagaaaaaattgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgccaaggcctgcgagctcttcatcctcgagctcaccatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagagttgagtgacatcgatgccgatgatggacagtcaggagttatgaagattctgaacttgctgcaatttagaaatggttttgtttactaaatttttatgggatgacactgtgaacctgttaactcgatgaacagcatgatttaactacttttgtacaaaaatttaaaactaaacactgatccttctgtgtgaaacatgtatgatcatctgccaatactgtttatttcctcataagtcaaaaaaaaaaaaaaaaaaaaaaaaaaaaaaaaaaaaaaaaaaaaaaaaaaaaaaaaaaa

SEQ ID NO: 1092 - DNA, 1008 bp, Glycine max
  Predicted polypeptide sequence is orthologous to G715, G1646
cccacgcgtccgcttaaatttcccaatcaattccatccatcgggtctttactctcttacccagcccacacacactctttctctctctctctttccctgatcatcaaaatcagaaaaaattgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgcggctcgaggcgagctcttcatcctcgagctcaccatccgctcctggctccacgccgacgagaacaagcgccgcaccctccagaagaacgacatcgccgccgccatcactcgcaccgacattttcgacttcctcgtcgacatcgtcccccgcgacgagatcaaggacgacgccgcgctcgtcggggcaacggccagtggggtgccttactactacccgcccattggccagcctgccgggatgatgattggccgccccgccgtcgatcccgccaccggagtttatgtccagccgccctcccaggcctggcagtccgtctggcagtccgccgccgaggacacgccctacggcaccggtgcccaggggaaccttgatggccagagctgagcgacaaccatgccgaaacggactgtcaggagttatgaagattctgaacttgcttggaattttgattgcttgcaatttggaaatggttttgttaactaaatttttatgggatgacactatgaacctgttaactcgatgaacagcatgatttaactacttctgtacaaaaatttaaaactaaaccagtgatccttctgtgtg

SEQ ID NO: 1093 - DNA, 615 bp, Glycine max
  Predicted polypeptide sequence is orthologous to G715, G1646
aattaagaattcataatctccaattattttattagagttccaattagacggctaaagcaggcttggccggccatgttattggagtgaaactatgaaagcttcaaaggaaatggcatatataacactcaaacttgacactgatgctacaactaagagactactaaagctgaagttaactcagaaacacataggagtgaagtagagagcaaatatgagacaagctggtgcatattcagggttactgtgtggtggggtatcgggaaggacagggccccactcactgcccttggcaaggatcaagaagatcatgaagaattctggggagggtgttaagatgatatcaggtgaggctccaattattttctccaaggcttgtgacctcttcattgaggaacttactagaaggtcctggatcatggccatccaaggcaaaaggaggactttgcacaaagaggacttggcttctgctgttatagccactgatatatttgatttcttgatcactttggtttccagttctgacagccatgcagttggtggtgccacaaatgtcatggggaggtggaaactattagattactctttaagccaccttacactacatactgcagctac

SEQ ID NO: 1094 - DNA, 1394 bp, Oryza sativa
  Predicted polypeptide sequence is orthologous to G715, G1646
ccggccgggagcttaattgcagcacgagggcaggaaccccagttgagagtggagatggccattttgttcaggcactaggcagtgggtaggacggtgaggagtgtgtcctgcactcctgcttcccctgacgatcgatccccatgcgtgccgaagcatctgatacttttgctgtgctgttctttaatttaccctgtacttttggatatctgaagcagtagagctcgttcactcaaacaggctagcctgttttgctttctgacacagcacacacagctacaaatcgactgtaattaaggtacgtatatataggtgacaatggacaaccagcagctaccctacgccggtcagccggcggccgcaggcgccggagccccggtgccgggcgtgcctggcgcgggcgggccgccggcggtgccgcaccaccacctgctccagcagcagcaggcgcagctgcaggcgttctgggcgtaccagcggcaggaggcggagcgcgcgtcggcgtcggacttcaagaaccaccagctgccgctggcgcggatcaagaagatcatgaaggcggacgaggacgtgcgcatgatctcggcggaggcgcccgtgctgttcgccaaggcgtgcgagctcttcatcctggagctcaccatccgctcgtggctgcacgccgaggagaacaagcgccgcaccctgcagcgcaacgacgtcgccgccgcacatcgcgcgcaccgacgtgttcgacttcctcgtcgacatcgtgccgcgggaggaggccaaggaggagcccggcagcgcgctcgggttcgcggcgggagggcccgccggcgccgttggagcggccggccccgccgcggggctgccgtactactacccgccgatggggcagccggcgccgatgatgccggcgtggcatgttccggcggcgcgcccggcgtggcagcaaggagcagcgccggatgtggaccagggcgccgccggcagcttcagcggggaagggcagcaaggttttgcaggccatggcggtgcggcagctggcttccctcctgcacctccaagctccgaatagtgatgatccatatggttccatgcatgcatcgctgaggtgctagctagctactatagctgctcaaatcaaatgctcaatgtgtcggtaattaattaatgtggtacgtattaacttaaccgatgtacgtaatggacgctcaagctaattaagggatgtacaatttactaattaatttaatttgtaatatatagccgattaactagcaaggtgacccagtactatttgtaatttcttttcccgttatgctactaattgtggacgcacaaaccattaccggaacagaaattactactgatgaattactatatataataagcttatataaaaaaaaaaaaaa

SEQ ID NO: 1095 - DNA, 819 bp, Oryza sativa
  Predicted polypeptide sequence is orthologous to G715, G1646
ccggccgggaaaaaaaatcaatcatcctatagttgctcccctatttcagcatctcaatttaagaaaggtgtgaaggcatgccgatcccggaaaaggacggggtggaggacaatcaagaggatgatacattttcaaggttgcaattgcttgcacaacaacgacatgccatggagaagttctggaggatgagccaggaacagatcgaagaatccgcaggcaacgaagagcttatactgccgatttcccgtgtcaagaatatcatccatgcaaaggagggtggtatgatgttatctgctgataccccagcttttgtaacaaaactttgtgaacttttcgtccaggagctcatccttcgtgcttgggtgtgcgccaactcacacaatcgtgaaatcatacttggcacagatattgctgaggcaatcaccaccacagaatcctatcactttcttgctaatgtagtccatggccaccaggcgctaggaagcaacataccagagataggggtttctgcttggaagcgccataagctagatgaaatgacctcactctgccatcctccccaagcagtgcaggtcacagatttagctaaccatccacccaatattcctgtttgtcctcctataggtcaatcgggtactcagcacacaacatctacacatgttttgatgatgcaaggagaatctattcacaaggcaagtaaagaaaaatccccactgaaggaagtgatggtgccgacccaacaaggtgggcatgaccaacagctcttatgcagttcctaatgttggtggtgctactagtagtaaagctgttattgatagc

SEQ ID NO: 1096 - DNA, 673 bp, Zea mays
  Predicted polypeptide sequence is orthologous to G715, G1646
attgggtacctcgaggccggccgggagccgccagcgatcccaacccccgactcctccggcagcccgcaacgactcgcgccgcctccggtcgcgccgggtccagggtcaggacacttattgattttgaacaaagatctagcatggaaccatcctcacagcctcaaccagtgatgggtgttgggtcacaaccttatcctgctgctgctctctatgtgccactacctggagctcttgctgttcctcctggctcacagccagcagcagcattccccaatccaactcaactcagtgctcagcaccagatggtgtaccagcaggctcagcaatttcatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaaagacgacattgcagctgccatcacccagactgatatatatgacttcctggtggacataatcccgagggatgaaatgaa

SEQ ID NO: 1097 - DNA, 1111 bp, Zea mays
  Predicted polypeptide sequence is orthologous to G715, G1646
tttttttttttttttttttttttttttgaagagcagtaattggacaataattaccagacaaccacataatacttgtcgcattacagcatcagataagtgaggcctaggcatacactaccagcccaaacaaaggcgccccccagttacaacaaccttaccaggattctaccatcaaacaactcaattcttaatcttgagggagccccgtaaatgaccaagttttattacgcggcaacagcagcagcaactaaacagacacaaataacacatatgctattacgcggtaacagcagcagcaactaaacagacacaaataacacaactgccccggaacaataaggcaatgatgatacattattgctcaggcacatagacggaacaataacgtgatgatgatacattactgctgaggcacgtagtagtaggcgagagggtcggtggctggtactccggcggcggggcgcgggatcccggcagccgcggcagctgcggcggccgccgcatcagcgtctttaccgtcgtcgcgcggaacgatgtccacaaggaagtcgaatacctcggtgcgggcgatggcagcggcaatgtcggatttctggagcgtgcggcgcttgttctcttcggcgtgcgcccagccgcgatgggtgagctcgaggatgaacatctcgcaggcccgggcgaacaccacgggagcctcggcggcgatcatgcggacgtcctcgtcggctttcatgatcttcttgatgcgggcgagcgggaggttgtgattcttgaagtcggtagtggcctcgatctcgcggtactgctccgcccagaatatctgcagctgctgctgctgcgcggccgccgcctgctgggccgcggcagcagccggcggtgcgtagagctgcggcgggtaggcgccggcgccggcggccacaccgggagggtacgcaggcggagggtaggcaacgggggcacccatgactggaggcggcggcggggtgctggatttgttaggatccatggattcgggggcagctagggttgtgagacgagggggattcggcccgcccgccggctcgggggcccgtcttttaccggtatgaaacccggcccggccggcctcgaggta

SEQ ID NO: 1098 - DNA, 900 bp, Zea mays
  Predicted polypeptide sequence is orthologous to G715, G1646
  misc_feature (8)..(8): n is a, c, g, or t
  misc_feature (864)..(864): n is a, c, g, or t
  misc_feature (868)..(868): n is a, c, g, or t
gtaccctncgagggccccgccgccggccgggagcgatccaatccccgactcctccggcagcccgcaacgactcgcgccgcctccggtcgcgccgggtccaggtaaagcggcttccatctcctcggtctcagcgcgtcatcccctcctccttcctcttccgtttcccttagggttggagtagacacgtcggctcaaggatccttcgagggactgactggttgtgcaaatacctacttttaaattattgaaagtgggagcatgaaagggtcaggacacttattgattttgaacaaagatctagcatggaaccatcctcacagcctcaaccaatgatgggtgttgggtcacaaccttatcctgctgctgctccctatgtgccagtacctggatctcttgctgttcctcctggctcacagccagcagcagcattccccaatccaactcaactcagtgctcagcaccagatggtgtaccagcaggctcagcaattttatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaggaacgacattgcagctgccatcaccaggactgatatatatgacttcctggtggacataatcccgagggatgaaatgaaagagggagggctcggactaatcccatagntggnctgccgcctgctatgggggctccagctgatca

SEQ ID NO: 1099 - DNA, 775 bp, Zea mays
  Predicted polypeptide sequence is orthologous to G715, G1646
aaaaaaagaagcttgccatttcgctcagggccctgcaacgcgcggcagctagcgggagagagtcttgggactgggccgcccggccgcgaggaataaactcactcctgccttcatacgtatccaatatccatagccgcggcagtacgtgtatgtggttagctatacgcgacctcagctcgggcgcaagctacaacgccgaccaggcgagaagaagcatcgatagtgtgacgagctaacccacccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatacgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcccgggaccggcgtcgtcggggct

SEQ ID NO: 1100 - DNA, 865 bp, Zea mays
  Predicted polypeptide sequence is orthologous to G715, G1646
ccctgaccgccgtaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgccgcagtaacgaatttgcttccttatcatggcttcgcttccatgcagcctttgcgggttttagtaaactattattattactgagagtgccctgttgttacccatgctctgttgttgccacccaataactcgatgacctgatgatcatctgatgtgccccccgttccgtaacaagtgattccatttctgatttcagagaaaaaaaaaaaaaaaaaaaaaaaaaaaaaaaaaaaaaaaaaaaaa

SEQ ID NO: 1101 - DNA, 1205 bp, Zea mays
  Predicted polypeptide sequence is orthologous to G715, G1646
cccacgcgtccgggcttggcttgggactgggccgcccggccgcgaggaataaactcactcctgccttcatacgtatccaatatccatagccgcggcagtacgtgtatgtggttagctatacgcgacctcagctcgggcgcaagcctacaacgccgaccaggcgagaagaagcatcgatagtgtgacgagctaacccaccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagttgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtagacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctggcctcctggcttagctacatgtgcatgatgtcaatcgttcaatgtgccatgctgtgtatattctacagcaaacgtggtaatggagctgctatgcatatacagaacgaataaggcgtgacgtgtgagaccgtaagagtacgtagtactaatatgtagatgcacgtgacgtgcctattaatcaaaccattaactatgctagttaattaaattagatcctctct

SEQ ID NO: 1102 - DNA, 775 bp, Zea mays; identical to SEQ ID NO: 1099
  Predicted polypeptide sequence is orthologous to G715, G1646

SEQ ID NO: 1103 - DNA, 865 bp, Zea mays; identical to SEQ ID NO: 1100
  Predicted polypeptide sequence is orthologous to G715, G1646

SEQ ID NO: 1104 - DNA, 1205 bp, Zea mays; identical to SEQ ID NO: 1101
  Predicted polypeptide sequence is orthologous to G715, G1646

SEQ ID NO: 1105 - protein, 442 aa, Oryza sativa
  Orthologous to G715, G1646
MEQTLDVPRSLRLLAPKAQQQMDEFWRDRQKEIETTKDFSEHAIPMARLKKIVSSQKGNMMMTFDMPAFLSKMCELFVQELAVRAWASAQSHNRCIILDTDIAKAIASTESYDFLVDILHNHRVKHKSTPCSTLTTKRCRLVDQPSTSHMPYQHQLPQFAPTYTPAIPITPSLMPPISHYIPFQYPSLSQEVSPMMASAPIVNRSMLLIHNIARGLGLQGNNISTFANNNIPDNIVGCSSPTVLASMMSPALLEVAGTSLNPPNSHSICTMNMINSSDPSGSSIGDINVANQASLAPSGRFNPAILRESSCPSFLHSNNDTIVAIPEGVDISGTMDVASDVAAIVINGQEEHERETNVEHHQQNEIYESIDIGIINASVADDNKYSISWDELGMADDSLLDKFLEEFQVRNDGVLRTGIELHEDPFLGDVMLANPSTSNANK

SEQ ID NO: 1106 - protein, 421 aa, Oryza sativa
  Orthologous to G715, G1646
MEQTLDVPRSLRLPTPKAQQQMDEFWRDRQKEIETTKDFSEHAIPMARLKKIASSQKGNMMMSFDMPAFLSKMCELFVQELAVRAWASAQSHNRCIILDTDIAEAIASTESYDFLVDILHNHREKHKSTPCSTLTTKRCRLVDQPSTSRPPYQHQLPLFAPTYTPAIPITPSLMPPISHYIPFQYPSLSQEVSTMMASAPIVNRSMLLIHNIARGLGLQGNNISTFANNNIPDNIIGCSSPAVLASMMSPALLDVAGASLNPPNSHSICTMNMINSSDPSGSSIGDINVANQASLAPSEHFNPAILQESSCPSFLYNNNNDTIVVVPEGVDISGTMDVAGLVINGQEEEHERKTNVEQNEIYESIDIGIINASVADGNKCSIRWDELGTADDSLLDKFLEEFQARNDGVLHSGIVLHEDHS

SEQ ID NO: 1107 - protein, 246 aa, Oryza sativa
  Orthologous to G715, G1646
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAASFPPAPPSSE

SEQ ID NO: 1108 - protein, 205 aa, Oryza sativa
  Orthologous to G715, G1646
MEPKSTTPPPPPPPPVLGAPVPYPPAGAYPPPVGPYAHAPPLYAPPPPAAAAASAAATAASQQAAAAQLQNFWAEQYREIEHTTDFKNHNLPLARIKKIMKADEDVRMIAAEAPVVFARACEMFILELTHRGWAHAEENKRRTLQKSDIAAAIARTEVFDFLVDIVPRDEAKDAEAAAAVAAGIPHPAAGLPATDPMAYYYVQPQ

SEQ ID NO: 1109 - protein, 197 aa, Oryza sativa
  Orthologous to G715, G1646
MDPTKSSTPPPVMGAPVGFPPGAYPPPPPAGAAAAAYAQQLYAPPAAAAAQQAAAAQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAGIPRPAAGVPATDPLAYYYVPQQ

SEQ ID NO: 1110 - protein, 444 aa, Oryza sativa
  Orthologous to G715, G1646
MKQTLDVHRSLRPPMPMAQQQMDEFWRDRQKEIEMTKDFSEHMIPMARLKKIVSSQKGNMMMTFDMPAFLSKMCELFVQELAARAWACAQSHNRCIILDMDIAEAVASTESYDFLVDILHNHSVKQKSTPCSSTKRCRLVDQPSTSHIPHQHLLPQFAPTYTLAIPITPSLMPLISQCTPSSFPSLPQEKFPLMAPTPIVNRSMLFINNIARGLGLQGNNINAVANNNILDNIVGCSSPAVLASMMNPALLGPSGAPLNPPNSQSYNCTMDIINSNDACGSNNSSVIVANQANIAPSGHFYPIALQSSCSTFLHSNNNDTITAILEGVDISDIMHVTSDVDAATKVFSGQEEQHEKETNVEWHHQNEIYESIDIRIINATTRDGNKCSISWDELGMADDSLLDNFLEELQVRKDDVSDTRIAFNKDPFLDDAVLSNPSTSNGNK

SEQ ID NO: 1111 - DNA, 950 bp, Glycine max
  Predicted polypeptide sequence is orthologous to G720
aattcggctcgaggtgttttcctgcaaccattttcttccttcgtcggttgattggtgaagttgctggtgaccccagaagaaggggtagtgttggaatattattgttaagctttgaactttgaagtagtggcagaaaggttcattgacccttttttggcagacttacttgtttgtggtccgaaactgctgattgcaactgttcagtggtcacaggaagcaccaccctccaaagccagcacttaaaacctttccttctcttccgtctctcttctttacccttctgttttattaacaatgcaataagaggagaaagaacactcagtttaattagcaatggaattgaagaagcattttcttttatgccaagaaggaattggatgctgataagtggtatcgattgatctgttattttctgtgggagactgagaaacgatgccaagccagctatggttttctctgccaatgatttacaagaatggaaagattttcccaaagggctcaaggttcttctccttgagagagacaacatttctgctgccgagataagggcaaagcttgaagccatggactacaatgtttctacattctgtgaggagaatgaagccttgtcagcaatctcaagtggactcgaaagcttccacattgccatagtggaggtgagttcaagcagtggccagggaggtttcaaatttcttgagaatgccaaggacttgccaaccattatgacttcaaacaatcattgcttgaacaccatgatgaagtgcatagcgcttggtgcagttgagttcctcagaaaaccactatctgaggacaagctcagaaatatctggcagcatgtggttcacaaggcattcaatgccagggcaagcatcctgtctgaatcacttaaacctgtcaaagaatctgtagtgtccatgttgcagctccaaacagacgatgaacaacatgaa

SEQ ID NO: 1112 - DNA, 1174 bp, Glycine max
  Predicted polypeptide sequence is orthologous to G720
cccccttcctttttcggtgagcaattagtctgctcatggcaatcttcatcatccagtaaccctgttccctgcttttatttaggggtttacggaagcggatatttatcccaatcaacagactggttatgggcattaacagttaaccctcgaccatttttttaatccattgaaatccctcctttatctggtccaatgtctgtttggagctgcagcatggattctacagattctccgacaggttttagtgattcagaaagaacattttccccagaattaaatgccttgtgaacaacatgctgccaaatatttttgagcttgtcctcagagagtggtttactgagaaactcaactgcaccaagcgcaatgcacttcatcatggtgttcaggcactggtcctttgaagtcataatggtaggcaagtcctttgaattctcaagaaatttgaaacctccaaggctacagcttgtactcacctccactatagcaacatggaagccttcaggactactcgagagtgctgacaaggcttcattctcatcgtagaaagtggaaacattatagtccacggcctcaagttgttctcttatctcagcagcagaactactatctccctccagcagaagaactctaagtccctttgggaaatctttccattcttgtaaatcattggcagtgcaaaccatagctggtttggcattcttactcggtcccctagttaagtaacagatcaatattgctgatcaacaccgaatccctttctcttctccaaaactgaacacatgaatcaaggtagaatcagcatgcacacggaaagttggttcttttcacaaagccttttttttttattgtttcctagctattaccttggctgaaaagaaaatgccccaccaactactctgcccaaagttgtgttcttttctttctgctcttattccattgaagacaaacaaagcaaatagagtgagggaaggggaagtgagttaggaggtttaactacggtcgttgaagggtgtctgtgactactgaacagttgccatcgctccttaagaaccacataatatgcagaaaaagagtctctcactatggtcaatcatggttcattttccaaatctaccctcatttcttaccatttttttctataaaaaaaaattacatgtgtttcccggacgcgtgg

SEQ ID NO: 1113 - DNA, 2757 bp, Glycine max
  Predicted polypeptide sequence is orthologous to G720
ttttaaaagaaagtaatgatcatagcttagaattattttcaaaacgttaaaaagataaagtgagcaaaaacaactgaacatgcacaaagtgttgttctcaatgctgaacttaagctaaaatagctgagtgaacaaattgaattgggaaaagaacaagttagcataaaccaaagcctggactcattttttattcacaacactatcctaactatcctttttttccattattagacctcaactagaccccctccccaacaacaccaacagaaccaagacacctccagtccctgtcatgctatttttacatggaccccgaagctggtcacttacaaccaaaaacccctcaccaccacaaccatcaaaaagtccacattgttatctttctttcagccacaatattttgtataaagcttcaacaaatgcgtggccagtccttagtttcaacaaatgatgccatgcactgcattgaaactgctgaatgctgctgcatagcttaacctttttttttaatgttatttttagcgttttgttttggcaagtggccatggaataggatcaatgtattgcccatttgtgatgcatcatggtggtgtatgacctgacctgatatcatatcatatcatatcaaccatcattgctcagcagcttaaggagagacatcttgagtggttggtgtggaggcggggatggcaaggcaaagtaaatggtcccaacttccagccaaatctaccactagttgcaacctgggagggaaatttgagaaacaaaataattacaagagtcaacagggcgttgatatgtaactggctggccccatcatcaaaaccacctactctgtgggacccagtggtggggtcggtcatacatgtcagcggagtttaggagtagaagaacgcttgttgccaagagggatgccggaaatgccttgtttggagagctcagccaacacactatccatggaaggaggtttgagtcctaagggcaatggtagccatggcttgcttattgcttcctttcacaaccttgtctaccacttcttctgccggatgatgctcaaaggaacttcgtggcatgctgaatctatagtcaactgctttaggattgtgcaatccaggtgtattttgattgtagggaaaacaaggagcttgaggaggtggcaccaacgggcatccccaagcatccacatgcacccccggataaggcttccagtgccaactttctgtaggatgccacatgggataaccaggatggccccaaatctgtacaccggctgtttgactgccaggttgtccccacataggatatataggagctggagaaagggtgtgatgtgaatgatatggagggtatgccatgattggtctttgcatataatagttcctttgcattgcatccccttgattatgccatttccgatcttcttccctgggtgcactttgtctcttgtgtattctatatttctgaagatggcttgccacattgtgccttgtcaaaccttccactttcattatctccaatattctagaaggaatggcttgatcaatacctagttgttcgacagcctttacaaattttttatgcagctcaggtgtccagtctactttcaccttcttccgattagctttaatctcacatgaatcattaagtacacccgttttatttggagatgtattaccatcggcattgctgagaaactttttattatgtggattcagtgaaacagcgctctcacccttggaaacattggcaaaatcatcttcctccctaatcagagtcttatcaggttcccttggctgaggagaactttcggcattcaaattcccacatgaagtttcgacagatttacattccctatcatgttccccactttctttttctgttgagcaattagtctgctcatggcaatctccatcatccagtaaccttgtcccctgctttaattgaggggttgacggagccggatatttatcacatacagcagactgctcatggtcattacccctaaacctcgacacattctctaaatcaattgaaatcctacttttatcttgtccaatgtctgtttggagctgcagcatggattctacagattctttgacaggttttagtgattcagaaaggacattttccccagaattaaatgccttgtgaacaacatgctgccaaatattcttgagcttgtcctcagagagtggtttactgagaaactcaactgcaccaagcgcaatgcacttcatcatggtgttcagacactggtcctttgaagtcataatggtaggcaagtcctttgcattctcaagaaatttgaaacctccaaggctacagcttgtactcacctccactatggcaacactggaagcctttaggactacttgagagtgctgacaaggcttcattctcgtcgtagaaagtggaaaccttatagtccatggcctcaagttgttctcttatctcagcagcagaactactatctccttcaagcagaagaactctaagtccctttgggaaatctttccatccttgtaaatcattggcagtgcaaaccatagctggtttggcattcttactcggtcccctactgcagcaacagatcaatattgctcatcaacaccgaatcccttcttggctgaaaagaaaatgcccccaccaagtcttctggccaaagttgtgttctttctttctgctgttcttattccattgaagacaaacaaagcaactagagtgagttaggaggtttaactacggtcggacgcgtgg

SEQ ID NO: 1114 - DNA, 684 bp, Glycine max
  Predicted polypeptide sequence is orthologous to G720
  misc_feature (563)..(563): n is a, c, g, or t
  misc_feature (611)..(611): n is a, c, g, or t
aagaacagcagaaagaaagaacacaactttggccagaagacttggtgggggcacttttcttttcagccaagtaggggaccgagtaagaatgccaaaccagctatggtttgcactgccaatgactttacaaggatggaaagatttcccaaagggacttagagttcttctgcttgaaggagatagtagttctgctgctgagataagagaaacaacttgaggccatggactataaggtttccactttctacgacgagaatgaagccttgtcagcactctcaagtagtcctaaaggcttccatgttgccatagtggaggtgagtacaagctgtagccttggaggtttcaaatttcttgagaatgcaaaggacttgcctaccattatgacttcaaaggaccagtgtctgaacaccatgatgaagtgcattgcgcttggtgcagttgagtttctcagtaaaccactctctgaggacaagctcaagaatatttggcagcatgttgttcacaaggtagactggacacctgagctgcataaaaaatttgtaaaggctgtcgaacaactaggntattgatcaagccattccttctagaatattggagataatgaaagtggnaaaggtttgacaaggcacaatgtggcaagccatcttcagaaatattagatacacaagagacaaagtgcaccca

SEQ ID NO: 1115 - DNA, 684 bp, Medicago truncatula
  Predicted polypeptide sequence is orthologous to G720
  misc_feature (646)..(646): n is a, c, g, or t
  misc_feature (674)..(674): n is a, c, g, or t
gccattttcttttcagccaagaggactagaaaaaggatgccaaaccagctatggtttgcactgccaatgatttacaaggatggaaagatttcccaaaaggacttagggttcttctccttgaaggagacaacaattctgcttctgaaataagaacaaagcttgaatctatggactataatgtttctacgttctacaatgaaaatgaagccttgtcagcaatctcaagtagtcccaaatgcttccatgttgccatagtggaggtgagtataagctgccctgatggaggtttcaaatttctcgagaatgcaaaagacttgccaaccattatgacgtcgaatagtcagtgcataaacacaatgatgaagtgcatcgcgcttggtgcagttgagttcctcactaaaccactttctgaggacaagctgaaaaatatttggcagcatgtggttcacaaggcattcaatgccgaggcaagcgctctgtctgaatcacttaaaccggtcaaagaatctgtagagtccatgttgcatctccaaacagacaacacactacatgaaagtacaatatcaatagatttagataaggtgtccaagtttagtgataatgaacatgagcattctgcggcaagcgataaatatccggctccttncaccccgcaattaaacaaggggcaaggntagtggatga

SEQ ID NO: 1116 - DNA, 747 bp, Lycopersicon esculentum
  Predicted polypeptide sequence is orthologous to G720
ctttccttttcagtttccacttctctgagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgataaatatccagctccttcaaccccacaacagaaacaaggagtgaggggtcagtggatgaatgttgattacccaa

SEQ ID NO: 1117 - DNA, 765 bp, Lycopersicon esculentum
  Predicted polypeptide sequence is orthologous to G720
atatgctgcagcatgtcctctatttttctttgaaaaaatttcttgtgactaactaaaaagtgtacagttttttggtgattaataaatttgttcatgtgtgcagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgaataatatccagcttcttc

SEQ ID NO: 1118 - DNA, 783 bp, Lycopersicon esculentum
  Predicted polypeptide sequence is orthologous to G720
ggatgagctaagtcttcttcatttcccaagagatacaggcataaatcggaaacaacctctttagttcaagattgaatagttaatgactgattaaaaagtgaccgagttggagggactaaaaaggatgcctttttagaaatgatttgcattgagaatgaattattgggttggaaagatttcccaaaggggcttaaagtcctacttcttgatgaagatagcaactctgctgctgagatgaaatcaaggcttgagaaaatggactacatagtctactcgttctgcaacgagagcgaagctttgactgcaatctcaagcaaatccgagggctttcatgttgccattgtggaggtaagtgcaggcaacagtgatggggttctacggtttcttgaaagtgccaaagatctaccaactataatgacatcaaatatacattctcttagtaccatgatgaaatgtattgcgctaggcgcagttgagttccttcagaaaccattgtcagatgataaactcaaaaatatatggcagcatgtagttcacaaggcattcaatactagaaaggatgtgtccaaatcacttgagccggtaaaagattctgtcctctcgatgctgcagttacaactagaaatgggtgaagcagatgacaaaagttcaaatggaacagaacctcccactgcagtagcggaaagcaatactgaacagtcatcgggctgtgataaataccctgctccctcaccccacaattgaaacaggagtgcgatccgtcgatgatggtgactgccatga

SEQ ID NO: 1119 - DNA, 573 bp, Solanum tuberosum
  Predicted polypeptide sequence is orthologous to G720
gtgaatgttttggagggactaatttggatgtcttaaaaaggatgcctttttagaaatgatttgcattgagaatgaattattgggttggaatgatttcccaaaggggcttaaagtcctacttcttgatgaagacagcaactctgctgctgagatgaaatcaaggcttgagaaaatggactacatagtctactcgttctgcaatgagagcgaagctttgactgcaatcttgagcaaatccgagggctttcatgttgccattgtggaggtaagtgcaggcaacagtgatggggttctccgatttcttgaaagtgccaaagacctacctactataatgacatcaaatattcattctcttagtacaatgatgaagtgtattgcgctaggtgcagttgagttccttcagaaaccattgtcagatgataaactcaaaaatatatggcagcatgtagttcacaaggcattcaatgctagaaaggatgtgtccaaatcacttgagccggtaaaagaatctctcctctcaatgctgcagttacaaccagcaaagagtgaagctgatgaccaaagttcaaatgg

SEQ ID NO: 1120 - DNA, 724 bp, Glycine max
  Predicted polypeptide sequence is orthologous to G736
gcggccgccctttttttttttttttttttttgatcaattatctgttataccttgtgtttttttatttattgagaaacaacaacaaaactacatttaaaatgataattgatacctaagtttttaagaagaattacttaaaaaacctcaaagggagatctatgtcaatacaagaaaaagggggggggggagagaaaggaatgaaagaagtgaaggcttaacaaggttgacgttgaccacctgagctcatcctccgtcttttagatggaaaaagctgccggaaatcaccatgagccacggcggcaacatgccattcatccaaagccaacctctcctcctgaccaaactgcggtttgacctttcgcctgccagctcctactggcacgttgcgaagggccccaccagccgtccagtatctctggcatcccttgcagaaatgtctgggctgattaacgttgtagttattgaagtagcaaaacttggtttccatgctcttgcatcttgggcatggtatgatcttatcaggtctctttatctcctctgtcccatcttcactatcatttctatcttcttttctttctcttccatgcaacgtaatcgttgttccaaacagtttaatcccttcactagcttggccactttgtgcttcagccattaattttagagagaggaacaaagagagaatattattattcttattgaagaaggtttagctcgagccgaattc

SEQ ID NO: 1121 - DNA, 862 bp, Glycine max
  Predicted polypeptide sequence is orthologous to G736
tttcaatcctcttatctctttgtccatggactaatatttcatctatatctgcataccatcaatttcggggatcccaatcttatgtcacagctataatgtgtaacccccttaaccaattatccgcagtctatattcatgccttaaaattaaccttgcttatggacaatggacatgagcttcgaggaaaaaaaaccaatctcagcatctcacgtctcctcatagttgaacatcatcatttttttaggtgtgttcacatcttaattctcaagacacgctttggtcccttcgctgctgaagtccttaatttcttgttcataataattccaagttgtgttttcgtacatgatttcattgaccttgatgctgagctcctgaggtgattctctggcgcttggcctgaaaaatctggcggaaatgagtgttgggcatggcaacgtgtccctgattcatctcaaacctgttttcatcttcagaagtttcataggcacgcccatccatgaagtcaccggctccatggcacggtgacttagccttccggcgcccggcgccgaccgcgacgtttcggagggccccaccagccgtccagtacctctggcagctcttgcaaaaatgcctcggctgattaacgttgtagttgttgaagtaacagaatttagtttccatgctcttgcatctcgggcagggtattatcttctctgctctcttctccaccctctcatattcgcttcctttttctcctttctttacttccccacccttcaatgtaatcagcgcaccaaacagcttaatcccttgagattcctcgcccatttcagagagagagagagagagttattcttaacggagaaggttttggttggcg

SEQ ID NO: 1122 - protein, 205 aa, Oryza sativa
  Orthologous to G736
MAPAAGGFKLFGKVIMQCGVSEGTQDKAQGFVVAREKVEPEEEEEEEQRVPAAATSGQRASIKREAADRDEEQRQGGGDAAGQPTQRRLQDSAEARAAAAAPLPCPRCRSRDTKFCYFNNYNVNQPRHFCKACHRYWTAGGALRNVPVGAGRRKNRPLGPLAVAHHNHHHRAAAGFVLGFPNPSSPTSPSPVYTDRWPVTPDRPF

SEQ ID NO: 1123 - DNA, 820 bp, Glycine max
  Predicted polypeptide sequence is orthologous to G748
  misc_feature (7)..(7): n is a, c, g, or t
gtccggnaatctcccgggtacgacccacgcgtccgcaaaacccaaacctcaataaaaccgaaactcacaaacacttaaacagaggaagtaacgaaccaaccaacctgacacagccgccacaaccataaacattagcataaacaaaaaaccgttaatctcgcgcgttcttttttgttgttgtgtcgtgtcccttttggatctccagaaaatgcaggagaataaggatccagcaattaagctcttcggccagaagattgccttcgccggagaagtcgaccctccggccatttccgccggcgaaattgactcgccgccggcgatggatgtcgacaaggacgaagaagacgactttggtgactcagagactgaagatgagaaagacaaggatccccgagctgaaaaagttagtgagaaaacgaaagaagctgatcctcctccaaatgctgcagactcaaagaagaccccagagggtattcagaacccaaacacaccttccatagacgaagaatctgcaaagtcaaaaaccaacaagtcagagaacaacaacaacaacaaaacactgaagaagccggacaaaattttgccgtgtccgcgctgcaacagcatggacaccaagttctgctactacaacaactacaacgtcaaccaaccccgctatttctgcaaggcgtgccaaaggtactggaccgcgggcggcaccatgcggaacgtgccggtgggagcggggcgaagaaagaacaagaactcagcctcgcactaccgccacatcacaatctctgaagctcttcaagcggccagaattgatgcccccaacggaact

SEQ ID NO: 1124 - DNA, 1745 bp, Glycine max
  Predicted polypeptide sequence is orthologous to G748
ggctcgaggttaaaaagaaagaaaaataaaaaaaaaccaaagaaacagaaatgttggtggcaaaagactccacgatgatgaagctcttcgggaagacgatccctgcgccggagatctccgccggagctccggcattgtcttctggtgatgctgatgctgttggtgttgttcagaaccatggttcttcaagtgtcaatggggatggtgaagagcacgagattgagcaggacataatgggagaggaaacaactgagagtgagaaggaagatgaagtgaccaatcttgatactgtctcaagaccaggggaagtgtctattaacccctctaccaagaaggaggatcttacattgaaaacttcaaaaaagaccgaacaagaacaaggtgaaaattcccaagataaaacactgagaaagccggacaaaatactgccttgcccccgctgcaatagcatggataccaagttctgctactacaataattacaatgtcaaccaaccccgccatttctgcaagaattgtcagagatactggactgccggtggagtgatgaggaatgttcctgtgggtgctggtcgcaggaagaacaagaattttacttctcagtatcgtcagataactgttcctgaagcagcactcttgagttctcagccggacttgccaaatggagtcagtcatccttccttgaactgtaatgccacactccttgcatttgggtctgatacacccttgtgtgaatcaatgacatctgttttgaaccttgctgaaaaagcagtgaacaattccacaacaaatggatttaatggctcagaagaactagaaattccttttgcttatgttgctggagaaaaagtgaatgatgattccaataaatcttctgacatgtcaacaaagccaatggaaggtgaaaccaccaataggtcccaagaacaagtcatagagaattgtcatcccttcccacctcatgctccctactttcctggtgccccttggcctttcccatggaatccagcactgtggaactccccggtaccatcaccacctgcttttttcccacaaggatttaccatgcctctctatcctgcagcagcttattggggtcttactataccgggtgcatggagcatcccatggctagcgcaaccatcattaccaaatagcacagtgtctaactctggtccagaccccattgcccgaaccatagccatgtcttgattgccacgtcccaaaaagttaacaggaggaagtggggtttcaacaagaggactcttattgctgttcaaccatattgcaatggaaagtgagggaaagtgagataaggcttctagacccacccagttactgttgatgtctctcttgatcctttagccaacaaagaatagtgggtttcctcttgggggaatgtacagggcagtgggatatgcctaaggggaaaagcaaaagtggtgaggaaaagaaagtgctctatggatgtgttgaaagcaaaatgaaatgccaatgtccaagataattagcttgatgcagaagatgtgattcaaatgtgaaagctaatgaagatagggttttgcgtgactcttgtggtagtttcaaggaacaatcctaacaaaaagaaaagcgtgagccatatcagcaatactctcaagatattgtcaaacatatttcttttaacacactttatattatgagtttaatatcttattaacagtataaaataattttacattattatttaattataatttattgttt

SEQ ID NO: 1125 - DNA, 1896 bp, Glycine max
  Predicted polypeptide sequence is orthologous to G748
  misc_feature (1859)..(1859): n is a, c, g, or t
  misc_feature (1863)..(1863): n is a, c, g, or t
  misc_feature (1872)..(1872): n is a, c, g, or t
  misc_feature (1878)..(1894): n is a, c, g, or t
ggtccggattcccgggtcgacccacgcgtccgccagaaagaaaaaaaaaatgcacgaaattagagaccctgcaattaggcttttcggtcagaagatccctttccctgaagatgttgttgttgacaaagaagaaaaagaaatagaaagtggcgaggaaagagaacaagagatggaaaaatatgaagaccaaggacacaaggatgctggagttgaaaatgttactgaggaagagctagaagttgatcctcctccaaatgctgaagagactaagaattcaggctcatcccctgaggctattgtgaaccccaaaacaccttccatagaagaagaaacagaaaaatcaaaaggtgacaaaacagagaaggaacaaggtgatgcagccaactcacaagagaaaaccctgaagaagccagataaagtgctaccatgcccccgctgcaaaagcatggacactaaattctgttactacaacaactacaatgtcaaccagcccccgcattcggctcgggacggctgcgagaagacgacagaagggggcaccatgaggaatgttcctgtgggggcaggacggcgaaagaacaagaactctacctcgcattatcgccacatcactatctccgaggcccttcaagcagcaagaattgatgctcaaaatggaactcatcttccaactttgaaaggcaatggtagagtcctcagctttggattagatgcacatgcacctatttgtgattccatggcatctctcatgaatcttggagagaaaaaggctcttaatggcacaagaaatgggtttcatcatggctttgaggatcaaagactccccgttccttgcaaaagtggggaaaatggtgatgactcttcaactacatcctccattacaatttcaagtcccaagggagaaaataacaaaagcaccttccaacaacaaccattgccccaaaatcatggtttccttcctcaagttccatgcattcctggtgttccttggccctatacatggaattctccagttcctccacctgctttgtgtccttcaggatttcccctaccattctatcctgctacattttggaattgtggcatgcctgggaattggaatgttccatggttttcctcaagttcacctgcttcaaacctcaagtctccaagctccagtcccaattctccaactttggggaagcactcgcgggacagtgacatgattaagcaagactctttgcacaaagaagaagcttcaacgccaagaaacgggagtgttttggtcccaaaaacgttgagaattgatgatccaagtgaggctgcaaagagttctatatgggcaactctaggaattaagaatgagtcagtgagtgggggagctatgtttaaggccttccaatcgaagaagggtgaaaagaatcatgttgaagcctctccaatgttgatggctaaccctgcagctttatctagatccctcaattttcatgaaaactcctgaattagtggcactggtgaaaagtccttacagcaaagttagtcacttcttgagttatttgtctagctagcaagagacggtgaccatctttgagtgacattgaccttgtatagaagaagcgaaagggtggtagtctctgatttcctcggcacaagtgagacgacgaggactaattctgtctttaatttcattcgacaatattaaaatagagtatataggttttttttcatgtgcttagtttgatgagtgagttcatgtatatgtacatatataaaaatatgtgaaatactgatctttagcctagagagacggaaaagatcttttactttcttgtagtataaaataaaaatcctgactgtagaaaagttagtcacctcccttngagnataaaatangaaatnnnnnnnnnnnnnnnnnag

SEQ ID NO: 1126 - DNA, 2093 bp, Oryza sativa
  Predicted polypeptide sequence is orthologous to G748
gtcggatctctctctctctgtctctctccctctctctctcgcccatgtaccatctccatggacgacctcgccgccgcctcccctcctcacccgccgccgccgccgccggaatcccacgtgcctccgcccccgcagacgccggagaaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatcaatggcccatatatttacctgacaagtttcagaaaggaaaaaaaaaaagatctgctgcctgacaagaggttcaactccgaagaaatggttagcatttttgtactgcgtctgcgtgatgttaccttgttgctttctttggttctctaatgatcccttagttacctctatgatgacttgcattagttgaagtacctctgtccttttgttcggctgtgttgcctttatactagcatctgtgtagaatgtagaccgaagtctcaagctttcctttttgattcagtacgcttattgtgg

SEQ ID NO: 1127 - DNA, 1875 bp, Oryza sativa
  Predicted polypeptide sequence is orthologous to G748
gcacgagctcgtgccgaattccgcacgggaagatttcaagaaatccaaccaaaaatctcgcgctctcctctcctcctcctcctcctcctccgcatgagctcgtcggcgttggcgttggcctgtcgtctccgggaggagtagtgcaggcggcggcggggaagtccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttcctttaaaaaaaaaaaaaaaaaaaaaaaaaaaaaaaaaactcgagggggggcccggtaccca

SEQ ID NO: 1128 - DNA, 507 bp, Zea mays
  Predicted polypeptide sequence is orthologous to G748
cgagggaagcgaagggaagctattgacagttattcttgtacaaccaagcacgcacgcgctggaaaacctgatcacctccaacccaacatgttgggggcacgctctacatggaaacaacacactgtttgaggatgcactcttccaatggttacagttacagtaacggtgcccgctgccttgtacagcagcagcacctatgttgccaatcatattgtacagaacatatatggcatgtttggtttgcttttacggacaacggaaacagggaagcctctccgccaggattagctacactactgctgcctggaacgggaatcaacacgctgcggcaactcgcgctggagctcttgctcttgcgcctcccagcaccaacggggatgtttctcatgcttccgcctgcggtccagtacctctgacagctcttgcagaaatgccttggctgcttgatgttgtagttgttgtagtagcagaacttggtgtccatgctgttgcagcgagggcacggca

SEQ ID NO: 1129 - protein, 493 aa, Oryza sativa
  Orthologous to G748
MAALRQGDDPAIKLFGRTIPLLLDPPAAAAAAADEENSVLENSVLSFLDFLATFGVMPNLGNGVKTNNDLPLVSDKLLIVKGIPFCPNNSKKNDLQGISRPDGRIEIDSMTEDVKTEPDGSVPEKILKKPDKILPCPRCNSMETKFCYFNNYNVHQPRHFCRNCQRYWTAGGAMRNVPVGAGRRRNKHVSKYCQAMMTCNNTVAPGDVSDVVHHQVITHGSSLLPATLKENETPTEFISEVPPCKSSASILDIGEPNDTDLVPLASGDNKEEKSCASSVVVSSCSENLMPDNAIMKEPNNRSGCCNGVALPFPTGPALVLPWSLGWNSVALMPATQCSMQPVLGLKDGIPCPPSWPPQLMVPAPGICTPVVPIPLVPPLWSCFPGWPNGMWNAQCPGGSSSLVLGKHSREESLQEEEKTRNYLWVPKTLRIDDPAEAAKSSIWATLGIKPDDKGIFKSFQPNVAKNGTAPESPQALQANPAAFSRSQSFQETT

SEQ ID NO: 1130 - protein, 513 aa, Oryza sativa
  Orthologous to G748
MTTRRTRKERKQMGGGGKCKRGKRGKIAAKRRRGQVRCCSSSSSSGGARRRARERESEESLGEMGECRGGGGGGDGLIKLFGKTIPVQPDAKFLILGSASLGEFSDVQQHSGSSSSSTESDVQETAAVAVADPSPRSEVVDGESPPQPGGEAASHQQQQKEMKLKKPDKILPCPRCSSMDTKFCYFNNYNVNQPRHFCKHCQRYWTAGGAMRNVPVGAGRRKNKNATAAAHFLHRVRACAAAAAMPAAPHDATNATVLSFGGGGGGHDAPPVTLDLADKMTRLGKEGLVAHARNADAAAACSEVSSNRDDEQIGNTVAKPANGLQQHPPPPHHHHHSAMNGGGIWPYYTSGIAIPIYPAAPAYWGCMIPPPGAWSLPWPATVQSQAISSSSPPTSATPSVSSFTLGKHPREGGDHEARDHHGNGKVWVPKTIRIDNADEVARSSIRSLFAFRGGDKADDNNDDDGTGVHKLATTVFEPKRDSKTAKHPAITSLPLLHTNPVALTRSATFQEGS

SEQ ID NO: 1131 - protein, 438 aa, Oryza sativa
  Orthologous to G748
MRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGAGRRKSKSSTANYRSILITGSNLAAPAGDAPLYQLSIKGDQTATAVKFAPDSPLCNSMASVLKIGEQSKNAKPTSTAQPRNGETQTCPASGTTSDSPRNEPVNGAVSGHQNGIVGHSGVPPMHPIPCFPGPPFVYPWSPAWNGIPAMAPPVCTAPAEPANSSDNGSTASVQWSMPPVMPVPGYFPVIPSSVWPFISPWPNGAWSSPWIQPNCSVSASSPTSTSTCSDNGSPVLGKHSRDSKPQGDDKAEKNLWIPKTLRIDDPDEAAKSSIWTTLGIEPGDRSMFRSFQSKPESREQISGAARVLQANPAALSRSQSFQETT

SEQ ID NO: 1132 - protein, 440 aa, Oryza sativa
  Orthologous to G748
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGDEELDSKGNGKVWVPKTVRIDDVDEVARSSIWSLIGIKGDKVGADHGRGCKLAKVFESKDEAKASTHTAISSLPFMQGNPAALTRSVTFQEGS

SEQ ID NO: 1133 - protein, 380 aa, Cucurbita maxima
  Orthologous to G748
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 1134 - DNA, 1053 bp, Glycine max
  Predicted polypeptide sequence is orthologous to G789, G1494
ccagatgcaagcagggcatcaagcaatggtgtctggactactactttatccgccgagcctgaagctgttagagaccatgtgccgagaacaagtcctcagaatgaaaaagggaaatcggagatgcttgaaccaactacaacttcatcatccggtggctcaggtagtagtcttggaaaaaattgttcgctatctacgagaaaccagggccaaaaaagaaaaggaatagatgtggaagaatctgaggagcaaagtgaggacacagaacttaaatcagcacttggaaacaagtcatctcaacgtgcagggttggctcgaaggaaccgcgctgctgaagtgcataatctatctgaaaggagaaggagagaccggatcaatgagaagatgaaggcattgcaacaactcatacctcacagtagcaagacagacaaagcatcaatgttggaagaggcaatcgaatacttgaaatcacttcagttacaacttcagctaatgtggatgggatctggcatggcaccaattatgtttccaggaattcagcactatatgtcacaaatgggtatgggaatggctacaccgcctttccctcctattcacaatccgatgcaattaccgagactgccgcttgatcagtctgtatctgcgtctcagacaccaaaccagacattaatgagccaaaatcctattttgggtgcctttaattaccacaatcagatgcaaaatccagctctttcagagcaatatgcgcgttacatgggctatcatcttatgcaaaatgcctctcagccaatgaatgtattcagatatggtccccagggggtacggcatagtcaaacaatgattacacccagcaacagcagtggaaacatgagtggagcagcaaatattgatgaggctgtgagtggcaaaatgggttaattagtttcaaagcatgcttttgagtacctatggcgtaactaacaagataattgcaagatgatagaagcccttgtaaggcttgtatgctttcacaatatgtctgcctgttcatacagtggctgatctacagttatgtga

SEQ ID NO: 1135 - DNA, 809 bp, Glycine max
  Predicted polypeptide sequence is orthologous to G789, G1494
  misc_feature (694)..(694): n is a, c, g, or t
  misc_feature (741)..(741): n is a, c, g, or t
tcgcgatctacctgattcatcccagaaagacaatgacttaggtgcatcacgaaaggttctaaattttcctcacttttcaacaccccgtaataatgtttcttcagcacctggtagtacacagtttagggaaaaaactactgctaacttgtcacaaagtgaggctagagagtactcagtgatcacagttggttcaagtcactgtggcagcagtcatatccctcaggagaaagatgtaagcagggtttcaagcagtgctgtttgggctactaataataataatagtttatctgctgagcctgaagctgtcagagattgtgtccagagaccaatttgtcctaggagtgacaaaggaaaatcagagatgattgaaccaactgtgacttcatcttctggtggctcaggcagtaccggtattggaagaacttgttccctatcaacaagagatcatggccaaaagagaaaagggacagaagaagaagcatctgaggaacaaagtgaggccacagaacttaaatcagctgatggaaacaaggcttctcagcggacggggtcttccaaaaggaaccgtgcagctgaagtgcataatcaatcagaaaggagaagaagagataggatcaacgagaagatgaggacattgcagcaactgatacctaacagtgacaagacagatgaagcatcaatgttagaagaggcnaatcgaatacttgaaatcgctccagtttcagcttcaggtaatggtgnatggggtctgcatgacaccagtgatgttcccaggaattcagcactatatgtcacaaatgggtatgggg

SEQ ID NO: 1136 - DNA, 487 bp, Oryza sativa
  Predicted polypeptide sequence is orthologous to G789
  misc_feature (382)..(382): n is a, c, g, or t
  misc_feature (439)..(439): n is a, c, g, or t
gccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaaggtaagaaacattattatatatgcatcttttttctgatcaggtgcaagtccatggactgatacagctatgttgancggacaaggcatctatattagatgaagcaatcgagtatctgaagtcactccaaatgncaagttcagatcatgtggatgactactgggatggcaccaatgatgttc

SEQ ID NO: 1137 - DNA, 1108 bp, Oryza sativa
  Predicted polypeptide sequence is orthologous to G789, G1494
ttttttttttttttttttttttttttttttttttaaagaagggcaaagattgccactggcacttcatattataaggattattagtacatacactgggaattagcatcttagggaaggggggaaatgctatgtgcatttacagacacttgtagcatttatgtcagacagatactgattgagatacataacagcaatatggatgcaatctgttcatcatgtcaatattttcagctatctccagaaagacgaccctttgtgcaaagcctacattgaattccttatcatgtttctggtcattctaaattccatcagaggttggtggttgttcagccccagaatttggcagaacagtgctagctgacgctttcggtatctggttttgctgtgctacttgaggcccagaagcatatggtcctgatacctgtggtggcactgtttgccagccatctgggtgaaggaagggattgcttgcctctctcagttgaatgttctgcatctggtttgcaacattcattgggttcatagctggagatgaatttagagggatgtgatttggcatagaatggttcatgtatggcaatcttgacatgtgacttaggccttgtgccgcaggcatgcacgcagaattcatgcccacggccattggtggcatgaactggtgagcaccagggaacatcattggtgccatcccagtagtcatccacatgatctgaacttgcatttggagtgacttcagatactcgattgcttcatctaatcgggcgcccgggtcggtcttgttgcaatgaggtatgagttcttgcaatgcgcgcatcttctcgttgatccgatcccttcttctcctctctgacaggttatgaacttcagctgcacgagttctcctctttgatccatatcgccgcgacgacgatttggtctcttcggttgcctcgcattcagcatcctcactgcgactgtctgaatccgctctgcctttcctcttgtgggcgctggcgctctcgctgggcaagccggaagcgccgaagttgctgccgatctcgccccccatccatcccacgattcttgtgtccccccaagaaattcacaacctgcataacccctcgtgccg

SEQ ID NO: 1138 - DNA, 2125 bp, Zea mays
  Predicted polypeptide sequence is orthologous to G789, G1494
cgatatgatcgatgggcaggtaatcttgccggttgctctgctggttgttggttttttttttttttttttttttcctaggaattgactgctgattgaatattgcttgctgtacagatcagtacacacagtaggacaggagtcggagttggcatctcaggggagaggggttgctatctacctgcaactctgcatttacatgtagatgtagcattcgtgtccagacaagcattgccatattgatgtagatacactgcagcgcagctacagagatgccatccgctcctcatcacgtcagtatttccagggattgccagaaaagaaagaccctttcttgatcccattcaattctcttgaacgctgtactgcagtctgcacagcagtatgcagctcgagttcttccgtagatagaatacggcggtagacaggctgttgtcttgtaacctatacaagactcctgataataactctagaactaagcttacatgtcaaagaatatggttctgacacttctgtacagatatacagcttaaggcatgattttgatcactctaaactccatggaaagttggtggttgccctgccttagaagttggtataacagtactagctgccacttccagtatcttattgtgttcttcggcttgtgctatttgatgtccatgaacgacatggggtcctggtcctggtacctggggtaccactgctgctcgcccgccatctaggtgaaggacgtggctacctgcatccctgaggtgaccgatttgcacctggttcgcggcgttcagtggattcattagattcatagctggagacgagttcagagggatatggtttggcagggtgtggttcatgtatggtaatcttcgcatctgacttaggccctgtgctgcagggatgcaacctggattcatgcctagagccatcggtggcatgtattggtgagcaccaggaaacaccattggcgccatcccagaagtcatccacatgatctgaacttgcatttggagggacttcaggtactcaatcgtctcgtctagtatcgacgctttgtcagtcttgttgcagtgcgggatcagcccgtcccgcgcgcgcatcttttcattgatccggtcccttcttctcctctctgagagattgtgaacttcagctgcacgagtccggcgtttcgtcccatatcgccttgatggtttcgtttcctcccttgcctcctcacactcggcatcctcactcggactatctgagtcgtctctacacctccccttttctcttctgtacatggacgctgtcactgggcagcccggatccccccatagttgcttccagacccgccggatgacgatgtgccgtcgtgcgcgccggtattgctcggcaactccgactgcaatgccgcgtccttccccctgatccttgccggcgtcctgagcacctggttgcttccgcagaaggtcgagcagatgtcgccagcccagctcgactcgacgccgctgctcccaacgggcggcgaaggcgaaggctgcgaggtagggcccgggagcgttccctcgtgctgcggggcggcgtcggcgatggtgctgtaccagagctgcgtgtacaggtccttctccagcgcgtcgtcgagggtgtccgggaaccacgcggcggtctcttcgccggtgaggccgctggtgcccgggcggtcggggtcgtaggtgggcgccggcctctggtgcgcctggggctgcgcgacgacgctcccgttgtgccacagcagctccacgaggtcgtcgtccgcgacgacgggcttcttctgattcgttgccgccgacctcgcattgccgtccatctcgtcaggacttcgactcgagtgcccggagaacaacgtcttctctcctgattctgaacggagtactgctgcgtgctgctgctgcctcgcccgagcagagctaccttgcgagtcgtcgcctccgtccgtccttggcgccttgcaagctgcaaacaggagcaggctcagggagcttttatgaggcagctctgtagcagcacggcatgagagcacacaagtcggagcgctcgtacactgggtcgccgcccccgctgtcccgtttacttcgctctctcgagaaaggagagaggcccggacgcgtgg

SEQ ID NO: 1139 - protein, 451 aa, Oryza sativa
  Orthologous to G789, G1494
MAICSTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQDKEFNVGFAQRVVFLEIAENIDMMNRLHPYCCYQQQEQQLGEPEDYVWEPYHHCKLPSSQQKPEGGDLEFMSKLVASIISC

SEQ ID NO: 1140 - protein, 447 aa, Oryza sativa
  Orthologous to G789, G1494
MDAGATARSSSSSAMMMNQKKPLLSDGELVELLWQDGGVVGHAQTRHRSSDVLARSGVTGEEETASAWFADGGGGGGGDDDALGLGMGRDIYSQLWHSFANVDGHAAGALALATPTPTPRAAARSDDVSSRLDEADLSICGSNAVVAPALPADDDDDIDAAAPREEEEEEEEGPGAARAAGASSSGGSGSGSGSYPLFKRGREELVDSLSEVADETRPSKRPAAKRRTRAAEVHNLSERRRRDRINEKLRALQELVPHCNKTDKASILDEAIEYLKSLQMQVQIMWMTTGIVPMMFPGTHQLMPPMGMGLNTACMPGAQAQGLNQMQRTTYYMNNSLPNQMPQIPSPAMNAPSVPDDMQNDNRIRGPRNPFLHCNDTLTATAQVDYYVKFHHYRSFRLQFLFILQYQFFSGARHRQYVKNIVAVWTQLEPASQKLHKNTTVTVSLFF

SEQ ID NO: 1141 - protein, 377 aa, Oryza sativa
  Orthologous to G789, G1494
MAVAAAAATTTRWAWAWAGTSTRRLWHSFANVDGHAAGALALATPTPTPRAAARSDDVSSRLDEADLSICGSNAVVAPALPADDDDDIDAAAPREEEEEEEEGPGAARAAGASSSGGSGSGSGSYPLFKRGREELVDSLSEVADETRPSKRPAAKRRTRAAEVHNLSERRRRDRINEKLRALQELVPHCNKTDKASILDEAIEYLKSLQMQVQIMWMTTGIVPMMFPGTHQLMPPMGMGLNTACMPGAQAQGLNQMQRTTYYMNNSLPNQMPQIPSPAMNAPSVPDDMQNDNRIRGPRNPFLHCNDTLTATAQVDYYVKFHHYRSFRLQFLFILQYQFFSGARHRQYVKNIVAVWTQLEPASQKLHKNTTVTVSLFF

SEQ ID NO: 1142 - DNA, 1850 bp, Glycine max
  Predicted polypeptide sequence is orthologous to G801
cctctattctccgtctctctactctcttattctcaacgtcaaacccaaaaccccttcttcttcttcttcttctctcgcgccgcaataataatactaaaacatgtccaactctgatggagccactaacgccgtccctcccaacgacgccaacaacaacacaatcgttgagtaccagcagcgaaccaccaccaccaccaccgccgccgccgccgccctcgccgtcaagaaaccgccttccaaggaccgccacagcaaggtcgacggccgcgggcgccgcattcgcatgccgatcatctgcgccgcccgcgtcttccagctcacgcgcgagctcggccacaagtccgacggccagaccatcgagtggctcctccgccaggcggaaccctccatcatcgccgctaccggctccggcaccactccggcgagcttctccactgtctccgaccacaagcccctcctccctccccctacccccttcatcctcggcaaacgcattcgccctgacgacgactccgccgccaaagacgacgccgtctcgctcgtcgccccccccacgccgcccgccctctgggccctacctccccgccccgacttcggccaggtctggagcttcgccgccgcgcccgaactcgtgtcggtgtcgccgcagaattcaatgtttcaccatcaccatcaacaccaccagcagcaacagcaacaggccgccatgggagaggcctctgccgcaaggctcgggaattacctccccggccacctcaatttgctcgcctcgttgtccggcggccacgggaattccggccggcgggacgacgagcctcgctgaatgaatcaatttctgaaattatgatggatttgattgtgatcttcttcgtatataaatatatgtattattgtgtgtgggtgggtgagtttgtattttgtctctgtgactttgttgttgtgtgtggactactgtggacaaggagaaggattgaagattcttagtgaaatttttagggttagttttttttttatttttaatttttggtagtatttcgagtggacaagtccatgaattaaggaattcaattggattattagggttttccttgtttggaaaactgattaggttacttgttaggagatgatgatgaatttgtttagaacattgctggaggagagacaacagagagtatgatgatgagatgaataaccagggattgaggcttggaagtgggtttcaggacctcgatccattgatcggtatgcagatgcagatgcaaatgcaaatgcagacgcagatgcaagtgtaatgaaatgaaaaattaatttaatgatgttattgtggaaaatatcacaccagagtccaaggcgaatgaattcaaggttaagcttcttcttgtttcttctgtctcgctttcactgtgggttttgatcaacttgacttactttctttcactttcctaatttgctcattaaaagtgattagtgttcatagtcttagtttgagtgattgtgtgtttgacaatcaagcgtcactcccattttcttggagtaaacttctttccaatgtttattgagaattcatgttattgcgcatcattgaaggattgtggtccttctaattatgcattctaccttgcttagttgctctctccttcactttcggggatgcctaacagcctgcttctgcaatgtaagacctctgtttctagatttttatctgaaattctcagccatttcttagattcgtcagcgtgacaataatgtcttttctagtatgtaactggatttccgtggggtgttagtgaagtgaataaagacccatctgctcatttctctctaaaaaaaaaaaaaaaaagggcggccgc

SEQ ID NO: 1143 - DNA, 421 bp, Glycine max
  Predicted polypeptide sequence is orthologous to G801
gggtcgagctctactctattgttatcagcgtcttttcacagaaccacatcgtcttcttatggtctcgcgccgtaataataagactaacacatgtccaactatgctggaaccgctaacgccgtccttgctaacgacgtcaacaacatcacaatcgttgagtaccagcagcgaaccaccaccaccaccaccgccgacgccgtcgccctcgccgtcaagaaaccgccttccaaggaccgtcacagcaaggtcgacggccgcgggcgccgcattcgcatgccgatcatctgcgccgcccgcgtcttccagctcacgcgcgagctcggccacaagtccgacggccagaccatcgagtggctcctccgacaggcggaaccctccatcatcgacgctaccggctccgggaccactccggcgagcttct

SEQ ID NO: 1144 - DNA, 1219 bp, Zea mays
  Predicted polypeptide sequence is orthologous to G801
gctgggggtgtggttttttttttacaaaaaaaaagaagccgcttttataaatggctccacaccggaggggccaaggactggcgcggccctatccctatccggctatccccatcggcttcctccccacaagtcgtgtccaccaccatcccccgcgcggcccgcgcgccccgagacagtgcgtggccatggcctctcgcgacggcgccaccttccaagtgtaccgggccatgcccgcgccgacgccgatgtctctggcgtccgccgctccagccgcagccgccgccgacgccgcggcgccgaagaaggcgggcgcgggcgcgggaaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccggcaggccgagccctcgatcctggcggccacggggtccggcaccacccccgccgtcttctcctgctcctccgcaccgtccacctccgcggccagcgccggtgccggcgccggcgccggtgtctccctcccgctcctcgggaagcgcccgcgcgaggagcacgagccggcggtggcggtggcagtggcgccggcgccgttctgggccaccctgcaggcgcggcccgtggcggcggcgtgggggctctcgccggcgcaggaggcggcggcgcaggcgtacgcgtcggtggcggcgcagggacaccacctcaacctgctctccgtgctctccggcgccgcgaggcagtcggaggaggagtcccggtgactgcctgcatgccgccgccgccgcactgttgctacgtaatcgcatgcgtcgacgcgtggtggcatgccgcgcgcatgcgtctcgtttccgtgcatctccggggggtgcgttgcgcgtgttttccctgtggttttgcggtgtgagaggaacgcggcgagctggacaaggaggatccagagcgcgagatcggatcggggttagcggctgtagatagcattcgtcaggttcgtgtttgtgataatgagctcgccgtagcgcgcgcggtggttatgtggtgtggttatgtatgcatgcatgcatgccgaattgtcaactgatctgaatcctaacactaaataatgcattgcacgtcccggtgtgtgcaattccgcaaaaaaaaaaaaaaaaagggcggccgc

SEQ ID NO: 1145 - DNA, 544 bp, Glycine max
  Predicted polypeptide sequence is orthologous to G849
aaacaagttaaggatgacagtaaaactctacttcaaactggaatttctcatcataacgagttggatgctttgggtttcaccctggagcctaattcttcacaaagcctaccgattgtatgtgcttcacattctcctcgtcctaaagctgacataactgagcctgtaataaggtatccctccagtccagctgtaattcatcagaggattcaaggcaactctgacatgttacctgagcatcaagtaaccagtttaggtagacattttgaaagtgaccatgattcagcaccttctcctgtcaatgtgtctgttgacaaaaatatgaaagattccaaagaactggttactgttcctgaaatggatgaggaactagctatggtacctgtacaccagaagccaaagcgatctgagatcgtccagcgtcgaatacgcaggcctttttctgtagatgaagtagaagcactggttcaagcagttgaaaaactaggaactggaaggtaagatttacattagacttggtttggcttgacaattatatttaatgggt

SEQ ID NO: 1146 - DNA, 464 bp, Glycine max
  Predicted polypeptide sequence is orthologous to G849
accgattgtatgtgcttcacattctcctcgtcctaaagctgacataactgagcctgtaataaggtatccctccagtccagctgtaattcatcagaggattcaaggcaactctgacatgttacctgagcatcaagtaaccagtttaggtagacattttgaaagtgaccatgattcagcaccttctcctgtcaatgtgtctgttgacaaaaatatgaaagattccaaagaactggttactgttcctgaaatggatgaggaactagctatggtacctgtacaccagaagccaaagcgatctgagatcgtccagcgtcgaatacgcaggcctttttctgtagatgaagtagaagcactggttcaagcagttgaaaaactaagaactggaaggataaatggaaaacactggtgcacacggcaagaatatcccctcagcataggaggggtgaacctgttccccaagaact

SEQ ID NO: 1147 - DNA, 2804 bp, Glycine max
  Predicted polypeptide sequence is orthologous to G849
  misc_feature (7)..(7): n is a, c, g, or t
  misc_feature (33)..(33): n is a, c, g, or t
aaaagcnggagctccaccgcggtggcggccgcnctagacccagcggccgcgaaaaaaaaaagaaaaaagaaaatgaaaacgaaaacttcacgttcctgaaagagagagagagagaaagttaaggacttaaatggtttgtttcagttcgtgaattccattagatctcttgcatttgtaaacagttttgcggggtttttgctttgtacgcaacaagttgtacttttttttcctgtgtcggaaaatgagtttcatcggaaacttcgttacttgatcgaagtttggttcatcggatcgagttcgaatgctgttttttcaggagtgacaaaagaatctggtgtatttatgcttctggttattggatgagctgtatatgttttaactatggtgttgaagaagagagtagatcatggatttgatggcttacgagttcctgttatacctaaagctcctagatctgcaagaaggaggattgctttcaaaaaagcagttgaagatggtcaagtttgtgctattgaactactggcatctttagctggtcagttgttgcaggagagtgaaggttctgcttccagcaatgcatctgaaggaaatcatcatcccccctttagccaaggtgtcattgagcaagatatacaagatggagttaaaccattaaagaaggaggaaattcatcagggaagttgtgtagagagtacttttaagaccgaggtagcctcacaaaaagtagtttcagacctctttcacataccaagactggacatgtttcagttaataatagttctgactgttgtgagaaagctgaagctgatgtgaagtctgaaattttcgaatgggataataaatttgggaattattctaatagattagtagaaacacgtgaaaaatttagggtgtccactcatggtaacataaagaatggatttaaatgggaacaggaggctggaagttcatgcattcggggatcaaatttagctgataagtgtagtttggaggatcacttagaattgtatgtatctcctgcactaattgactcgaaaagtaatattaaatctccatttcataggaaattttttcccagtgcttccttttccaggtatgggaatggcattaagttaggttttagagatgatgacgaaaactttttaaggtgcaaaaagttttgcacgaagccaaaggcttttaggtctccacgacgcattgcacaccgaagaatcaggaatttgatgtcttccaaatactggaagacagctccaaagttgaaggactctgaactttctagatctgatctaggagtacctcgttatcataagaggaagacttgttacggttttgaaagatctcagcacaatgccattgttaaaaagaggaaattcgttgaccgggtttcaggagtaacttctgatggaggattcagtagtgagagtgtgtccaattcaccacagaaagggatggatggagacaagcctagctcatctgcaaaattgcatgtacctaaggctaaggattctcatgtaaagtttagcataaagtcaataaggattccagagctttatattgaggttcctgaaacttcaactgttggttcactaaagaggactatcgtggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacaagcttctccaactgtttgtgttggtgatccttcttctcaatgtgaaacatcccagcctaccaggtccacagaaattcctgtcttagattcaggaattactgataccttgcacgactcacccttgctgacatatccgggcaacctaattgaaagtaaccatgagtctacttcttcacttgcggacactacacttgacaaactaacacctgattccagagcgatagttgttgttccagctaccacagaaacattagctgtggttcctgtgagtcagaaaaccaagcgctctgagtttgtacagcgtcgaaccaggagaccattctctgtgactgaggtagaagcacttgttcatgcagttgaggaactcggaactgggaggtggcgtgatgttaagttgcgagcttttgagaatgcagaccataggacttatgtagacttaaaggataaatggaaaacattagtgcacaccgcaacaatctcccctcaacaaaggaggggagagccagtacctcaggagctcttggacagggttttggctgctcatgctttctggtctcagcaccaagccaagcaacatggcaagcatcaagctggaccaggaaccttgaagattacagaagcctcagctgaaagaccttgtgtgtgttgaaggtgagaaggtgtccacttgtgatatgatgatggtgtagaaaggagtggtggtgttgacaggaaaagaggaagacaaaaacttgtacattttgatttgattcaatttcatgtaatattctcacaccaaattctttgccggccattaattgcatgcagggttggcatttgtaaatgatttgatgcaataagattgttctaacaggaacttatgatgttctttgatttttttttcttgatttcttttgcatttatgaatgtttgtagaaatgtaaaaagaacatagaacatgacgacccaaaggaaaaggtgaaaatgttcttgttattatctttcatttcatttatggaaattattgttcccacttgtttgatacttcacttcctgtttgctg

SEQ ID NO: 1148 - DNA, 2046 bp, Glycine max
  Predicted polypeptide sequence is orthologous to G849
  misc_feature (1566)..(1567): n is a, c, g, or t
gcggccgcccttttttttttttttttaaaagaaagtaaaatttcttatctcaactactttaagtatgccaatatgtgtattactattattcatttaatattatcatttagacttatacagcgattagctcttttttattcatggataagctctagctacactcattaacattattagctcctgtgggtccataattcaatttgcagataaacttctatcatcaacacgtgcatccacgtgcccctccactccagttacacaccgaaccttgactttggagtgaaaacctatgacgcaaattctctataggcatcaccttgttctaattttacatgatagataaagtgtgacattgtactaaaaatcaaagtgataaacacactttgtcataaatacaggaagaagaaaaaatgataaatgacacttttaacaaaggcacgtggtggtgtcaagtccttattaaaggagaaggcaaggttttgtagagtggtgcttgagctgttgcttagtctgctgctgggaccaatatgcgtgggcagttaggaccctgtccaaaagttcttggggaacaggctctcccctcctttgctgagctgatattcttgctgtgtgcaccagtgttttccatttatcctgcacttcaaatccacgtatgtccgatgctttgcattgtcaaatgcacgaagtttaacatcgcgccaccttccagttccaagtttctcaactgcttgaaccaatgcttccacttcagcaacagaaaagggcctacgaattcggcgtggtgcgatctcagttcgctttgacttctgatgcacaggtagtacagctagtgcctccatacccatttcaggaacagtaataagttcttttgaatctgtcaaatttttttcacctgatgtgttgattggagaaggtgctgaatcatgatcactttcaacaaggttacctgaactggttgcttgatgcttggctaacatgttagaaaagccctgaatcctctgatgaattacagcaggacttgaagggtaccctattaaaggctgaggcatatctgcactaggaatgtggagagaatctgttgtagcacatgcagatggtcggtttcgtgaacaattaggctccaaggcgaagcccaaagcatccaggtggttatcatgagaaattccagtctgaagtagagttttactgtcatctctaaccttctttccatggagaatcacacccacacgcaatccgcctccaagtacagcagtcactgcctccatcactgtcctcttcaaggacccaacggttgcagtttctggaatctcgataaaaagctcgggcactctaaatgatttgatcctaagcttcactggataaaagaaagacatctccatgtaagaacccctttgaagacctcgggccgatctcagagtacataaagaatcattccctcaatcttcccataccgtaagaatctctagatcgtaatgcagagtgtcccaaggatgatgttccatgatcttggctcattccagaagatgaacaagaaacactttggttcgtgtcattcttgggtgaatnngcgaagtgtcatcacttctgatatatccgttagagtttgcaccagagcggcagttaaaaagcttcctctttttgaaaggaatattcatctgagaactttggtgtttattgcagttcctcttgctgaggtaagttcgcttccaatctccatcattgttagaaagtgcataattctttgttttttcagcaactttctgaaagttagaagccattcttttacctatacaagtctttggcctaaaggacttggtttcagtatttatagggtgagtacacccagaagagttttcatcatcatctctactaactactggtacattgtcacgacttttggacaacaagctacagggaatcctatcattatacccagacaatttggcattgccacctaaactgatcaatgcaggaggatttacatccaaagggtcctcaaaattacacatgtcaatcccactaccaattggcacccggacgcgtggg

SEQ ID NO: 1149 - DNA, 519 bp, Glycine max
  Predicted polypeptide sequence is orthologous to G849
ggctcgaggttcattacacttgatagtaacatatttgctctgtataccttgtgaacagtaaagtttagcataaagtcaataaggattccagagctttatattgaggttcctgaaacttcaactgttggttcactaaagaggactatcgtggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacaagcttctccaactgtttgtgttggtgatccttcttctcaatgtgaaacatcccagcctaccaggtgagccaaattttacgacgatttctttttatcaccacagctgatttatgaagggaaatggccaaggttaatttatggggtagaaataatgattcagttctattcagccgaatttttattgtgatactattgctaatgtcattatttg

SEQ ID NO: 1150 - DNA, 730 bp, Glycine max
  Predicted polypeptide sequence is orthologous to G849
cggacgcgtgggcggacgcgtgggtggaacctttggatacatggctcctgaatacttcatgtatggcaaagtaaatgacaagattgatgtctatgcattcggtgtaatgcttattgagcttttttcatggagaaagcccatatgtggtgattatcccaaaggtcaagagagccttgtcatgtggtcaagtccaattctaaatagcggaaaggtgttagtcactaaagaggactatcgtggaggcagtgatggctatacttggaggtggtgcacatgttggtgttcttcttcaggggaaaaaagttatagatgacaatagaacacttgtgcagactggtatatcttgcaatgaaaatatggataccctgagtttcatgttggagcccacttcactacaagcttctccaactgtttgtgttggtgatccttcttctcaatgtgaaacatcccatcctaccaggtccacagaaatttctgtcttagattcatgaattactgataccttgcacgactcacccttgctgacatatccgggcaacctaatggaaaagaaagttgatcctacttcttcaattggggaaactacttttgaaattctaacaacctgattacagactgaagatgtggcttcagctaccacaaaaacataagctgggggtcctggggagtaaaaaaaaccaagcccttctgagttttttaaagcgtcaaaacctggaaaacaatttttttg

SEQ ID NO: 1151 - DNA, 588 bp, Zea mays
  Predicted polypeptide sequence is orthologous to G849
tgttcattaaggtcccagaaaatgcaaccattggatcactgaaggtaaacactagatgggcatacagaagttattgctaagcaatcgtgcattcatttggcatcccaatattctttttggtgatgttgttgttaatttactatacagtgtaattgatgaaatctgcaaggttgcaagagcgcacttgagttcatagatttatctttttcattccacagttggtacgctggattcagttgactgtcatgttagatttctgcatttgaggtttattgcaatgtggaataatgagtcttcacaatagttttactggtatacagagcaaataaataatttttttagtaacagtttgtagttcgtctatgcctacagagagctgttatggatgttgtcaatagtataatggaaggcggcctacgcgttggtgttcttcttcaaggaaaagatatccaagacgacaacaagacactttgtcaggctgggatatgccacgataaaaagctaaataacatagacttcacgctggagtgcgagcgtgagcgcgagcctccctctggagtcattgtacaagaacagatggatttcctc

SEQ ID NO: 1152 - DNA, 479 bp, Zea mays
  Predicted polypeptide sequence is orthologous to G849
aaaaaaaaggggggggggttggcaaaaccacacaaactaatggggttccttgggaccccccttttaacctggttttttataacccacagttttaacaaaagaacaagttttccttggaaaaaaaaatctaagaaaaaggaagagccgggggggggggtttgcccaaaaccctcccctggtgttggtgggggaaccagaaggcctgccctagaagaacccggtttaaaattttttggggaaccgggtgccctttcggtgggggggggaatatgctcgcagggaaaaccagggttttccatttgtccttggggccaacggaggcccggggatttatttgggcgagggcgagggtttaaaagggtttcccctttccagcccaaaggtggtggaccgttcccaccagcgcttaaacctcgcggaaggggaaggcgctcctaaggcgccttggcccggtttaaaacccttgggatttacaaggg

SEQ ID NO: 1153 - DNA, 2526 bp, Zea mays
  Predicted polypeptide sequence is orthologous to G849
ggatcctaaggcgaagtctgaggtccaggacaaggaatcctccatgatcagctatacgaaggctgaattgggttgtaattttggtgtgatcgcagacaggtggtcgcctgaatccgtggaatcaggagccttcacaggagatgcagtggcgagactgatgatgacggccccggcaggatttcataagaatgcacccgaaatgtatagtttgcttgattcaatggatgtggatgtcaagccgcctcctttggtcagctctgacagcaccggcgagatgccattgcatggcgataaaattcaccgctcaacctccttaccgaggggcccaaagggggtggggttttttgctgtagatagagatgatgacgacgacaagtcctcagggtgcactcatccgagcaccgccactaacaaggatttcacatccaattgtaaagctgagtataatagggtaaggaagctgctcactagtaagcacaggaaagttgctccagcgaggattcacaaatctgatctttcctatagtgatgtcgagcggaagccttctttccggtacaaaaaaatgcatacacgacagaggacacaaaggagtacattcaagcggaggaagctctttgatcgccatttagctctagcatctgaatttggtacagcaaatggaaagggaaacacaaaggttgccggaagaaactccaatgctgtgtctttggaagcaaacaaggggactaattcaatgccattccagaaatcttgtgggtcaaatgattgccatgtgaaacttagaattaagtcttttaacgtgcctgaacttcttgttgaaatcccagacagtgcaactgttggctcactaaagaaaactgttctcgaggcagtgactgcgattcttggaggtggcctacgtgttggtgttcttcaccatggaaagaaagtcagagatgatagtaaaacgttaattcaggctgggattggtcaggatgatatgctggacaaccttggcttttcacttgaacccaactgtactcaaaacccacaagtccaagctcctgaagatgtcagtttcctcgaaaacattgatactaccgaacccctcgcaaggatcacacctgctgactcgtcttctaagcttggtgaagttgacgtatcacaggagcttgcattaaccccattagcaatgaactaccagggcagtgatcatgattccgtgcactcccctggggctgtctcgtcgcgcgataaagactcgcgagccttatttctggttccagctgcagatcccaatgcaggagctgtagttccagcaaataagactaagaggtcaccagagcagggacaccgcagaatcaggcggccgttctctgttgctgaagtagaagcacttgtgctcgcagtcgaaaagcttggaaccggaaggtggcgagatgttaaacttcgcgcttttgacaatgcaaagcaccgtacctacgttgaccttaaggacaaatggaagacgctggtacacacagcgagcatctcgccgcagcagcggcgtggcgagccggtgcctcaggagctgctcgaccgggtcctggcggcccaggcctactggtcccagcagcaagccaagctccagccgaagacgccctcgctggctgaggctcgcttgctcacccaataattcgatgatcccggctgatggcctcctctgaggccgttgcagcctttgtataaagtcagtaagtcagtcagtcccttcacaggaggtttaatgaaaatataatattaggggaaaaaaagaatgcatatataaggtacaagaagcattgaccgatttgttgtaatatctactcaccaccggttattctttaagccaggattctctctccttgtgaatttaaccaaaggaaagggcatttctttggcaattgtacattttgatgatggaagaagaagatgatccatgaactgagatctgcagtgtctacctactaatggctcacaatttttgcaattgtgattaagaaattcaaggtgctgcttgaccaagctcggctccggcttccagtttttggattctcttgtgaagaagttgctgcctcttttttatacagcagaagctgagagccgaacagtgtatttggcttgaattgcagcctatatagtttcatccactcatacagacggccacaaatgccgtaaaaggagggtagcttcttttgctgagtctagtcttgggagcaaagctcaggaccgaagtctagacttgagacggagcgggggccaaagcggcacccgaatgaaagcttcagattcttttgttcagttaaattcattctttggtagtggagactgacggaaggataggagattaggtggggtggatctttggttctctttttctcttttcttcttctattattacattattagttgtattaatgtactatattattttaccaatcttgtagttaccctcaaatttgtaattggtgaaattaacaaaattgaaggagatacatttctaccacttcgctaaaaaaaaaaaaaaaa

SEQ ID NO: 1154 - DNA, 1528 bp, Glycine max
  Predicted polypeptide sequence is orthologous to G864
ccacgcgtccgggaatctctctctctctctctctttctttccctttttcactttctcattcattcttattagtatttctatttcacttcaccaacccactccaccgtttcccctttccttccatgctattatggcttcatcttccatcaaacacactcaccaccttaaccgcacaaaactcttcatgaaagaagaaacccttttgaaaaagaagcatcactatcccaaaatcatacgaatacgtgtcaccgacgccgacgctaccgactcctccagcgacgacgacgagccctccatgtcctccacgcgccgcagagtaaaaaacttcgtcaacgaaattaccatccaaggcggcggcggtggtggtggcgacgttaacgttgtttctaagaaaagaagattcaagtccggtgccggagctccgttatgtcggcggaagacgggggcgaaagaagttccgggggagtgaggcagcggccatgggggaagtgggcggcggagataagagacccgtcgcgccgcgtccggctgtgggctgggaacctacgacaccgccgaggaagctgccattgtgtacgacaacgcggccattcagctgcgtggcgccgacgcgctcaccaatttcataacgccgccgccggagaacagaaaaaccggttactgctccggcgaggagtctcgcaacaacgacgacttgcgttcccccacttcggttcttgggcgctgttcggtgtccgaggaagctgtaactgcaaacgacgtatttggaggctctagtgagtgcgagtattcatgcgtttcggagtcagtgtttcctattcctaacgaggtggtgtttgactttgaaagcacgttagatatgtttgatgaagggattaataatgttgtggcagagactagtatattcttggcggaggatttagatttgggttttacgagttggcatagagagtgtgataatttccaagacattgggggggatttgtttgtttgggatcctcttgtcgctctttgattgagacacagacaccattctctcgtctttgtaattctattgccaacgaaaatgggttgctatcagttttgtttcttttgggggtttaggcaaaaaccttgtgtctaaggagaggttttctaattttttattctagcagtatatgtttattaaccactagttgtaaaaccgtgcttcccacggtgttgccgtctttttgtttcttatataaaattatgtctcataaaaaaacccacgcgtccgtggttctatttgtttgatggccatcttgcacgtcctgatcttattgtgttcaagtgacagacaaatcagaacagggaagagagatttgaaatgtaaatgccaagtgaaagtgaaaagtacagtccagttttagtgatctctttaatttatttgttcatagattaatatgatggtgtatgattgcttttctatttattgtggcatttttgtgttgtaccctgttgttgtgtttgcaataagtattagtaataaagcagcaaattcaatttc

SEQ ID NO: 1155 - DNA, 587 bp, Glycine max
  Predicted polypeptide sequence is orthologous to G864
ctctctctcatcctttttccctttttcctctctcacccactccctcactccaccgttttccctactactcctttcaacgtcaatgctacccccaataatctaacaacatgactgcgccaccatccaagtacactcaccactccaaactactcattccctccgaagaagaccctcccaaacacccctatcccagactcgtcagaataaccgtcacagacaccgaggccacagactcctccagcgacgaagaacagcatacttccacgcgccaccgacacagaaagttcgtcaacgagatttctatcgagtcgtcgtgcgccagcgagaacgacggcgccgcttcgaggaagagaattcgaagaagaagcaccgctacgcccaaaggcagagcttcagacactcggctcgtgtccaacggcaagaaattccgcggagtgagacagcggccttggggaaaatgggcggcggagatacgagacccgtctcgacgcgttcggttatggttgggtacctacgacactgctgaggaagctgctttggtgtacgacaacgcggccattaggctgcgtggaccccacgcgctcaca

SEQ ID NO: 1156 - DNA, 1232 bp, Zea mays
  Predicted polypeptide sequence is orthologous to G864
ctcgtctgtctctccttgcctgtgcgcttcggttattagctagctagcttgggtctagtctagtgtaactcccggccgccatctttgctgtacttcgttcgtccatgtcgcgctcgcgcacggtgcggatcttctgggacgatcctgacctgaccgattcctccggcgacgacgagggctgcggagcccggagggtcggcagaatggtgagggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggaggccgtggggcaagttcgcggcggagatccgcgacccgtggcgcggcgtgcgcgtctggctcggcaccttcgacaccgcggaggaggccgcgcgcgtctacgacaccgccgccgtccagctccgcggggccaacgccaccaccaacttcgccgcgtccgccgccactaacagcggctccggggccggggccgggcaggacccggcgacgacaccggcagcgggctacgagtccggcgcggagtcgtcgccgacgtccgtgctccgcaaggtcccctccctgtcctccctcgccgaggacgactccgacgcgccggccgccgagcgccgcagcctggccgtcctcgaggaggaggagctgggcgagttcgtgccgttcgaggacgcgcccgtctacgccaccagcggcttctgggacttcgagcccgacgcggggttcctctacgccgagccgtcgtcgccggaggcgtcgtggaatgccgccgccgccgtcgccgagcccgcctcgtctgacgacgcgcccagctgggccgcgtcgccggtgcaggagaacgactacttccaggacctgcgcgacctcttcccgctcaaccggcttcccgcgattttctgaacaggtggacggggaacgccggaaccgggaacggcgccgctggttcgtctaccgggatgttattttggacgtcgagagtgcgctgtgtctgtgtctgtgtctgtgtcgtgcctacgcgcaccgtgtacttgtacgcctttccccacgccgtttttgttactatcttcgagtcgatgagaaatgtggaaatatgctgccgaacgatgagcacgtagagttttg

SEQ ID NO: 1157 - protein, 299 aa, Oryza sativa
  Orthologous to G864
MSRSRTVRIFWDDPDLTDSSGEDEGCGGRRVGSMVRELPPAQMPVAQAGFAPAAAAAAAALPEQCSGGDGDMGRRVVGGGCTVGVGRRRLTKDGGPGAPSTKFRGVRRRPWGKFAAEIRDPWRGVRVWLGTFDTAEEAARVYDNAAIQLRGPSATTNFSASTNSAGAQDPVAVGYESGAESSPAVSSPTSVLRKVPSLCSLAEDKDDYEAGPCEPATAAGSNLTVLEEEELGEFVPFEDAPVYGGSSFWDFEPESGFLYAEPSSPETPWDAGATSSGEAQDYFQDLRDLFPLNPLPAIF

SEQ ID NO: 1158 - protein, 373 aa, Oryza sativa
  Orthologous to G864
MEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 1159 - DNA, 471 bp, Glycine max
  Predicted polypeptide sequence is orthologous to G867, G1930
gtttgtacatcttttggtttggggcgaaagttcatccttttcatatatgcatcaatttcaacagataacaacgcgatctggtcagtcttctatgcttctgcatacactctagggtttccttttcctaactcgttcttctcttcaatatatgcgggtctatttgaaacgattgaggggggtagagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtatagtcgcggaaactcccctcgtcgaagtacaagggcgtggtgcctcagccccacggccgctggggtgcgcagatctacgagaagcaccagcgcgtgtggctggtaaccgttctctaggaagacgaggcggcactgtcgtacgacataccagcg

SEQ ID NO: 1160 - DNA, 1952 bp, Glycine max
  Predicted polypeptide sequence is orthologous to G867, G1930
attcggctcgccctcgacccgaatcggctcgacctctctttgctacctcttagtcaaacaaagtaacaaaccatcctcccctctcttctcttcttttgttctctagatttcttctctcttgtttcttagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggttttttttttctttttttttttcgggagtttttgtgactgatgaaagaaagaaggtacaagaacggcggtgtagtggcatggcaagttgctgcaaagtgcaaaaggtgaattgtatattacttaatattattagatgttgaaattaggtgtaatgtaacaaaaactgtacaagaagaagaaaaaaggttttaagaaggggagaagaaaaataaaaataaaagatatcatatgaaaactgtttaatggtatatgttgataatattgttgaatgtatgttcatggcatctgatgttgtttttttttctttttttagttgtgtgggggttgagggaagtaaacatgggtttccaaaaatatctttgttgattgttgaacgcgcacacaacaaacaatttttttggttggtgaattaaaagtagtatgatggttgaggaaactaattaattttcgtggtgtattttgggtaatcataatgaggcattttgtcaggttgtgagaattgctattataattagacaaatgttaccaagtgttttaaatatgttatttgtattttttataaaaaaaaaaaaaa

SEQ ID NO: 1161 - DNA, 1651 bp, Glycine max
  Predicted polypeptide sequence is orthologous to G867, G1930
attcggctcgggctcatctatctttgcttccccttagtcaaacaaagtaacacaccatccatcctctctctcttctcttcttctgttctctagtttcctgctcttgtttcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggctttcgtacgttcgccgcggctccgccggccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgtttagcgcgacggcgaacggcggcgaagggcgttttgttgaacttcgaaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttgagttttgtgactgatgaaagaaagaaggtacaagaagaacggcggtgtagtggcatagtggcatcgcaagttgctgcaaaaggtgaattgtatattacttaatattagatgctgaaatattaggtgtaatgtaacaaaaaactgtacaaggagaagaaaaaaggttctaagaaggggagaagctagaagaaaaaaaatgatgtcatcatgggataactgtttaattgtatatgttgataatattgttgaatgttgattattatgttcacggcaaaaaaaaaaaaaaaaaaaaaaaactcgagactagttcc

SEQ ID NO: 1162 - DNA, 1483 bp, Glycine max
  Predicted polypeptide sequence is orthologous to G867, G1930
ttgactcgtgggcggacgcgtgggctcaggttcctcctatatatatatatatatacatacataatatccttctccctcaaaccaaaccatacctattctcaagtttctctctgtttcttcctacttcatgctatagcacttacaatactcaacaataacctaaccaaaccaaaccaaaccaaaacccttatctgcactcacttcacacaaaccaaagttaattaattaccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtttttgagtttcttttgtgaattttgtaactgttgaattcatgaggtagagatggtgatggtgttgttgcaagttgccactcacaaaaggtgtatagtctcagacaaaaagaaaaaggaaaaattagggcaagaaaaattgttgaacagaaattttcttaacaaaaaaaaaaaaaaaag

SEQ ID NO: 1163 - DNA, 1443 bp, Glycine max
  Predicted polypeptide sequence is orthologous to G867, G1930
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgatgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaagggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 1164 - DNA, 425 bp, Glycine max
  Predicted polypeptide sequence is orthologous to G867
cgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtttttgagtttcttttgtgaaatttgtaactgttgaattcatgaggtagagatggtgatgtgggttaaaaaataaaaaaaaaaaaaagggcgg

SEQ ID NO: 1165 - DNA, 405 bp, Oryza sativa
  Predicted polypeptide sequence is orthologous to G867
gcggatgaggtgtgacgtcgaagcccgcacgcgcgtggccacatcgtcgaggtacaaggggtgtcccagccgaacggcgtggggggccagatctacgagcgccacgcgcgggtgtggctcgggacgttccccgacgaggaggcggcggcgcgggcctacgacgtggcggcagctccaggtaccgggggcgcgacgcggccaccaacttccccggggccgcggcgtcggcggccgagctcgcgttcctcgccgcagcactccaaggccgagatcgtcgacatgctgcggaagcacacctacgccgacgagctccgccagggcctccgccgcgccgctctagagatccaagcttacgtacgcgtgcatgcgacgtcatagctcttctatagtcacgtaatcatctgc

SEQ ID NO: 1166 - DNA, 381 bp, Oryza sativa
  Predicted polypeptide sequence is orthologous to G867, G1930
gcacgagggctcacctttcctcagcttagctagctagctgctcgatccggcggcgtgatcgagtcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggggccagcgcggtgatggacgcggccgagcctggcgccgaggcggactcgggcggcgagtgcaagggagtcctcctcaacttcgaggacgccgccgggaaggtgtggaaattccggtactcctactggaacagcagccagagctacgtgctcaccaaggggtggagccg

SEQ ID NO: 1167 - DNA, 441 bp, Zea mays
  Predicted polypeptide sequence is orthologous to G867, G1930
agccgcgcgcagcccacgccggcctgggcgcgcgtgctgctgttcgacaaggcggtcacgcccagcgacgtcggcaagctcaaccgcctcgtggtccccaagcagcacgccgagaagcacttcccgctgaagcgcgcgccgccgtcggtggaggcgcaggcgcccaccaccgccaagggcgtgctcctcaacttcgaggacggggagggcaaggtgtggcggttccgctactcctactggaacagcagccagagctacgtgctcaccaagggctggagccgcttcgtcagggagaagggcctccgagccggggacaccatcgtcttctcccactccacgtacggctcggagaagcagctcttcatcgactgcaagaagaccaagacgacgacgcccgccaccgacggggtaccggtaccattaccagcaccagcggagaaa

SEQ ID NO: 1168 - DNA, 576 bp, Zea mays
  Predicted polypeptide sequence is orthologous to G867, G1930
gccggccgggcctccatatcctacaacacttcccgcaacagttgcatacgccgtgcccatctatctatagctagcactaggagtggtgcacactgaaatggacagcgccagcagcctcgtggacgacaccagcagcggctgcggaggcggcgcgtccacggacaagctaagggctttgggcgtcttcgccgacgactcggtgacgccgctggagcgcatgggcagcggcgccagcgcggtcgtgaacgcgcccgaggcgggcgccgaggcggactccggctccggtgccgccgtggtgagcgtcgacgggaagctgccgtcgtccagggacaagggcgtggtgacgcaggccaacgggcggtggggcgcgcagatctacgagcgccaccagcgcgtgcggctcggcaccttcgcgctcgaggccgacgcggtgcgcgcctacgacgtcgcgaagcagcggatccgcggccgcgacgcggtcaccaacttccgcccgctcgcggacgccgacccgtacgcggcgacgagctccggttcctggtgtcccgctccaaaggcgaggtcgtcgacatgctc

SEQ ID NO: 1169 - DNA, 471 bp, Zea mays
  Predicted polypeptide sequence is orthologous to G867, G1930
cccacgcgtccgcccacgcgtccgcgcaagcgcaacagaagcatactacgccgctacgcgctgggcggtgccgcacagctatagatagctagcagtgttgcatagaaatggacagcgccagcagcctcgtggacgacaccagcggcagcggcggcggcgcgtgcacggacaagctaagggctttggccgccgccgccgcctccgcctcggggccaccgccggagcgcatgggcagcggagccagcgcggtcgtggacgcggccgagccgggcgccgaggcggactccggctccgccccggcctccgtcgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcgcgggcgaggccgacgcggcgcgcgcctacgacg

SEQ ID NO: 1170 - DNA, 497 bp, Zea mays
  Predicted polypeptide sequence is orthologous to G867, G1930
  misc_feature (221)..(221): n is a, c, g, or t
ctgcttttgttttctgtgcgtaccgctccaaggctcgaggttcgtggacatgctccgcatgcacacatacttatgcgagctcacgcacaacaagatgcgccttcggcggcgagacgctgtcaccagatggtctctggcctataacccttacttactacgcgtcaggtatacccggggaccgagatgggaagaaccgtcgccggcgcgggagacacctgttnagacacagaaagtcaccatcggcgacaaacgcaagcagaaccggctggtgatccccaagcaccacgccgagaagcacttacagctgcagatcccgtccgtcggcgatgagagcaatggcgcgctcctcaacctggaggacgaacagggcaaagtgtggcggctccactactcgcactggaacagcagacaaagctacctgctcaccaacggctggagccaatgggtaaaagagaatggccttcaacccggagacgtagtaggcttatagcgctccg

SEQ ID NO: 1171 - DNA, 604 bp, Glycine max
  Predicted polypeptide sequence is orthologous to G867, G1930
ggacaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaaaggcgttttgttgaacttcgaagacgttggagggaaagtggtggggtttcgctactcgtattggaacagtagccagagttacgtcttaaccaaagggtgggagccgttggttaaagaaaag

SEQ ID NO: 1172 - DNA, 772 bp, Mesembryanthemum crystallinum
  Predicted polypeptide sequence is orthologous to G867, G1930
  misc_feature (1)..(1): n is a, c, g, or t
  misc_feature (24)..(24): n is a, c, g, or t
  misc_feature (27)..(27): n is a, c, g, or t
naaaacatagttcagagtgatggnggncgcgtcgacctccccgcctcccctaggcggcagcttatgccggatggggagcgggacgagcgtgattatcgactccgagaacgggatcgaagccgagtcgagaaagctaccctcatccaaatacaagggagtggtcccacagcctaacggccggtggggtgctcaaatctacgagaaacaccagcgggtctggctcggtaccttcaatgaggaggatgaggctgcacggtcttatgatgtcgctgctcagcggttccggggccgagacgcggttactaacttcaagccgctgtcgtcggaggaggaggctggggcggccgagctccggttcttgaattcccggtcgaaggccgagattgttgatatgctgaggaagcatacttatcatgacgagctacaccagagccgccgtaacttgaagctgctgtttgaggctgatagggcggggtgcaatagtggtaataataagtccagcctggatattatgggttataatatccacactgtacggtgatcatgacccacccgcgaacagctttttgggaatagtcttacccccagtgctgtggtaaagcttacccgctggtgattccatactgtacgcctagaagtatttcttttttcaggccttattgtcctgctcctttcactttttgcttctcccttctaacacttttcctctccaaaggctcttctgtttattttatgcttccacgccatgcgtgttgtctctttctttctctgg

SEQ ID NO: 1173 - DNA, 681 bp, Lycopersicon esculentum
  Predicted polypeptide sequence is orthologous to G867, G1930
cttcctaattttccttttctcatcaaaaaagacaaaacaacacacacaccaaaaaaaaaatggaaggaagtattagtagcatagatcaagagagtactactagtgactctctctccattgctccggccgcgtcgtcatcgacgatgattaaatcgtcgacgacgataaaactgccgccggagagtggtctttgccggatggggagtggaacaagtgtgataattgatgctgaaaatggtgttgaagctgaatcaagaaaactcccatcttcaaggtacaaaggtgtggtcccacaaccaaatggtcgttggggcgcacaaatctatgaaaagcatcagagggtatggttaggcacattcaacgaggaaaatgaagccgctagggcttatgacatcgcggcccagagattcaggggccgcgacgctgtaactaatttcaaacccttgcttgagaatcaagaaagcgatgacatggaaatcgctttcttgaattcacattccaaggcggagatcgttgacatgttacgtaaacatacgtatatcgatgagttggaacaaagcaagagattgtttggatttactaaagacggtatgataaaaaggaaagatggactagtaattagttcgttctttggtagtaaaaatgataaagtcaattgcaaagcgcgtgaacagctatttg

SEQ ID NO: 1174 - DNA, 740 bp, Solanum tuberosum
  Predicted polypeptide sequence is orthologous to G867, G1930
cttcctaattttccttttctcatcaaacaaaacaacacacacacaaaacaaaaaaagtttcaaaaaatggaaggaagtattagtagcatagatcaagagagtactactagtgactctctctccattgctccggcggcatcgtcgtcaacgatgataaaattgtcgacgacgataaaaccgccgccggagagcggcctttgccggatggggagtggaacaagtgtgataattgatgctgaaaatggtgttgaagctgaatcaagaaaactcccatcttcaaggtacaaaggtgtggtcccacaaccaaatggccgttggggcgcacaaatctatgaaaagcatcaaagggtttggttaggcacattcaacgaggaaaatgaagccgctagggcttacgacgtcgcggcccagagattcaggggccgcgacgctgtaacaaatttcaaacccttgcttgagaatcaagaaagcgatgacatggaaatcgctttcttgaattcgcattccaaggcggagattgttgacatgctacgtaaacatacgtacctcgatgagctagaacaaagtaagagattatttggatttactaaagatggtatgataaaaagaaaagaatggacaataattaagttcgttttttggtagtacaaatgataaagtcaattgcaaagcgcgtgaacagctatttgaaaaagctgttacaccaagtgacgttggaaagctaataggcttgtgatacc

SEQ ID NO: 1175 - DNA, 785 bp, Hordeum vulgare
  Predicted polypeptide sequence is orthologous to G867, G1930
  misc_feature (556)..(556): n is a, c, g, or t
gacgccgcgcgcgcctacgacgtcgccgcgcagcgcttccgcggccgcgacgccgttaccaacttccgcccgctcgcggacgccgaccccgacgccgccgccgagctccgcttcctcgccgcgcgctccaaggccgaggtcgtcgacatgctccgcaagcacacctacttcgacgagctcgcccagagcaagcgcgccttcgccgcgtcggccgcgctctccgcgcccaccacctcgggcgacgccggcggcagcgcctcgccgccctccccggccggcgtgcgcgagcacctcttcgacaagaccgtcacgcccagcgacgtcggcaagctgaacaggctggtgataccgaagcagaacgccgagaagcacttcccgctgcagctcccggccggcggcggcgagagcaagggcctgctcctcaacttcgaggacgatgcgggcaatgtgtggcggttccactactcgtactggaacagcagccagagctacgtcctcaccaagggctggagcctcttcgtgaaggagaagggcctccgggccggagacgtcgtcngggttctaccgctcccccagccgggaggaccgtgaagacaggaagttcttcattgactgcaagctgggggcaaaacccaacacgtcggccaaacatagcccggggaaattggtgggggtcggtgcaaaaggcgagagaattttcgtgagtatctaatagatgacaaggtccaggggagcagggggagagatggagggagactgggctaaggagaggggggagtagagac

SEQ ID NO: 1176 - protein, 365 aa, Oryza sativa
  Orthologous to G867, G1930
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 1177 - protein, 317 aa, Oryza sativa
  Orthologous to G867, G1930
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 1178 - protein, 393 aa, Oryza sativa
  Orthologous to G867, G1930
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHAGDVVGFYRSAASAGDDGKLFIDCKLVRSTGAALASPADQPAPSPVKAVRLFGVDLLTAPAPVEQMAGCKRARDLAATTPPQAAAFKKQCIELALV

SEQ ID NO: 1179 - protein, 394 aa, Oryza sativa
  Orthologous to G867, G1930
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 1180 - protein, 415 aa, Oryza sativa
  Orthologous to G867, G1930
MEFTTSSRFSKEEEDEEQDEAGRREIPFMTATAEAAPAPTSSSSSPAHHAASASASASASGSSTPFRSDDGAGASGSGGGGGGGGEAEVVEKEHMFDKVVTPSDVGKLNRLVIPKQYAEKYFPLDAAANEKGLLLNFEDRAGKPWRFRYSYWNSSQSYVMTKGWSRFVKEKRLDAGDTVSFSRGIGDEAARHRLFIDWKRRADTRDPLRLPRGLPLPMPLTSHYAPWGIGGGGGFFVQPLAAGHALRAPPQARPRLPRLQPRRRDGEAGPPVRLGEDSSASTTAGARAVAAAPPLHAAAERRWCKGGGLTGGARLGSGHREPHDGREARAAVRREPRQPACRRRRRRRRRRVEQSWQCTVIADARVDEEGSNTAAAGIASSPPPWRRVVRCIVSVVVVFLQEGRAFGLGSRSVAT

SEQ ID NO: 1181 - protein, 420 aa, Oryza sativa
  Orthologous to G867, G1930
MEFATTSSRFSKEEEEEEEGEQEMEQEQDEEEEEAEASPREIPFMTSAAAAATASSSSPTSVSPSATASAAASTSASGSPFRSSDGAGASGSGGGGGGEDVEVIEKEHMFDKVVTPSDVGKLNRLVIPKQHAEKYFPLDSAANEKGLLLSFEDRTGKLWRFRYSYWNSSQSYVMTKGWSRFVKEKRLDAGDTVSFCRGAAEATRDRLFIDWKRRADVRDPHRFQRLPLPMTSPYGPWGAARGRSSCRPATLFEHHRFRQGFDFRNINPAVPARQLVFFGSPGTGIHQHPPLPPPPSPPPPPHQLHITVHHPSPVVTAGLPMVVDSVPHVNNPAAASKRVRLFGVNLDNPHPDGGQSSSGHDANALSLRMPGWQRPAPLRSLELPPHMPAGAAGAESSAASSPSSSSSSKREAHSSLDLDL

SEQ ID NO: 1182 - protein, 401 aa, Glycine max
  Orthologous to G867, G1930
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 1183 - protein, 351 aa, Glycine max
  Orthologous to G867, G1930
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 1184 - protein, 362 aa, Glycine max
  Orthologous to G867, G1930
MDGGSVTDETTTTSNSLSVPANLSPPPLSLDGSGATAVVYPDGCCVSGEAESRKLPSSKYKGVVPQPNGRWGAQIYEKHQRVWLGTFNEEDEAVRAYDIVAHRFRGRDAVTNFKPLAGADDAEAEFLSTHSKSEIVDMLRRHTYDNELQQSTRGGRRRRDAETASSGAFDAKAREQLVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 1185 - protein, 399 aa, Zea mays
  Orthologous to G867, G1930
MDSASSLVDDTSGSGGGACTDKLRALAAAAASASGPPPERMGSGASAVVDAAEPGAEADSGSAPASVAAVAAGVGGKLPSSRYKGVVPQPNGRWGAQIYERHLRVWLGTFTGEAEAARAYDVAAQRFRGRDAVTNFRPLAESDLDPDAAAELRFLASRSKAEVVDMLRKHTYGEELAQNRRAFAAAAASLASPQLPPAKNTSPAAAREHMFDKVLTPSDVGKLNRLVVPKQHAERFFPAAGAGSTQLCFQDRGGALWQFRYSYWGSSQSYVMTKGWSRFVRAARLAAGDTVTFSRSGGGRYFIEYRHCQRRRRDVDISFGDAATVPAWPRPIVIGTAAMNNGGATVASATIAGHDIEVAVAPSGARSFRLFGFNVECSGDDAPAPAPAPAEVEYVDGDT

SEQ ID NO: 1186 - protein, 392 aa, Zea mays
  Orthologous to G867, G1930
MDSASSLVDDTSSGGGGGACTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASAATASSLANNPPSYASLSPATATAAAAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVAAASTAGPSPPAPVAKAVRLFGVDLLTAPVTAAAPAEAVAVAGCKRARDLGSPPQAAFKKQLVELALV

SEQ ID NO: 1187 - DNA, 2493 bp, Glycine max
  Predicted polypeptide sequence is orthologous to G869
  misc_feature (1707)..(1707): n is a, c, g, or t
gtatttttaaaaatataaaattctcagtctggcgtgtttttatagagatttgcgttcgtttcactctctgtgtcaaggttggcttttttttttttctcttttctttttcttctggatttattgagcttgtttcacccaagtcacatgccagtgttttcgttagagcgataaaaactagtgttttgttgtacgggaagatacaatcttggccttagatttgtaatattttatctggggaactagaccagactgtttttgtttttgtttttgttttgttttttggttatatatatcagtttctttcacctgttgatgctcttttctctcctgcttgggcgagtgaagaggtgagagagcagataaaagcttgaggcttgatttctgcgtttcttggagaatttgtcttcaaaaaaagaaggggcagcagtggatttatgtcgtctgggtttattctggcagtgattggggctccgttgaagctcttcattgtttatgtttccgtttttttcttcctgactcgcttcgtgttctactgttgctgtatgctacactgcatcctgaaccacaatactgtgaacccatctgtttcaatgcgattgagaccaaaaaggacttgttgtggagtggagtgtttcggaggctttcacatacaaagattttcttatctcttcatattcttaagaggggatttcacctgataccttgagagattttgttaccctaccctttttttcttcgtttcttactttgagatttcctttctttgattccatttggtttcctttctgggtattctgaggggtttttggagggtttttctttctcattttttttccaccatgcccgagtctcggaaacaaccggcttctagaccgaagcaaaagcttcatcaccactccttgcaagagtccaaggcgatgagaaaacttcgcatcatttgcgacgatcctgatgctactgattcatccgaagatgagactgagaaggttcagagcccgagaagagttaaaagaaacgtgtctgagatctctcttccccctcttcctccaccattcaccaccactcctgaaaccagctcctgtgaggtgaatagcggcaaaaatgcaacattgaagggtttcattgaaggtcaaccccagagtaagaagagggttttgactcaccccccatcaacaaggaggaacacttctgggaaattcagaggtgttaggcagagaaaatggggtaaatgggctgcagagattcgtgacccctttcagagtactcgtatatggctcggcactttcaacactgcagaagaggcttcccaagcctacgaggccagaaggcttgagtttgaggctatggcagaggctcaagcttacaaaactagttctgtttctgaacctttggctacaatttctgataataagagtaactgctgtaactcttctgccgctgctatctccgccgctgccgtctccgccgctgcatgtgtctgtatctgagaagttttctactacttttgatgacttagaagagagtgtgttgtctcacaattcaccatcctctgtgctagagttggatacattggcttccaaatcccttgagaagggtaatgtttcaaccgaggaagctattgaggctaatgatttggtggctgaacttgcagggttagaggtaccagatgtcagtctgttaaacttgttaccaccaccatctgattcntggtggtgcagctgctgctgtttcatctgggattgagccaaactttgggcttgattttgattggctatcgtttaatgattatggacaaggttttgatgatttcggtggcttggaagatattcatattggtgggtttgatgacaatgagcctactgagcttcctgattttgattttggtgattttggtgctgatgagtttgctggttggattgaggagcccctgaatataccttgtgcctaaggttttgcagagctacgtaggaatatgaggctagatttctacaatattataagttttgttatttataagttagtctttctgtgagatctcaggaatgatgagttagtttttctgtgggatctcaggaatgatgagtgagtgaatggttactatatgcgttttacatttcatttgtttttgatggagttgttagttagagcagtgagatggtgagagaatcctttgggttttcccgtgctgttaaagagccgtccaagggaatctcgaaccatgatactatgtcgtaatttcaaggttcttcaatggcagagtattaatggaatgaaagttaatgttttgcatcgttttttctccagtctcatagcatatgaattggtcgtctcattgatatttgtctttttattcacgaatttgcccatgtgcgaagatcttttttgtattttcttcatatagtcatcaaaatctcttggctggttgatctgcctaattatcagaatggatcatggtcaccctttatcgattaagattctaaaattggataaaaa

SEQ ID NO: 1188 - DNA, 2337 bp, Glycine max
  Predicted polypeptide sequence is orthologous to G869
  misc_feature (122)..(122): n is a, c, g, or t
tcgaattcgctcgaggaaaaacagataaagcgacagggcagagaaaaagaggttcctatgcattcaccataacagtgaatacacatagggacaggagcaagcataaagtgaaggtcggctanaaaaaggtcttcgattctcgtggcataaacattaaacaaaagggtgctctatgtttttattaatgcaattggggttaattgttttatagagatttgcgcctgtttcaatccgtgtaccaaggtagccacttttttttcttttcttttgttttttctgttaacccagacacaggtgatagatcggtcataaaaaaatatattttgggacagaaaaatcttggccatagatttgtaatcttttcatctcaaaaaatttctcgtgctgttgtgtctctatatatactgtgtagctctatctctaacgttttctctctttttggtcagagggagagtggggtgtgtgtgtttttgttgggatttgtgaggaatccattgaaggaggaagagcgggagatttatgtcgtcttggttttatttggaagtagtgattggagctttgttgaagctcgggttcggttacgcttgtgtttgctgcatgctactctggctggtgttgaattctgctgtttcgatgagtttgaggtcaaaaaggacatgttatggaattctggtttgttatggaggctttcagataaaaaaattctctgctttcttcctcctttggagagtggatctcacttgatgttcttgaaattatgagggattttttttttggtttattaaaaaaaattattttgttttgctgaacaatttttctgggtattttgaggggttttgacccaattttttttaccatggcggagcctcttaatcaatcgactcctaggacgaaaaatatgttacacatgcgcaatccggttcttgtctcgctaatgacccggacactgcgcatcttttgccttgatcctgatcctactgactcttcatctgatgaggatgagtattttgggaatgttaggaagatgatcgagccgctcgagccgctcgagcggctcgaggttccggttaaccctgtggttgcagatgaaactagtactgagagcacaaacaatgatgaattgaaccagacgaagagggttatggcgaaaaccccctcagtgaagaggcaatcttgtgggaaatacaaaggtgttcggatgcggaaatggggcaaatgggccgcggagattcgtgaccctttcaagggcacgcgaatctggttgggcactttcagcactgcagaagaggcttctcaagcctatgagaccagaaggcttgagtttgaggtcatggccaaggctctatctgatgagaagagcaacaatggcagcagcaacaacaatgttgttgcttctgctgaaactgaaactgtggctgcccctgaaaataacagttcaaactattgtgtttcttctgctgcaggttctgtatcagactccaagtctgcttctatggatgaatcagagagtgtgttgtcactcacatcaccatcttctgtgcttgaattggatacatctgctttcaatttgattgggagtggtaaggtttcaagcaatgaagttgttgagactaaaggattggaggctgaagttgctgagactaaaaatttggcagctgaatttgccgagctggaaatgctggaaatgccggatttgagtatgctgaatgtgccatccccatctgctgtcgctgctactgctgctgctccatctgagtttgaattggatttgttggcatttgttgattccgagtatggatttcatgatgagcatgactttgatgatgatcttgctgccctggaagactttcacatttgcggtttcgatgacaatgagcctagcgagcttcccgattacgattttgacgactttggtgctgatgagtttgctggttggattgaagaacccctcaatataccttgcgtatagattttgcagcttcataggaatgagttctatccaagagactagtactactacaacattacaagttgtgtcattgcttaaaaatgctatagttttttgagatctcaggaaaaaactagttcctgggagagttgttttgtcaggtttgttttaatttatttgtttctttagggatggaagatcaatgagaggttaagagacaatgccttggtttttcttgtgctattagagccgtccaagggtttttcaatttctattatcgtgaaagttgagtgtgtagatgtctatcaaacttgaaatctactatctttatcagaaattctatggtatccttggaaaagtaccccgcagaaaaaaaaaaaaaaaaataa

SEQ ID NO: 1189 - DNA, 1855 bp, Oryza sativa
  Predicted polypeptide sequence is orthologous to G869
gtggatccccgggcaccaggcccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcagggacgggttcggggtcaagtattccgggttcctccacataaggccgtgtggtttctgtcgaggagattgacggattcgatcgattcgtgttcgtctccgtcaaatttttgcacaagagaaaaaaaaaagtttcccccttttagagtttttccccttcagttttgtcagttttggtgaggaattttagagttcttttccggcaagagttagaagaagagagaaatggccccttccaagcagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctaccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcaaaaaaaaaaaaaaaaaaaatgagaaaaagtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgatt

SEQ ID NO: 1190 - DNA, 2245 bp, Zea mays
  Predicted polypeptide sequence is orthologous to G869
cattgggtacctcgaggccggccgcccctttttgctcctctcgccgctttgggtcggggtttaagcgagtgttgagggaggccgtgacggaggcgacgacgacgacggacggacggacggtgccggcgtcggaagaacaagtagccagctctcgtatatgccttcttgccccatctccgatctggtcgtcgtagcgctcatcgcccccgtcgtcgccggcctcctcctcctcctcctccgctccctcgcctgctccagccgatctatgcgcaaggggctcaacggatggaacaaatcctcgtcgatgctcagggacgggttcggggtcaagtattccggattcctccacatacggccgtgcggtttctgtagaggagactgacggattcgtcctcaaggccgtgccgtttctgtagaggaggctgacggattcgaccgatttgcgctcgtctccgttatatttttgcacccagagttttttttgttttttttcttcagaagcttttccccgtagttttggctggagttctccccggcagaggagatacaagagacatggccccgttgaaccaccaccagcatgtcctcctcaagaaggccctggcgaagaaacccaaagctaagcggatgtccaggtttggccttaaaccctccgctgaagccctcctgaagtcccggccgcagcagccggcgcctgccccggcccagccgaggcgccgcgtccgggttctcttcgaggaccctgacgccacggactcggactccgacgacgaggaggccggcgcccctacgtgcccggcggaggccaagcgcttctccttcgaggcgttcgtcggcaaggtcccagccaagccggtccttccggcggccgctgtcgccgcgtgcaccagcggcggggcgccggagcgctaccgcggagtgaggctccgcaagtggggcaagtgggcggcggagatccgcaacccgttcaccggcaagaggcagtggcttggcaccttcgacaccgctggcgcggcctccgcggcctacctgtccgcctcccggagcttcgccgacgagaagcgccgccgccgcgggctgcccgtggccgcgtcctcaccagacactccggcaagcggcagcaccccgacggcttcctcctcgtcgtccgcctcgaccgctccattcgcgcacccgtcgccgtcgtccgtgcttgaaccgagcaaggaagcgcggaacacgcagtccccagaggcgacgcccgcccggccgtcgaccgactcagcgcagctgccggaggacccagagttctaccaggaccttctgcgcggcctgcagctgcccgacatcgacccgctggacttccgcgccgggctggacgctctggatctctccgatgcggacttcggcctggacgacgaacatgacctcctgctcggggacttcggggacgaggagatggagatcgacctcgacctcgacgacatcaacgacgtcttcccggagatgcccggctgcgacctcggccgcggcatggacgacttcctgcaaaccgttgatttctgcgtgtgaattgaaagggagtgtgcccttgatatgttagggttgtttggtttcataaacgagcccctgagagtgtgcttggaaaggggagatgagatatcttgggttttttccccgggcaagttggatctgctcgtgcccaggagatttcctctttgccgaacacaccaccattagcggccggagagaagaggtaattttggtaggttatattatgtttaaggtttaaggtatagtgcctaagtgtttgctttgttatttggtaattggtaatgcttgtcaaagacattgtagtggacaagttcattgagctgttactattaagcaatgaaagggaaaaaaataagtttcgtggtaaaaaaaaaaaaaaaaactcgagcccggggggctcatttaccccatcaggtaccacagagaaatcagtgatcactctagtgtatttacccatggccttagtgacaaagacgaaggggcagacggtcttgcagatgcaacacttgttgtcgcccatcacgaaacggaggcggacgatgcatgtggagcacacgtcgcggtgcccgcacgacccataggccacccactccagcgtatctgcgcacaccgcacaaaagtcttccatggctatctgcgcagctctaatctccgaagtccgaatatatcttcaaatctggtaagatagggatcgattctatctcgaacaggg

SEQ ID NO: 1191 - protein, 444 aa, Oryza sativa
  Orthologous to G869
MAPSKQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQDSHASAHLGRGTAQLEATLRRWSEIRIYTNPARVLTGSMLRVADQEYTTATIPLAIAAYGEDKTSKSQTCPYTTTAGDKSVLLREDPKLPRLTDQLPVDMVSSAPDFSTFS

SEQ ID NO: 1192 - DNA, 1262 bp, Oryza sativa
  Predicted polypeptide sequence is orthologous to G877
ttttttttttttttttttcttttttcaccatcagcacttccgatgaatgttttgcctttgtcctgaacactaccaccaccttttttttccaattacaacataaacaaaacgggtaacatcttctgcattcttggcttccaaaaaataaaagcccaaagaaaaaataacaggtaaaagctagaacaacaagagctatgttgtagcatgctaccatgtatagaagctgaagcacatctatcattttcttttctttctttaatattattatttacatctgaggtccaaatgatggaggcctgttcatcatctgttggaaggatgatgaagattggtttaccgcggggaagccgagctgcgacatgggctctgtcttcatctctccttccggaatcatgagcccctggtagccctgcatggtggatggatgaccagcatctttgctggagcaagagaccctagagatggcatgggaatcgccatgcctggcgggaccatcccaaaggggaaattgctcgccgatggtccaaatgtggtttcttggtgggagaacgaaggagctgaagggagccgcgccaccaaactggctgaagctggcttgcccttgttcttgcctgcgctgagagccgttagattgcggtgcagatggagcgtttccagatccagagctcccatgtccactatttctggcagctggaacttcatggttgtgcttcccctcgtacgtcgtgatgacggattttagatcatgcgatgctctctccacgtgcttgcgcaccgaacacccttggtgcgtacatttgtaatagctccttgggtttggatttcctttaacaaccttctgtccatacttgcgccagcggtaaccgtcatcaaggatgtcaacctcacttgttgtctgaacaacaacacgaggctcccggacacctctcgatgccgcagctcccatgtcaatgttactggtggtggtaatagcagcagttgcagctgtcaaagcatccagcttccttctcttggaatcagtctcatctccatccccgttgcactctatagaagccgtgccatgcgttgccctatcatcctcctcattagatagtgttgacgacacatcaactgcatcttgggactccatgatagatgtatcacaattggttgatactggaagacaagcagctgttcttgtttcaataacttcactttgaacatcttgaaggcaatcatttttggcattgtcccacaaggatgcagagttatggccctcgtgc

SEQ ID NO: 1193 - DNA, 1091 bp, Glycine max
  Predicted polypeptide sequence is orthologous to G881
gcacgagcttcaatattctatgttaatttacttgctattgtttgcttatcatcctttcaattaagttatatgtagttgtgcttgatggtcgttcaactcttcaacacagaaatcataatggatgaaaaggtggaaactattaaagctgagttaaaacgagtgagagaggagaacaacactctaagaatgatgcttgaagttctaagcagcaagtacacaaagcttgagacccatcttcaagaaataaacaagacacggcactagggcctgaggtcaaatcaaatagggtcagtaacagtaccacctatgtttcatacaaacaagagaccgagactagagcttcccacagcaaaaaagccattacaaatctttgtcagaacacaccccaaggatgatagtttgatagtaaaagatggctatcagtggaggaagtatgggcagaaggttaccaaagacaatgcttcaccaagagcttatttcaggtgctccatggctcccatgtgcccagtcaaaaagaaggtgcaaagatgcttacatgataagtcaatcgttgttgcaacttatgatggagagcacaaccatgcggccattcatgagtcatcttcatccacatctaaaggctcatcaccagtggttaataacttacctctgatgacaagcatattaaatgacaaagaacccatgaacattggcttggctctttcagggtggtctcaaacagatagaagacattgtgaagatgtcatgcaacagaataataacaatggtggtagcaacatcaaaattgaagaatatgtaagttctctaatcaaggatccagacttcaccatgtcattagctgaagcagttgcccgcaccatcactggccagcagaagcaacaagatctaaacctcaatttggagcttcctgaagagtgaaatcaatcatttttttcccacaaaagccataatgcaagtgtaaagatgaattttagttcagtgaattgtagtccagtagcactgaaaaagcgaggaaaacttctttagaatggtttactttaagaaaacattataggttgttttcgttttccgtttccactttaattgcaaaa

SEQ ID NO: 1194 - DNA, 467 bp, Oryza sativa
  Predicted polypeptide sequence is orthologous to G881
  misc_feature (121)..(121): n is a, c, g, or t
gtggatccccgggctgaggcttctctccttggctcagcttgacatcgtcggagcagcagaaaagtttgctcgatcgagctagctactaggtcgcggatcagtgataaatcgttcgccgatngatccgtggattagcacccagccttcgctgagcctggacctccgcgtcgggctgccggcgacggcggccgtcgccatggttaagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacg

SEQ ID NO: 1195 - DNA, 456 bp, Oryza sativa
  Predicted polypeptide sequence is orthologous to G881
gcacgaggggctgctgcagagccagttcagcgacatggtcaccgccgccggctacgccgaccgaagaccgagtgcacctccggcgagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtg

SEQ ID NO: 1196 - DNA, 388 bp, Zea mays
  Predicted polypeptide sequence is orthologous to G881
  misc_feature (52)..(52): n is a, c, g, or t
gtcggccgcagccaccgccgccgccgtcttccaccacgagccgggcgagccnccgccgggaggagtggatgtccggggtgtcccggcgatacgtccacgccgacccctctgacctcagcctcgcggtgaaggacgggtaccaatggcggaagtacgggcagaaggtgaccaaggacaacccctgcccgcgcgcctacttccggtgctccttcgcgccgtcgtgcccggtgaagaagaaggtgcagcgcagcgccgacgacaggaccatcctggtggccacgtacgagggcgaccacaaccacgcccagcctccgcggcacaacggcggcggcagcaaggccgcgacgaggtcgacgccagcggcgaccgaggccgcgcgaccggcgcc

SEQ ID NO: 1197 - DNA, 1136 bp, Zea mays
  Predicted polypeptide sequence is orthologous to G881
gtcggccgcagccaccgccgccgccgccttccaccacgagccgggcagccgcgtccgggaggagtgcaagtccaaggtgtcccgcccgtccgtccacgccgaccccgccgacctcagcctcgcggtcaaggacgggtaccagtggcgcaagtacgggcagaaggtcaccaaggacaacccctgcccgcgcgcctacttccgctgctccttcgccccggcctgcccggtcaacaagaacgtgcagcgcagcgccgacgaccccaccatcctggtcgccacgtacgagggcgaccataaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggcgattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaaattatttttccctagcactatgtttcatgagaatgagaccaggaatgaaccaacttgagtttgaaaatttccataggggagtaataataacagaggtatact

SEQ ID NO: 1198 - DNA, 994 bp, Zea mays
  Predicted polypeptide sequence is orthologous to G881
tagcgagtaccgtcgaattccgggcaccccccgcaggtcggctcgacctcagctcaaacatccctactctcctgctcctcttcttcctcctcctctcgctctcaagcgcgtcttcactccggcctagctcggacggatcgacatcgaggggaaagggaataagtgggggcgccagcagatggatccatggatcagcagccagccttctctgagccttgacctgcgcgtcggcctgccgccgctcagcctccaccaggcgccggtggccgtcgccttggccaggcccaaggtgctcgtcgaggagaacttcctgctgcctcccaagaaagaaccagaggtggcggcgctcgagacggagctgcggcggatgagcgaggagaaccgacgcctggcggaggcgctggccgcggtggcctccaagtacgaggcgctgcgcagccagcacaaggagatggtgtccgcggcgcccgccggcgggaacgcgtcgtccgcgtcggagggcgggtccgtgtcgccgtcgcggaagcgcaagagcgagagcgcggacacggcgccggcgcctgcgcagcgcccgcacccggcggcggacctgtcggagtgcacctccggcggcgagccgccgtgcaagcgcgtcgtgcgtgaccgggcggaggaggtggaggaggaggaggagtgcaggcccagggtgacgaagctgtacgtgcgcgccgacccggccgacctgagcctggcggtgagggacgggtaccagtggcgcaagtacgggcagaaggtgaccaaggacaacccctgcccgcgggcctacttccgctgctccttcgccccggcctgccccgtcaagaagaaggtgcagcgcagcgcccacgacgcctccgtcctcgtggccacgtacgagggcgaccacacccacgccccgcccccctcgggctcgggcaagaacgccgcgaagccgccgtcgccggcgcgccgccaggaggctgctgtcgcggtgacc

SEQ ID NO: 1199 - DNA, 838 bp, Zea mays
  Predicted polypeptide sequence is orthologous to G881
  misc_feature (827)..(827): n is a, c, g, or t
cctcgaggccggccgggaccgttcgatccgagtgtcctgcagagcccatcctgttcctgtccccctcgagcaatcgagctcagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgccccgccactggctgctgggggccacggacatcgtccctggctgacgggcaggacgaggccaagaccctggaggccaggctcacccaggtcagcgaggagaaccggcggctcaccgagatcatcgcctacatgtacgccagccaggtcgccgcgcggcggagtcccgacggcaggaagaggagcagggacagcctggagccgtcgaattcgggcgacgccaacgctgccgtcgagagcgccgccctcagcgacgagggcacgtgcaggcggatcaagctcaccagggtctgcaccaagatcgacccctccgacaccacgctcaccgtcaaagacggctaccagtggcgcaagtacggccagaaggtgacgcgcgacaacccgtccccgagagcctacttccgctgcgcatacgcaccatcctgccccgtcaagaagaaggtgcagaggagcgcggaggacagcgccatgctggtggccacgtacgagggcgagcacaaccacccgagcccgacgcgcgccggcgagctccccagcttcacctccatcaactcctccggcccggncatcacgctgg

SEQ ID NO: 1200 - protein, 396 aa, Oryza sativa
  Orthologous to G881
MAKMLPPPSQSVPSRPPSWLYIPPRRRHGTFTSSCAFRLSPSSPSSPPPPVLDFQYIQFMDSWIEQTSLSLDLNVGLPSTARRSSAPAAPIKVLVEENFLSFKKDHEVEALEAELRRASEENKKLTEMLRAVVAKYTELQGQVNDMMSAAAAAAVNAGNHQSSTSEGGSVSPSRKRIRSVDSLDDAAHHRKPSPPFVAAAAAAAYASPDQMECTSAAAAAAAKRVVREDCKPKVSKRFVHADPSDLSLVVKDGYQWRKYGQKVTKDNPCPRAYFRCSFAPACPVKKKVQRSADDNTVLVATYEGEHNHAQPPHHDAGSKTAAAAKHSQHQPPPSAAAAVVRQQQEQAAAAGPSTEVAARKNLAEQMAATLTRDPGFKAALVTALSGRILELSPTKN

SEQ ID NO: 1201 - protein, 335 aa, Oryza sativa
  Orthologous to G892
MSSTMPAQGGVRHHRTCRMYWCYQCGRAIRIISYPSTDVFCPRCFGRFLHEIDPPPRPAPPPPHFFPQPYHPHYDGHPRRWLIYGGEAPPVAAPGRAFRQPAPAVPGRAFRQPGPAPAPSPAPAPPRRRMPSPPPVARRPSTPPAIDPGNYFNGPNLNNLIEELTQNDRPGPAPAPSSAIDSLPTVQITGAHLSDGSQCPVCKEDFELGEAARQMPCKHVYHSDCIVPWLRLHNSCPVCRYQLLSSAAAGSNANSRARRGSANNGGGGGGGDGRDREQTIVRWGPFSWMWPPRGLEDPDDGWEYGRRGRPEAGDAGGRMCNDHGNFRKLVTMMDG

SEQ ID NO: 1202 - DNA, 579 bp, Mentha x piperita
  Predicted polypeptide sequence is orthologous to G896
aagttctcccgccacgagctgaagggatgcatcaacgacgctaagtgcatgaaatatcttctgatcaataagttccggtttccagaatcttcgatcctcatgcttactgaagaagaaactgatccgtacagaatcccaacaaagcataacatgcgaatggcgctcttttggctcttacagggatgccaagcgggagattctttggtgtttcattattctggccatggttctcgacaaaggaactacaatggagatgaagttgatggatatgatgagaccttgtgtccacttgattttgaaactcagggtatgattgttgatgatgaaattaatgcatctatagtccggcctgtacctcgtggtgctaagcttcatgccatcattgatgcttgtcatagtggaacagttcttgatttaccatatctctgcaggatgagcaggagcgggcaatatgtatgggaggaccatcgtccaccatctggtgtgtggaaaggatcaagcggtggggaatctattccttcagtggctgtgatgatgatcaaacttctgctgatacatctgctttatcaaaatcacttc

SEQ ID NO: 1203 - DNA, 632 bp, Glycine max
  Predicted polypeptide sequence is orthologous to G910
gcgataatttcatagcttttttcatgtttggaattgaagactaaggaaatggagaaggtttgtgaattctgcacagctttgaggccactcgtttactgtaaggctgatgcagcatatctttgtctttcctgtgatgcaaaggtgcatttagcaaatgcagtgtccggccggcacctccggaacctcgtgtgtaactcatgcggataccaccttgcttatgttctgtgtttggaacacaaaatgttgatatgtcgtgactgtgaccaaaagttgcacaacatttctttgccacataagaaacgagctatcagaagtttcatgggttgcccttctgctaaagactttgcagcactctggggggttgaattgaatgagattgaaaacagtgccactcaggatcagtttggttcagtttcttgtgtttctgcagatttgaatgttgcacaagtttcaggaaagcctggcattcaaactggggtcccttcaatgctatctggggccaaacttgatgggggaggatcaaccagtcaacaaggtcagatattgtatagtgatcaaaagcgtcaaacgattctgcagcagattattgattttaaatggcttcaacaaaatgaggagattgattattctgc

SEQ ID NO: 1204 - DNA, 1147 bp, Glycine max
  Predicted polypeptide sequence is orthologous to G912
tcgactcgagccgaatcggctcgagccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgaggacatgcatgagtggcttcagactatggctgctgaaccattaagatcacctacttttgtaacatatgttaatgttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatcaatacattatcaaagaccctccctgttagcaatcctccaaaaaaaagagagagaaaaaaaaaaaaaaaaaaaaaaaaaaaagg

SEQ ID NO: 1205 - DNA, 1014 bp, Glycine max
  Predicted polypeptide sequence is orthologous to G912
caacaacactctcaacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacgtatccagtgcctgagatggccgcacgtgcgcacgacgtcgccgcgctcgcgcttcggggcaagtcggcttgcctcaacttcgccgactcggcgtggcggctgcccttgccggcgtcgacaaatgcgaaggagatacggcgagtggcggcggcggctgctgtagcgattgcggcggaagacagctgcggcgagcagttacagaatagtattgtgaatgatgccgttgctgatgattgtgaagttagcagaagtgacgtcagctttgatgaagattccaatagcaacaaaggtttgagagttttttgtgatttggatgaaattacaatggcagatgcaccggtttttgaggacatgcgtgagtggcttcagagtatggcggatgagcctttaagatcgcctacttttgtaacatatgttaatgttagggatgtctggaactttgtggaggatgatgctgaggtatccttgtggagcttcacaatttagtgcgtttagtttgttctttgtcttctttcgtttttggtttttgtacataattaggaacggaggagtacgaaaatgtaccaagaccgagacgatataaggagctagctatatagggaggatcataaaactgtaagacattgcaaattttctcattcagttgtttttgtaattctcataatcatatagataaaggaaaggtttgtaaaataaaaaaaaaaaaaaaaaaaaagg

SEQ ID NO: 1206 - DNA, 1252 bp, Glycine max
  Predicted polypeptide sequence is orthologous to G912
ctcgacccactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtagaaatcgttctttggagagtctgcaggccaatgtgcataggctcaaaacagg

SEQ ID NO: 1207 - DNA, 1162 bp, Glycine max
  Predicted polypeptide sequence is orthologous to G912
ccctcattcactctcttttctccggcagcaccaaaaccacccaacacttgaaatcaatatccattgttaccaaaaaagaaaagatcaaaacaccctttacatcattatactcagttccctctttccctatcaaaaccctttcccacaacactactcactctagtagtacaagcaaaaccttctaactttggcttcagcggcacatatatatatatatatgaacatgtataccttgaaccactcttcatatttgtaccatgtttcccctgagctctcctcttccttggactcgtcctcgccggcttccgagggctctcgcggcgtggcattttccgacgaggaggtgcggctggcggtgaggcacccgaagaagcgggccgggcggaagaagttccgggagacgcgccacccggtgtaccggggcgtgaggaggaggaacacggataagtgggtaagtgaggtgagggagcccaacaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatacggaggaagaagagcaagtgttagatatgcctgagttgcttaggaatatggtgcttatgtccccaacacattgcatagggtatgagtatgaagatgctgacttggatgctcaagatgctgaggtgtccctatggagtttctcaatttaataacgtgcttttggtttggttttttatgttagttttggagtgtgactgtctgtactggttttttattagtagtacggatactagctataggtggcagattgaaagggaccaaaaggaattttcttttgaaaccctttttgtcaaagtaatcaatcgcgtatcatcaagtgaatcccttgatcaagtttatgtatgaattaaataaaagaagaatctagttttggtaaaaaaaaaaaaaaaagg

SEQ ID NO: 1208 - DNA, 800 bp, Glycine max
  Predicted polypeptide sequence is orthologous to G912
aattcggcaccaggttagttactactaactaccccttttgcacacgttgtctcattcactcaaacaacttcaaagaacgaagcttttcaccaagtaacatgttttccatcaatcatttctccgacccagatgccacctcgccggggtcgggaggaagctcccgaccggcgctgtcggacgaggatttttttctggcggcaagcaatcccaagaaacgcgccgggaggaagaagttccgggagacgcgccacccggtgtaccgcggcgtgagaaggcgggactccggcaagtgggtgtgcgaggtgcgcgagcccaacaagaagtccaggatttggctcgggacctttcccacggcggagatggcggcgcgtgcgcatgacgtggcggcgatcgcgctgaggggaaggtcagcctgcctcaacttcgccgactccgcgtctcggctcccggtgccggcgacggcggaggccagggacattcagaaggctgcggcggaggccgcagaggcgtttcgccctgggaaggatgatgatgcggtggcggagagggtggcagcgacggcgacggagcgtgaagaagaacaagaagaagggatggtgccggagtatctgaggaacatggtgctcatgtcgccgacgcattgcttcgggagtgatgagtatggaagtgctgacgtggaatttgacgatgctgaagtttctctgtggagttactccatttaatttaactcagttattggattttttttttactattttgagtaatgtaaagattgttcgtatgggacaagtagaatagtg

SEQ ID NO: 1209 - DNA, 974 bp, Glycine max
  Predicted polypeptide sequence is orthologous to G912
attcggctccggaaactccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgcccgaaatggccgcacgtgcgcacgacgttgcggcgctcgcgctcaggggaaagtccgcgtgcctcaacttcgcggactccaggtggcggctgacggtgccggcgaccaccaacgcggaggagatacggcgagcggcgggggaggctgctgaggcatttgcagttgcagatggggacgacgttaatattgaacaacagcagagtgtgatggccacgaatgatgatgaagttcaagagcctctccagcaggaggaggttcaagacttgcatgatttgcttttgagtattgcgaatgagcctttgatgtctcctccaccctgtgcaagagatggtagggactggaatgacgtggacatatttgatgatgatgaaatctcactatggaacttctcaatttgacgcgtacgtcattaagagtatgactgtatgcatgtttgatgataagcgaaaacacctttttgtgtatgtgattttctatatttttagggacctgttgtgtgtagataaattaagtagcactcgattgattaagttgagtggagttaaacatattgtagttgtatctatgatttgtttcgtgattaaattttaatgacaagtacagttggcaaattcaaaaaaaaa

SEQ ID NO: 1210 - DNA, 883 bp, Glycine max
  Predicted polypeptide sequence is orthologous to G912
attcggctcgagtgggatttttagtccattgaattggatatatttatcctcatacatgatcttaggagacatttgtttttggtaaccactcgtcccaagcctaaataagttaaaacacagaagaaaatgcagaagcggagggcagggaggaagaagttccacgagacacgacacccggtgtacaagggagtgaggcagaggaacgggaagtgggtaagcgagctgcgacaacctaacaacaaaaacgcgcgggtgtggctcggaacattcgcgcaccccgacatggctgctatagcgtacgatgttgccgccttggctttcaagggcgacagtgcttccttaaacttcccgaacgccgccacctcgtttccccgccttaactcgcggacgtgttccgttagggccattcagtttgcggcgacgcaggcggcggagaagcatttttcttgtgtagagtctcaacaactccaaagggagggatcaggctccggaagcttctctttggacgatgattcttcggagttttcgtcccaaggaaggttcttttgggatgaagaggaagtgtttaacatgccggagttgctgaactgcatggcggaagcgctgattatcacaccgccggcgttggaaagagggttcaattgggttggtggcgaaacgactgtggatttgactctgtggtgaaactgatgaccacttaggttctctgcaaaccagagaggaacttgcaatttcgatctgttgcaaaatattatatatactaatagtctaaagatgtagttcatcatatatactagtactgatacattcaaaagttatatagcgtttgctgtatggttgagattttcgtcaaaaacaagctgtatcataaatcttttctgtt

SEQ ID NO: 1211 - DNA, 1014 bp, Oryza sativa
  Predicted polypeptide sequence is orthologous to G912
tttttttttttttttaacgtaaatccaaaatccttaaaatcattgttgttcttgaccaaaatagctctttggagaggagaagtaaatttacaggaattcattgactgcacattcaaaatcagatggaatcacaaaaggagggagaaatctggcacattccaaaattacaaaaattgccattcatcctcagtctcattgcctactctgttctaaattcaccaatactctgttctcttttttcccccaatttctggagaatcaaaatttgtccacacttttcagtgcgagattttgattagtagctccagagcggcatgtcggagccggcgagctcgccgtcctcccaccacgctccggcggccggcggctcgacgagcagcccctgcgccaagctcgcgtagtacgacccggcgtccatcccgccgaacctgaacccgtcgtcgagctcgaacgcccccgcgtcgaacacctccgccgccgccaccggcaacacgtccttgttgtcttcttcttcgtcgccatcgttggcgaaggtctccgccggagacgacggcgcggccgactggcgctggaacgcctcgacggccacggcgacggcgtccctgacccccctcgcgccggcgagcgcggcggacgcggggacgggcggcatccgccacgcggagtcggcgaagttgaggcaggcggccctgccgcggagcgccagcgcggcggcgtcgtgcgcgcgcgccgccgcctcggcggtggcgaacgtgccgagccacagcctggagccgcgcgccccgggcacccgcacctcgcacacccacctccccgccgcgcccggccgccccccgcgccgccgcacgccgcggtacaccgggtgcctcgtctccctgaacttggtccttcccgccggcctcttcggcggctccgaccacaccgtcctgtacgccgcctcctccacctccatggatgactctctctggttcacttcgccggccagcctgaacctcgtgccgaattcctgcagcc

SEQ ID NO: 1212 - DNA, 430 bp, Oryza sativa
  Predicted polypeptide sequence is orthologous to G912, G913
gcacgagggacacactgccacagacacaatccatagcttagctcctctccactggagggatcgatcgatcgatggactgggcgtactccggcaacagctacggctacggctactactcgtcggggacgtcatcccctccggcgggcggcgaggacgcgtacatgacggtgtcgtcggcgccgcctaagcggcgcggggggcggaccaagttcaaggagacgaggcacccggtgtacaagggcgtgcgcagccggaaccccgggcggtgggtctgcgaggtccgggagccccacggcaggcagcgcatctggctcggcaccttcgagaccgccgagatggcggcgcgcgcgcacgacgtcgccgcgctggcgctgcggggtcgggccgcctgcctcaacttcgcggactccccgcgcaggctccgcgtccc

SEQ ID NO: 1213 - DNA, 976 bp, Zea mays
  Predicted polypeptide sequence is orthologous to G912
cacgcgtccgctcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggacgacttcctccgccatcagctggtcccggaggacgacgccctcgcggccacgccgtcgtcgccttccagcgaagacggcaacacctctgatggcggggagtcctcctctgattcctctccgcccaccggggcctcgccgttcgaatttgatgtgttcaacgacatgagctgggacctgcactacgcgagcttggcgcagggattgctcgtggagccaccgtccgcggtcacggcgttcatggacgaaggcttcgccgatgtgccgctctggagctactagagactgaaattttccgtttctttgcttggcctgtggcgcctaattttggcagtgtaaaacggttacttcttttggtaatgagatggaacaagtttgcgaaacatgaaaacagagcatgctaatcgacattttcgcgcggccgaaaaaaaaaaaaaaaaaaaaaaaaaaaaaaaaaaaaaaaag

SEQ ID NO: 1214 - DNA, 543 bp, Zea mays
  Predicted polypeptide sequence is orthologous to G912
gacccacgcgtccgcccacgcgtccgagcagcgaaggtagccacaacatccactcgactgactactcgagagctaagaaactgttcaacaggtgatccagaacaagatgtgtccaaccaagaaggagatgagtgccgagtcgtcgggctcggcgagcagctggacttcggcctcgacctcgacctcgccggagcaccagaccgtgtggacgtcgccgccgaagcggcccgcggggcggaccaagttccgcgagacgcggcaccccgtgttccgtggcgtccggcgccgcggcagcgccgggcggtgggtgtgcgaggtgcgcgtgcccgggaggcgcgggtgcaggctctggctcggcacgttcgacgccgccgaggccgccgcgcgcgcgcacgacgccgccatgctcgccatcgccggcgcgagcgcgtgcctcaacttcgccgactccgcgtggctgctcgcggtccccgcctcgtacgccagccttgccgaggtccgccgtgcggtcgccgaggccgtggaggactttcagcgccgcga

SEQ ID NO: 1215 - DNA, 1065 bp, Zea mays
  Predicted polypeptide sequence is orthologous to G912, G913
cgcgcgcgtcgccgcccgcctcatcagccatcgcgttccgcatcgaaccagcacatcgcaagacaagcagcagcagccaccactgccatcacatggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgaggccgccgcgcgcgcgcacgacgtggccgcgctggccctgcggggccgcgccgcgtgcctcaacttcgccgactcggcgcgcctgctccaggtcgaccccgccacgctcgccacccccgacgacatccgccgcgccgccatccagctcgccgacgccgcctcgcagcaggatgagactgccgccgttgccgctgacgtggtcgcgccctcgcaggcggacgacgtcgccgccgccgccgccgccgccgcggcggcggcgatgtacggcggcggcatggagttcgaccactcgtattgctacgacgacgggatggtgagcgggagcagcgactgctggcagagcggcggcggcggatggcatagcagcgtggacggcgacgacgacggcgccggcgacatgacgctctggagctactgagctgtagagtctgtctccagcgcaggaggttgggagaggagaccacgctctggagctactactggacagggaagaaagtgggggagccgggagcgagttcgaatttgaattcagaaactctgtactggcactggcacacgcggggaacgcgccacgcaagagcgagcgctatttccctccctttttgggtgctgggagaataataaaaagaccaacaatgaaggcattagtactaaaaaaaaatactatagcataaaaaaaaaagggcggccgctct

SEQ ID NO: 1216 - DNA, 994 bp, Zea mays
  Predicted polypeptide sequence is orthologous to G912
ccacgcgccccctcagctcaatcccgagacaaaggaacccacctccactcccaccagcaagctcaagcaagcagccaccaccagcagcgatcagcggcagccatggacatgggccggcaccagctccagctccagcacgcggcctcctcgtcctccacctcggcgtcgtcctcgtccgagcaggacaagccgctctgctgctctggtcccaagaagcgccccgcggggcgcaccaagttccgggagacgcggcacccggtgttccgcggcgtgcggcggcggggcgccgcggggcggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgcggcctgcctcaacttccccgactccgcgtggctgctcgccgtgccgcccccgcccgcgctctcgggcggcctggacggcgcccgccgggccgcgctcgaggccgtcgcggagttccagagacgccgcttcggggcggcagccgccgacgaagcgacctcgggcacgtctcctccctcctcctcctcctcggcgacgaagccggcgccggcgattgagcgcgtgcctgtggaggccagtgagacggtggcgttggacggcgccgtgttcgagcccgactggttcggggacatggacttggacttgtactatgccagcctcgcggaagggctgctcgtggagccgccgccgccgccaccgcccgccgcctgggatcatggtgactgctgcgactccggagctgacgtcgcgctctggagctactagcaagctatagcagcaataagctccaccaactcatctgtactgtagtgtacttgtaccttgtaccttgtaccaaaatccaaattgatttgtagcgaattaacttaccaatcccccttggcaactccaaaaaaaaaaaaaaaaaaaaaaaaag

SEQ ID NO: 1217 - DNA, 1002 bp, Zea mays
  Predicted polypeptide sequence is orthologous to G912
tcgcgatctagaactagtctcagctcaatcccgagacaaaggagccctcctccacctccactcccagcagcaagctcaagcaagcagccaccacaccaccagcagtgaacagcggcagccatggacatgggccggctccagctccagctccagcacgcggcctcctcgtcctccacctcggcgtcgtcctcgtcctcgtccgagcagaacaagctggcctggtccccgtcctccccgcagccgcccaagaagcgccccgcggggcgcaccaagttccgggagacgcggcacccggtgttccgcggcgtgcggcggcggggcgccgcgggccggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgccgcctgcctcaacttccccgactccgcgtggctgctcgccgtgccgcccccgcccgcgctctcgggcggcctggacggcgcccgccgggccgcgctcgaggccgtcgcggagttccagcgacgccgcttcggggcggtagccgccgacgaagcgacctcgggcacgtctcctccctcctcctcctcgtcgccgtcgggcacttatgtctcgcaggcgccggcgccggcgattgagcgcgtgcctgtggaggccagtgagacggcggcgttggacggcgccgtgttcgagcccgactggttccgggacatggacttggacttgtactatgccagcctcgcggaagggctgctcgtggagccgccgccaccgcccgccgcctgggatcatggtgactgctcccactccggagctgacgtcgcgctctggagctactagcaagctatagcagcaataagcttggcaatgccaccaactcatctgtactgtactgtacttgtaccctgtaccaaaatccaaattgatttccagcaaattaacttaccaatc

SEQ ID NO: 1218 - DNA, 768 bp, Brassica napus
  Predicted polypeptide sequence is orthologous to G912, G913
  misc_feature (664)..(664): n is a, c, g, or t
  misc_feature (667)..(667): n is a, c, g, or t
agacacttgagtaagtttaattatcagacagactttaagcttctttgtgtttcttactatgtcgaacactagcgattctccgaccacggggaataaacaaatgacgacgtttcctctagcttcagtcgcattgccttccaaaacttctgatcatcagtctcctcaatcctctccaggctcatcttcttccccatctccgacaccgagaccttctcactccgccggtggatcttccacgaagagaacgacgacgggattatccggccggcactcatttttcagggggattcggctacggaacggaaaatgggtgtcggagattcgagagccgcgtaaaacgacgcgaatttggctcgggacttatccggtaccggagatggctgccgccgcttacgacgttgcggcgctggctctgaaaggccccgacgccgttttgaattttcctggtttggctttgacgtatgtggctccggcttcgaactctgctgcggatataagagctgccgccgcgagagccgccgagacgaagcaaccggacccgggtggagtcgagaaggtaatggaaccgggtcaacccggaagggaggaggaggaaaaagcaatgctttcttcgttggagtttatggacgaggaagccatgttggatatgccgaatttgttgacnganatggcggaagggatgctgatgagcccacccagaatgataaatccgacgatggaggatgattcccggagaatcatgaaggagatagtctctggagttccaaa

SEQ ID NO: 1219 - DNA, 775 bp, Solanum tuberosum
  Predicted polypeptide sequence is orthologous to G912
tgggtttacactcccatcaaataattaagtcagtttttaataatattattatggatatctattattcagacccactcgctgaatcatcgtcatcatcaatatctgatactaatagcaatcagtactcccctaataataatttttctgatgaggaagttattaatttagcttcaaataacccgaagaagccagctggcaggaagaagtttcgagaaactcgacatccagtatacaggggagtcaggatgaggaattctggaaaatgggtttgtgaagttagagaaccaaataagaaatcaaggatttggcttggtactttccccacagtagaaatggcagctatagctcatgacgtggcagctttagcattaagaggccgttctgcttgcttgaatttcgctgattcggcttggaggttgcctattccggcttcctctaactccaaggatattcaaaaggcagccgctgaggctgcagaaatcttccgaccagagtcgaaaagaagtttcagggagaatgtagcactactcctgaaacgctagaaaacacgttttttatgaagggaggagagttagtttgttcatgggatgagggaagcgctcttttacatgccaggattaattgcgaacatggcagaaggactcatgctacctcctccccatgtttagagatcggagatcattatggtggaattagctgatgtgcacacttatatgtctttatggaattattctatataaataaggattatttagggagattttattagtttcct

SEQ ID NO: 1220 - DNA, 640 bp, Descurainia sophia
  Predicted polypeptide sequence is orthologous to G912
gtycgtcggagaaactccggtaagtgggtgtgtgaggttagagagccaaacaagaaatctaggatttggctcgggactttcccaaccgccgagatggcagctcgtgctcacgacgtcgccgccatagccctccgtggcagatccgcttgcctcaatttcgcagactcggcttggcggctccggattcccgagtcgacctgcgccaaggaaatccagaaggcggctgctgaagcgcgctggcttttcaagatgagatgtgtgatacgacgacggatcatggcttagatatggaggagacgatggtagaagccatcgtgacggcggaacacggcgatggattttatatggatgaagaggccatgtttgggatgccgaggttgttggctaatatggcggaagggatgcttttgccgccgccgtccgtacaatggagtyataattatgacgttgacggcgatgatgacgtgtcgctatggagttattaaaaattcgatattcatttccatttttggtacttttctttttttattcttagatcctttttcagaatggatcctttatcgttttggttgagattgagaaacgaatgtaaatgatccaatttgggtgtttttcaaatgcaagtgtgaccgtgtgcagt

SEQ ID NO: 1221 - protein, 236 aa, Oryza sativa
  Orthologous to G912
MEKNTTAMGQLMSSSATTAATATGPASPKRPAGRTKFQETRHPVFRGVRRRGRAGRWVCEVRVPGSRGDRLWVGTFDTAEEAARAHDAAMLALCGASASLNFADSAWLLHVPRAPVASGHDQLPDVQRAASEAVAEFQRRGSTAATATATSGDAASTAPPSSSPVLSPNDDNASSASTPAVAAALDHGDMFGGMRTDLYFASLAQGLLIEPPPPPTTAEGFCDDEGCGGAEMELWS

SEQ ID NO: 1222 - protein, 219 aa, Oryza sativa
  Orthologous to G912, G913
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 1223 - protein, 219 aa, Oryza sativa
  Orthologous to G912, G913
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 1224 - protein, 214 aa, Oryza sativa
  Orthologous to G912
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 1225 - protein, 214 aa, Brassica napus
  Orthologous to G912
MTSFSTFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 1226 - protein, 219 aa, nicotiana tabacum
  Orthologous to G912
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 1227 - protein, 218 aa, Oryza sativa
  Orthologous to G912
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 1228 - protein, 246 aa, Oryza sativa
  Orthologous to G912
MDMAGHEVNSSSSSSGAESSSSSSGRQQYKKRPAGRTKFRETRHPVYRGVRRRGGAGRWVCEVRVPGKRGARLWLGTYVTAEAAARAHDAAMIALRGGAGGGGAACLNFQDSAWLLAVPPAAPSDLAGVRRAATEAVAGFLQRNKTTNGASVAEAMDEATSGVSAPPPLANNAGSSETPGPSSIDGTADTAAGAALDMFELDFFGEMDYDTYYASLAEGLLMEPPPAATALWDNGDEGADIALWSY

SEQ ID NO: 1229 - protein, 214 aa, Oryza sativa
  Orthologous to G912
MEYYEQEEYATVTSAPPKRPAGRTKFRETRHPVYRGVRRRGPAGRWVCEVREPNKKSRIWLGTFATAEAAARAHAVVAGTRCGRGACLNFADSARLLRVDPATLATPDDIRRAAIELAESCPHDAAAAAASSSAAAVEAAAAAAPAMMMQYQDDMAATPSSYDYAYYGNMDFDQPSYYYDGMGGGGEYQSWQMDGDDDGGAGGYGGGDVTLWSY

SEQ ID NO: 1230 - protein, 238 aa, Oryza sativa
  Orthologous to G912
MCGIKQEMSGESSGSPCSSASAERQHQTVWTAPPKRPAGRTKFRETRHPVFRGVRRRGNAGRWVCEVRVPGRRGCRLWLGTFDTAEGAARAHDAAMLAINAGGGGGGGACCLNFADSAWLLAVPRSYRTLADVRHAVAEAVEDFFRRRLADDALSATSSSSTTPSTPRTDDDEESAATDGDESSSPASDLAFELDVLSDMGWDLYYASLAQGMLMEPPSAALGDDGDAILADVPLWSY

SEQ ID NO: 1231 - protein, 253 aa, Oryza sativa
  Orthologous to G912
MEKNTAASGQLMTSSAEATPSSPKRPAGRTKFQETRHLVFRGVRWRGCAGRWVCKVRVPGSRGDRFWIGTSDTAEETARTHDAAMLALCGASASLNFADSAWLLHVPRAPVVSGLRPPAARCATRCLQGHRRVPAPGRGSTATATATSGDAASTAPPSAPVLSAKQCEFIFLSSLDCWMLMSKLISSSRAKGSLCLRKNPISFCMVTNSYTALLLEYIILQMNSMIVLIHELSKYQVFLLLTMITHHLFQWRR

SEQ ID NO: 1232 - protein, 224 aa, Oryza sativa
  Orthologous to G912
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMACDPAVGGGEDDNDGEVQLWSY

SEQ ID NO: 1233 - protein, 199 aa, Oryza sativa
  Orthologous to G912
MDRDESLGTQPLTGRRVRADTRHPVYRGIRLRSGKWVSEIREPGKSSRIWLGTYPTPEMAAAAYDAAALALRGADAALNFPGTATSRPAPASGSPDDIRAAAAAAAAMIGSGHRGNQRAADASTSRAAPAPEVAVAAGAGDQKRVVDEDDVFEMPRLLVSMAEGLMMNPPRLSPSTDGVGGVSPEDDEDEDGMSLWNHS

SEQ ID NO: 1234 - protein, 217 aa, Oryza sativa
  Orthologous to G912
MDDSHDLASPTSPDTASSSSSSTSTSSSSATVAPKKRPRNDGRHPTYRGVRMRSWGKWVSEIREPRKKSRIWLGTFATAEMAARAHDVAALAIKGRTAHLNFPDLAHLLPRPATAAPKDVQAAALLAAAAADFPSVSVDANAKSPDTCSVASAASPQPPPPDAEADPDSTLFDLPDLLLDLRYETSSSLSCGASWAVDDDVAGGVVFRLEEPMLWDY

SEQ ID NO: 1235 - protein, 251 aa, Oryza sativa
  Orthologous to G912
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 1236 - protein, 191 aa, Oryza sativa
  Orthologous to G912
MEKNTAATSQLMTSSVTATPSSSKRPAARTKFQETRHPVFRGGVRRRGCAGRWVCEVRVPASRAAARGERLWVGTFDTVKETARAHDAAMLALCGASASLDFANSAWLLHVPLAPVVSTPDSDHQLPDVQRAASKAIAEGVRTATATATSGDAASTAPPWLHRHPFCVSQTMQIHLCFSTRLLDVNVKAYQ

SEQ ID NO: 1237 - protein, 185 aa, Glycine max
  Orthologous to G912
MQKRRAGRKKFHETRHPVYKGVRQRNGKWVSELRQPNNKNARVWLGTFAHPDMAAIAYDVAALAFKGDSASLNFPNAATSFPRLNSRTCSVRAIQFAATQAAEKHFSCVESQQLQREGSGSGSFSLDDDSSEFSSQGRFFWDEEEVFNMPELLNCMAEALIITPPALERGFNWVGGETTVDLTLW

SEQ ID NO: 1238 - protein, 226 aa, Glycine max
  Orthologous to G912
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIEQQQSVMATNDDEVQEPLQQEEVQDLHDLLLSIANEPLMSPPPCARDGRDWNDVDIFDDDEISLWNFSI

SEQ ID NO: 1239 - protein, 207 aa, Glycine max
  Orthologous to G912
MFSINHFSDPDATSPGSGGSSRPALSDEDFFLAASNPKKRAGRKKFRETRHPVYRGVRRRDSGKWVCEVREPNKKSRIWLGTFPTAEMAARAHDVAAIALRGRSACLNFADSASRLPVPATAEARDIQKAAAEAAEAFRPGKDDDAVAERVAATATEREEEQEEGMVPEYLRNMVLMSPTHCFGSDEYGSADVEFDDAEVSLWSYSI

SEQ ID NO: 1240 - protein, 255 aa, Glycine max
  Orthologous to G912
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 1241 - protein, 254 aa, Glycine max
  Orthologous to G912
MNILGQSFNESNNGSYSCSSPETGSSSNIPNTFHSDEEVHTLASARPKKRAGRRIFKETRHPVYRGVRRRNNNKWVCEVRVPNDKSTRIWLGTYPVPEMAARAHDVAALALRGKSACLNFADSAWRLPLPASTNAKEIRRVAAAAAVAIAAEDSCGEQLQNSIVNDAVADDCEVSRSDVSFDEDSNSNKGLRVFCDLDEITMADAPVFEDMREWLQSMADEPLRSPTFVTYVNVRDVWNFVEDDAEVSLWSFTI

SEQ ID NO: 1242 - protein, 234 aa, Glycine max
  Orthologous to G912
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 1243 - protein, 233 aa, Glycine max
  Orthologous to G912
MNMYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYTEEEEQVLDMPELLRNMVLMSPTHCIGYEYEDADLDAQDAEVSLWSFSI

SEQ ID NO: 1244 - protein, 246 aa, Zea mays
  Orthologous to G912
MDMGRHQLQLQHAASSSSTSASSSSEQDKPLCCSGPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAAAADEATSGTSPPSSSSSATKPAPAIERVPVEASETVALDGAVFEPDWFGDMDLDLYYASLAEGLLVEPPPPPPPAAWDHGDCCDSGADVALWSY

SEQ ID NO: 1245 - protein, 231 aa, Zea mays
  Orthologous to G912
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVAAAAAAAAAAAMYGGGMEFDHSYCYDDGMVSGSSDCWQSGGGGWHSSVDGDDDGAGDMTLWSY

SEQ ID NO: 1246 - protein, 231 aa, Zea mays
  Orthologous to G912
MCPTKKGMTGEPSSPCSSASASTLPEHHQTVWTSPPKRPAGRTKFRETRHPVFRGVRRRGSAGRWVCEVRVPGRRGCRLWLGTFDTAEAAARAHDAAMLALAGAGACCLNFADSAWLLAVPASCASLAEVRHAVADAVDDFLRHQLVPEDDALAATPSSPSSEDGNTSDGGESSSDSSPPTGASPFEFDVFNDMSWDLHYASLAQGLLVEPPSAVTAFMDEGFADVPLWSY

SEQ ID NO: 1247 - protein, 256 aa, Zea mays
  Orthologous to G912
MDMGRLQLQLQHAASSSSTSASSSSSSEQNKLAWSPSSPQPPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAVAADEATSGTSPPSSSSSPSGTYVSQAPAPAIERVPVEASETAALDGAVFEPDWFRDMDLDLYYASLAEGLLVEPPPPPAAWDHGDCSHSGADVALWSY

SEQ ID NO: 1248 - protein, 145 aa, Zea mays
  Orthologous to G912
MCPTKKEMSAESSGSASSWTSASTSTSPEHQTVWTSPPKRPAGRTKFRETRHPVFRGVRRRGSAGRWVCEVRVPGRRGCRLWLGTFDAAEAAARAHDAAMLAIAGASACLNFADSAWLLAVPASYASLAEVRRAVAEAVEDFQRR

SEQ ID NO: 1249 - DNA, 2032 bp, Glycine max
  Predicted polypeptide sequence is orthologous to G922
aaacaaaaacacattatattatgtaatctactaggtacaagttagggtacaggagctcataattcataaaaaataaaatgatcagctgcaaaaaatgaaaccataaacagaaccccgattgagacttctacttcttccgtccttctaccctttttttgtcttcccaaatttcttacttgatggagttttaccaggcaatgaataaagagtatctctaaaaaactatcttgaagaacagtcattaccataagaataaaacactcatacaaataaaaagaaagaaagaaaagaaaagaaaaaacatcaatatatccctctaattctcttacttcctagatctccaagctgatattgaatacattggccgatcctcccagcaaattaacacacaaccattttcatccctcattctgtatccttcacaaccatagctctgcaggaacctccttgcttgcaccataccaaagtagctcaaaggcacgttgccaaacccagctagatcaaatctctggaaccacttttccagcttttcatgtctttcctttcgttcagatccctcacatgcaatgatgttctttatttcctccccaaaaagcatcttctccacccttaatctctccaatgatgttcttgagacagtggattccaaacaatcaaacaatgctgcataagagtatagagcttcaagaagcctatccatcagagttggaccattgtgattacagtcttgttctgtcacaaccatgacctttggtgataatccccacaaggcattaagaaagcgccccctgggccttgaattggaagtagttaaagatgatggagatgatgaggttgagtcaggacttggagtgtacccattaaccatatctttctcaagcaaatcacccaatgtgctttggcccattggcagaactctttgcaggtgaattccatttgagctttttaacagaagaggagactttctctgcatggcttcatcatcccaggccaaaagggtatgcaattggagaatggaacttattgctagtgcctccccagttttcacccgaagtttgtcaaaatcaagattttctaatttgcttgccacagggttgaattggaacggtatatccaacttttctgcttcttcagttagtctatgagccacctcatccagaatctcctttttctgatgaaccccggtgattctcaaatgaggagggccttcgggatgcgcacttaatactcgaaggagagcaatccactgagcagcttcagcagcattgagatcaattatgtgaatcactttctccccttccattgcttcaatgatggcctgatttgtgagaacaaatgctaccttcaagaaagggaaaagctcaaagaaaagcttctgaaccagaatttcgtcggatatcaaagtcattctggttgagttgagggctctgtggatcccaggccatgttttaagaatccgatcagcaagcgactccataaaatatgttgcgattcgctgcatagtgtccccatcaggggaagcaagcatggaaatttgctcaagtgtggtgtttgcattttcaaggttaccagcagctacatggtttgcacaagtgagcaacaaatggatcaagtacaaacccctttcctcggatttcatttccctaaacaagagattgttgggagaacctaagctaggtgaaagtgacatcatggagaagaactgcaggggtgaagaatttacagaagacgacccttcaaaaccaggtcagcaacagaagtaggcattgcaagttgcaagttgcaacgaggaaacgcttgcttatcccttggtgggttttcaaattgaagaataatccagacgaagcccccagaaaattccaaaacttgccacttggagcactgaaaaaatcagaaccaaaatggggttggttgtgcagcttcaatgggaatgagtttcaatgtttggacccttgttcttctggtttcagcgacttgttcatgactacgttgtccacaatgcgtgaagggtcccttttgtctttattgtttc

SEQ ID NO: 1250 - DNA, 1563 bp, Glycine max
  Predicted polypeptide sequence is orthologous to G922
gaattcggctcgaggttatcttctgtaacttcttcacctcttcagttcttttccatgatgtctctgtcagtttcacctagcttaggatctccctaccatatgaaatgcgagcttaggggtttggtattaatccatttgttgctcgctggtgctaattttgtagccaccggtgatttacaatatgcatacctcacacttgagcagatttcccagcatgcctctcttgatggggatactatgcagcgaattgcttcttatgtttctgaagcactcgctgatcggatacttaaaacatggcctggcatccacagggccctcaattccagcagaataactatggtttctgatgaaattcttgttcaaaagctcttctttgagcttttacccttcctcaagttctcatatatcctcactaatcaggctattgttgaagccatggaaggggagaaaatggtgcatatagttgatctctatggggccggaccggcacagtggatttctctcctccaagttttgagtgcacgtcctgaaggtcctccccatttgagaatcaccggggtccatcacaagaaagaggttctggatcagatggctcataaactcactgaagaggcggaaaagttggatatcccattccaattcaaccctgtgctaagcaagttggaaaatcttgatttcaacaaacttcgcgttaaaactggggaggcactggcaataagttctattatgcagttgcactcccttttggccttggatgaagatgcctcgcggagaaaatcgcctcttttgtcaaaaaactcaaatgcaattcacctgcagaaaggcctcctcatgaaccataacacactgggagatttgcttgacggctatagcccgagtcctgattcggcctcatcctcaccagcagcgtcttcatctgctttgatgaattcggagagctttcttaatgccttgtgggggttatccccaaaagtcatggttgtaactgaacaagactttaaccacaactgtttgaccatgatggagagactggcagaagctctattttcttatgctgcatattttgattgcttggagtccacggtctcaagagcatccatggacagattaaaacttgagaagatgctttttggcgaggagataaagaacatcatagcttgtgaaggatgtgaaagaaaagaaaggcacgaaaagatggataggtggatccagagacttgacttatctggatttgcaaacgtgcctataagctattatgggatgctgcagggaaggaggttcttgcagacctatggttgtgaggggtacaagatgagggaggaatgtggtcgggtgatgatatgctggcaggagcgatccttgttttccataacagcttggagaccaaggaagtaagataaagaagaaaattagtcatgtagtaatggatagagtctctttttttaagtttttcttttcttttctttgtttctaattgtatgacagagttttaccaatgtggtaatgactagtaatgaagagatacttctatttccttaaaaaaaaaaaaaaaagggcggccgc

SEQ ID NO: 1251 - DNA, 1574 bp, Glycine max
  Predicted polypeptide sequence is orthologous to G922
gaattcggctcgagaaaacaatggtctgtcactccagcagacaagtaaacaatcattctcttctcgaaatttgtatttattactatatctctgcaacagattctttgcttctaacctcccattgtagctcaaaggtaccttttcaaaaccagccatttcaagtcttcgaatccatttctcgagtttctcatgtctctcctttctatcaacaccctcacaagcaatgatgttctttatctgctctccaagaagcttgctctcaagtttttgcctctctactgatgttttcataacagtagagtccaagcagtcaaacaatgcactgtaaaagtacaatgctctatcaactctctccatcaaattggaaccattcagatttgattcttgttcagtaatcactactagttttggttgaagttttctaatagcattgagaaagatccccatcttaggtgaggcacccaaggaaagcggtgacaaagcagaatcaggactcaaggtatatgcattgatcatatctctctcaagccactctgcaaaagtcctttgacccatatgcagtgctctctgcacattcatagatgctgccgcagccggtgagatcctccccgccatgtcatcatcagtggcaagaagagaatgcagctgaagaacagaactgattgcaagagcatctcctatcttcacaggcaacttctcaaagtcaacatcttccagtttgctaacaactggatagaactgcaaaggaaaatccaatttccctgcttcagttgtcaaatgaaagttcatttggtctaatacctctttcttctcgtgaatgcctgtaattttcagatggggtggacctccctgacggtttttgaaagttagtagaagatctatccattgagttggctcacaacagtgaagatcaataatgtgaaccaccttttcgcactccatggcctcagcaatggcatggtttgtgatcaggtatgagaacttcaaaaatggacacagttcatagaagtatttctgaacaaggatatcttcagaagataatgatgtttttgatggattgagagacttatatacaccaggcaaattttttattatcctgtaaccaagtgcttcactgaaataagtgaccatcctttgcactgcattaccatcaggagatgaaatctgagatatgtactcaaggccaatatctgcattcttgatgcttccagatgcaacacatttggcacagtcaataagaaggcttattggatttaagccctgggagtcccatctcagctccctcagccactgggatggcgaacctaatccatccataatagctggattagcataaatgagagccgtaggtgtgaaaagagaaaatataggatgttcattctactcagagcatgtaaatgtttgataaaaacagttccagatacaatttgtcaatcagacaatgatacttgggagttttcttcttcctttccttttcagaagatattactttttggtagtgagaaaaaaaaaaaaaaaaaaaaaaaaaaaaaaaaaaaaaaaaaaaaaaaaaaaaaaaaaaaaagggcggccgc

SEQ ID NO: 1252 - DNA, 437 bp, Oryza sativa
  Predicted polypeptide sequence is orthologous to G922
cccacgcgtccgcgacctctgcccgttcctccgcctcgccggcgccgccgccaaccagtcgatactggaggccatggagtccgagaagatcgtgcacgtcatcgacctcggcggcgccgacgccacgcaatggctggagctcctccacctcctcgccgcgcgccccgagggcccgccgcacctgcgcctcacgtcggtgcacgagcacaaggaactcctcacccagacagccatggcgctcacgaaagaagcagagcgcctcgacgtgccgttccagttcaacccggtggtgtcccgcctcgacgccctcgacgtggagtccctccgcgtgaagaccggcgaggccctcgccatctgctccagcctccagctgcactgccttctggcgttcgacgacgacgccggcgtcgtggcgggcggcgacaaggagaggcgga

SEQ ID NO: 1253 - DNA, 487 bp, Oryza sativa
  Predicted polypeptide sequence is orthologous to G922
gccatgcggagacggagaagagggcgcgatcttgccagcagaggaagaagttgcccttctcctcccggaccttgaagccgtcgcagccgaggccctgcgccacccgccgcgcctggagcagcgcgtagtagctgagcgggacgcggccgaagccggcgccctccagccgccgcgcccaccgctccagccgctcgtgccgctcccgccgctcgccgccgtcgcacgccacgatgttcttgatctcctccccgagcagccaccgctccacgcgcgcgcgctccaccgacccgcgcgccgcccccacctccaggcagtcgaacagcgccgcgtagtagttgagcgcctccacgaacctctccgtcagccccgccgcgttgtggctcgcctcctgctccgccaccaccatcaccttcggcgacagcccccacagcgcgcccaggaacgcgtccgcgcgcgacgtcgacggcgacagcccggactccgggct

SEQ ID NO: 1254 - protein, 810 aa, Oryza sativa
  Orthologous to G922
MMHGLWVQDQGVVDHLAQLVPLLHECASHVTEGSFEKADFSFKKIRMLTIADGPLQRLSTIIVDSLAHRLLSSIQGLPGALIDPSDYFEKSTLRAARHNFFKLNPYLSTGFVTINWAIMEAMEDEKSLLSKKAESLGVSFHFISVIGRLETLDFSNLRSTFQIKFGVAVAISCALQMHRLLLVDDNLSSTSIAQLQKMANFTQPKQMASSVCSPASTLNYLQTPSPRTPKLLARLLSAIRALKPNIMLIMEQDADHNTLLFRDRFNEVLNYYAALFDCFHAVAAANPGRTDERLRVDRMILREEIKNILLRLCCTDRGMFQDDMLSSATSSPASSVYSPSPSPSNGSWVQELSHDQQSVRLIGLLYQCAAEVSAGSFDRANLCLEHITQLASLDAPHALQRLAAVFADALARKLLNLILGLSRALLSSANSADAHLVPVARRHMFDVLPFLKLAYLTTNHAILEAMEGERFVHVVDFSGPAANPVQWIALFHAFRGRREGPPHLRITAVHDSKEFLANMAAVLSKEAEAFDIAFQFNAVEAKLDEMDFDALRHDLGVRSGEALAVSVVLQLHRLLAVDDGRRHAAAGCLTPVQIIARSSPRSFGELLERELNTRLQLSPDASVVSSLSPHSPAAATAAHPTTSTPKLGSFLSAVRSLSPKIMVMTEQEANHNGGAFQERFDEALNYYASLFDCLQRSAAAAAERARVERVLLGEEIRGVVACEGAERVERHERARQWAARMEAAGMERVGLSYSGAMEARKLLQSCGWAGPYEVRHDAGGHGFFFCWHKRPLYAVTAWRPAASRRGHTRS

SEQ ID NO: 1255 - protein, 399 aa, Oryza sativa
  Orthologous to G922
MPLHPAAAASPTPPWMVRELRSDERGLCLIHLLLNCAAAAAAGRLDAANAALEHIASLAAPDGDAMQRVAAAFAEALARRALRAWPGLCRALLLPRASPTPAEVAAARRHFLDLCPFLRLAGAAANQSILEAMESEKIVHVIDLGGADATQWLELLHLLAARPEGPPHLRLTSVHEHKELLTQTAMALTKEAERLDVPFQFNPVVSRLDALDVESLRVKTGEALAICSSLQLHCLLASDDDAAAVAGGDKERRSPESGLSPSTSRADAFLGALWGLSPKVMVVAEQEASHNAAGLTERFVEALNYYAALFDCLEVGAARGSVERARVERWLLGEEIKNIVACDGGERRERHERLEPARRVAQGLGCDGFKVREEKGNFFLCWQDRALFSVSAWRGRRFD

SEQ ID NO: 1256 - protein, 223 aa, Oryza sativa
  Orthologous to G922
MALTKEAERLDVPFQFNPVVSRLDALDVESLRGLSLKVMVVTEQEVSHNAAGLTERFVEALNYYAALFDCLEVGGARGSVERTRVERWLLGEEIKNIVACDGGERRERHERLEGAGFGRVPLSYYALLQARRVAQGLGCDGFKVREEKGNFFLCWQDRALFSVSAWRGRRFAALLPLPPSTPLPCSRVIATLLSSPPPPCSPLHPYCPERRERMKGEKKGKRE

SEQ ID NO: 1257 - protein, 442 aa, Oryza sativa
  Orthologous to G922
MVQDEGSSSSVTSSPLHNFSNMPLHPAAAASPTPPWMVRELRSDERGLCLIHLLLNCAAAAAAGRLDAANAALEHIASLAAPDGDAMQRVAAAFAEALARRALRAWPGLCRALLLPRASPTPAEVAAARRHFLDLCPFLRLAGAAANQSILEAMESEKIVHVIDLGGADATQWLELLHLLAARPEGPPHLRLTSVHEHKELLTQTAMALTKEAERLDVPFQFNPVVSRLDALDVESLRVKTGEALAICSSLQLHCLLASDDDAAAVAGGDKERRSPESGLSPSTSRADAFLGALWGLSPKVMVVAEQEASHNAAGLTERFVEALNYYAALFDCLEVGAARGSVERARVERWLLGEEIKNIVACDGGERRERHERLERWARRLEGAGFGRVPLSYYALLQARRVAQGLGCDGFKVREEKGNFFLCWQDRALFSVSAWRGRRFD

SEQ ID NO: 1258 - DNA, 1062 bp, Glycine max
  Predicted polypeptide sequence is orthologous to G926
  misc_feature (1026)..(1026): n is a, c, g, or t
ccctcgcgttttcccacgcgtccgcccacgcgtccgattttctatcagaatctgagggcccaaaatctagggttttctgttcttctctggggatctgaagacatgcagtccaagtctgaaactgcaaatcgactgagatcagatcctcattcctttcaacctggcagtgtttattctgagccttggtggcgtggtattgggtacaatcctgtggcccagacaatggctggggcaaatgcatccaattcatcgtctcttgaatgccctaatggtgattctgaatccaatgaagaaggtcagtctttgtccaatagcgggatgaatgaggaagatgatgatgccactaaggattcacagcctgctgctcctaatggaacccgcgcgtccgggcaagaacagcaagggatgctgcatactgcatcatctgcaccctccatgcgtgaagaatgccttactcagacaccacagctggaacttggcggtcattcaattgttagtctatgcctttgttgttatcacttttttaagacatatacatggtccaaatattgatgacttagttcaatagcataaattgttggtgattcatgcatatcattttgataaaaaaaaaaatctgttatagaatttatagttggcttgcctttggaatggattggactcttcatattcttttgatgtaggcatgtgctacaaatccttatcaggatccgtattatgggggcatgatggcagcttatggtcaccaacagttggtatgtgacattaatctggcttaattcaatattaaagattattgcatatataggtcatagtcataaactcataattactaatttgcatttttcacaaattagcctgataagaaatgtgggtagtacataatccagaagggatatgttcctgtcataatgataaatttgtttcattttggttggtctattggcttggtaaagcaatggtgatatttggataacagagaaaaataaccatgtgatatttttaccattagggatatggctcttntataggaatgcctcatgccagaatgcctttgcccct

SEQ ID NO: 1259 - DNA, 946 bp, Glycine max
  Predicted polypeptide sequence is orthologous to G926
  misc_feature (903)..(903): n is a, c, g, or t
gttgtgttactattttttttttttaaatgtttgttttgatttttttataattttctctgttattattggtgtcgttgctattaattaatttctggtgctaaattgagataactgtgtgtgacaaagagagagagtaatcaagatagctcctttgaattttctatcagaatctgagggcccaaaatctagggttttctgttcttctctggggatctgaagacatgcagtccaagtctgaaactgcaaatcgactgagatcagatcctcattcctttcaacctggcagtgtttattctgagccttggtggcgtggtattgggtacaatcccgtggcccagacaatggctggggcaaatgcatccaattcatcgtctcttgaatgccctaatggtgattctgaatccaatgaagagggccagtctttgtccaatagcgggatgaatgaggaagatgatgatgccactaaggattcgaagcctgctgctcctaatgaaacaggaaattatgagcaagaacagcaagggatgcagcatactgcatcatctccaccatccatgcgtgaagaatgccttactcagacaccacagctggaacttgttggtcattcaattgcatgtgctacaaatccttaccaggatccgtattatgggggcatgatggcagcttatggtcaccaacagttgggatatgctccttttataggaatgcctcatgccagaatgcctttgccccttgagatggctcaagaacctgtgtatgtgaatgccaaacagtaccaaggaattctgaggcgaagacaggctcgtgcttaagctgagcttgaaagggagctcataaaatctagaaggggcataacatgctcacaaacattggacagaattgggttcctctactactagtgtncttcttaacgttttgggatcctctattgggctatatgctgaca

SEQ ID NO: 1260 - DNA, 858 bp, Oryza sativa
  Predicted polypeptide sequence is orthologous to G926
agaaggatcaacaggcaatggcatcctagagtttgcagcaccagtaatttgaggatgaacaaatgcatgtgaagtgtatcctgttaatactccaccataatatggatcagtaccatatggataagaaacacatgcaaaaggctggttgtaatcgaactttgaaggaggaaaggcagcttctgtgttccccaaagacaataccgacttagtgccatggtcccgctccccacaactatcattgttgttaatatctgaggggacaaacactgattgtggtgaggtgtgttgtccgttgagactgctgtcacttactgcagatgcttcttggtgagactccccagactttgttggtgacgactcaccaccagagttcctctgaactaactgtttcattggatagttattcctggcaagaaaatcatagttggtcttggccatgcattggacaggatgattctccatttcttgcaacagcattatcattattagaaggcattactcaagatccacaaacattttctgtcctcctattttgaagttcagaaaattttcaggtcagactgacagtggcacataaagaaagccaagttactagataaattagtaccttgaattcggtttgtatactatccacatacaatgattagggattaggttgtacaaacatccaaactcagctggatgaacagttgaaaatgatcgaagcataaaataaatcaaagaactattgtacggcctctacaatatcattaacaaacaatactatgtccacttcatgatggattaatctatctagacagtacacctccaggataagaagtagaaatcctcctcgtgccgattcctgcagcccgggga

SEQ ID NO: 1261 - DNA, 383 bp, Oryza sativa
  Predicted polypeptide sequence is orthologous to G926
agcctttggtccggcgggtggtgtggcggtggcgcgactagtggaggtagggcttcctgccttagaccagcctgttctccctctgggccttggcgcgggcacggtgacggcggaggatgccttcgtactgcttcgcgttgacatagattcggcgcatcggtatggcgcgtttagcggcatgtatgcattcgccctgccacctcatttgatttccatccgcgttaggtggtcaataagaaccatagcatttggctccataccaaggaataacttggtgagaggacctgaaaccacatggcctagtaatgttaacccaaattaggcaacgcataacacaccttgatggttactattcagaaaataaaatctttttagtaagtaca

SEQ ID NO: 1262 - DNA, 1666 bp, Zea mays
  Predicted polypeptide sequence is orthologous to G926
cccagcgtccggcccgagccacttacaataatccttgcccaatcccgtctttagccgctagggttacgcgtccacggcgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgaggcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacaggagtcccgtgctaaggctgaacttgagaaaaaggtgggcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccacagctgattcatgtgatgtgcttgcatatctttccttgtgccaatttttgtttgggggaacgcagtaattttatattttttatattcgggagtccacacaatcgtgtaaggttcctgcgaaccagttctgactttaattgaaccgcccggattcatatg

SEQ ID NO: 1263 - protein, 314 aa, Brassica napus
  Orthologous to G926
MISLTVTTPSLRETEDMHSKSESGNQIVSEAHHHTSSTSINSLNPWLRAAASCNANSSVEEAGDKSIALENQTNLESSNGSKSPSNRDENGNKESQVTASPQQSAADYSEKSQELVHPGSTPPPHPQLVSHTVGWASSNPYQDSYYAGMMGAYPLTYVPHGGMPHSRMQLPPEMAQEPVYVNAKQYQAIMRRRQARAKAELEKKLIKSRKRYLHESRHQHAMRRPRGTGGRFAKKTNTEASQQKDGEKRNACATQSPTSSHSDQHEGCSDEYRTNQSDEMQSSAYKIREEADCSGQQWNNISSNHPSQPLLAIK

SEQ ID NO: 1264 - DNA, 642 bp, Glycine max
  Predicted polypeptide sequence is orthologous to G961
  misc_feature (562)..(562): n is a, c, g, or t
tcacctcatcatctatcattatatctttctttcaattcctatcctcttccttgtagtgtacccattttgaatgtgttctctctctctctctctttctttaggtccctggtgaatatctagaaccactctctagctagtttctctcttcttgctagctagctatcgccgatcactctcttggtttaaaccacctgaatgccggaaaacatgagcatatcagtgaatggtcaatctcaagtccctcctggcttcaggtttcatccaactgaagaagagcttcttcagtactacttgaggaagaaggtctcttacgagaagattgacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatctacagcaatggaaagaggattggaatgagaaagactctggttntctacaaaggaagagcgccacatggccagaaatccgattggatcatgcatgaatacagactagacgacaccacaccagcg

SEQ ID NO: 1265 - DNA, 497 bp, Glycine max
  Predicted polypeptide sequence is orthologous to G961
gaaagaggaagacctactctctatctttaaacatgatccgggagagaataggggactcactcttcctatatttaccatcctaccatgaaggaaatagggggccttcacacttttggtttaaaccacctgtttgccggaacacattaccctgccaggtagtgcacaagctccagtgcctcctgggttcccgactcatccgactgaagaacagcttattcaccactactagacgaagaggtctcttacgagaagaggacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatcttcagctatggaaagaggattggaatgagaaaaaactctgttttc

SEQ ID NO: 1266 - DNA, 1034 bp, Oryza sativa
  Predicted polypeptide sequence is orthologous to G961
  misc_feature (4)..(4): n is a, c, g, or t
  misc_feature (199)..(199): n is a, c, g, or t
  misc_feature (205)..(205): n is a, c, g, or t
catngtgtcatggctccatcaccacctagcagctctacacctctctcttatattagctctctctctctctctacccccattcatgctcatctccttctagcttccagcttaatcccttccttgtcaatgttaatggacaaactctgagcattgcactacccatcatctcctagctagactcaccttagcttgtctcttngcgtcnctagtgtgtgattctttctcccatttcctgtttggtttgcactgagtgaacaagcaattaagcttggtagtagtagtagttgttgtattgatcgatcgatcgatctagagacgacgatgagcatatcggtgaacgggcagtcggtggtgccaccggggttccggttccacccaacggaggaggagctcctgacatactacctgaagaagaaggtggcctcggagcgcatcgacctcgacgtcatccgcgacgtcgacctcaaccagctcgagccatgggacatccaagagaggtgcaggattgggtcagggccgcagaacgactggtacttcttcagccacagggacatgaagttcccggcggggacgaggacgaaccgggcgacgggcggccggcttctggaaggccaccgggcgcgacaaggccatctacaacgccgtccaccgcatcggcatgcgcaagacgctcgtcttctacaagggccgcgccccccacggccagaagtccgactggatcatgcacgagtaccgcctcgacgaccccgccaccgacaccgccgccgtcacacccacggttacttctgctgctgctgcggcggcggcgatggccgcggcggcggacggcgggcaggaggatggctgcgtggtgtgcagggtgttcaagaagaagcaccaccacaaggaggcccgcgggaggcggcggcaagcacggcggtcgacggcagcgcccggcgccaagggcggcgcacgcttactcctccagcgacgacgcgctcgaccagattctgcagtacatgggcaggtcgtgcatgcaggagcacgagcttccc

SEQ ID NO: 1267 - DNA, 633 bp, Zea mays
  Predicted polypeptide sequence is orthologous to G961
  misc_feature (9)..(9): n is a, c, g, or t
  misc_feature (572)..(572): n is a, c, g, or t
ggtaccctnccgagcctggccgggctgccaccagcaattcccttccattcctcacatcgtcttcctcctctggccttcccatcttcttcctctcgtcctcgatcgatcatcctgctaactagctagaggtctggcactagctgctaactagaaaaaaggaagaaagcaagcaagctaagaaggaattgaagatcgtatcatcaatgagcatctcggtgaacgggcagtcgtgcgtgccgccggggttccggttccaccccacggaggaggagctgctcaactactacctccgcaagaaggtggcctcccagcagatcgacctcgatgtcatccgcgacgtcgacctcaacaagctcgagccatgggacatccaagagagatgcaagatcgggtcgggtccccagaacgactggtacttcttcagccacaaggacaagaagtacccgacggggacgcgcaccaaccgcgctacggccgccggcttctggaaggccaccggccgcgacaaggccatctacagcgccgtcaggcgcatgggcatgcgcaagacgctcgtcttctaccggggccgngcgccgtacggacacaagtccgactggatcatgcacgagaattgactggacaaccctgact

SEQ ID NO: 1268 - DNA, 1203 bp, Zea mays
  Predicted polypeptide sequence is orthologous to G961
ccacgcgtccgcccacgcgtccgcccacgcgtccgcccacgcgtccgcccacgcgtccgcccacgcgtccgcccacgcgtccgcccacgcgtccgcggacgcgtgggatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggtccccagaacgactggtacttcttcagccacaaggacaagaagtacccgacggggacgcgcaccaaccgcgccacggccgccgggttctggaaggccaccggccgcgacaaggccatctacaacgccgtcaagcgcatcggcatgcgcaagacgctcgtcttctacaagggccgcgcgccgcacggccagaagtccgactggatcatgcacgagtaccgcctcgacgaccccgctgctgctgctgctgctggatccggtgatgccgtggccaacgacgacgcagccgccacggctgctgctgctgccgccgcgtcgtcggacggcgggcaggaggacggctgggtggtgtgcagggtgttcaagaagaagcaccaccacaaggagtcaggtgggggcgggggcaacaagcacggcagcagtaacagcgagcatgggcacggcggcgccggcaaggcatcggctgcggctgcggctgcggcgcaccagcaccagcaccatggaggcctgcagtactcctccagcgacgaggcgctggaccagatcctgcagtacatgggcaggtcgtgcaagcaggagcacgagctggtgtcgccggcgccggcgccgccgggacgggcggcggcgtccaggtacctccggcccatcgagaccgttctgggcgggcacgcgttcatgaagcttcccgcgctcgagagcccgtcc

SEQ ID NO: 1269 - DNA, 820 bp, Zea mays
  Predicted polypeptide sequence is orthologous to G961
  misc_feature (750)..(751): n is a, c, g, or t
  misc_feature (755)..(755): n is a, c, g, or t
  misc_feature (758)..(758): n is a, c, g, or t
gccggccggttctgggtacccggcttccctcgtcaccggctccggctccggcaccggctcaatacaatcccatcaccaatcattcattccctttgcctactactgctaccttctcctccttccatcttcgatagacgacgaaataatggcggtattcgacgtctgaatcctcgtactcttatactgcatacatacagacagacccttcttcttccttagttccctatagctctagctaggcgaccgatcatgagcatctcggtgaacgggcagtcggtggtgccgccggggttccgtttccacccgacggaggaggagctgctgacctactacctgaagaagaaggtggcgtcggagcgcatcgacctggacgtcatccgcgacgtcgacctgaacaagctggagccatgggacatccaagagaagtgccgcatcggttcgggcccccagaacgactggtacttcttcagccacaaggacaagaagtacccgacggggacgcgcaccaaccgcgccaccgccgccgggttctggaaggccaccggccgcgacaaggccatctacgcctcgccgggcgcccgccgcatcggcatgcgcaagacgctcgtcttctacaagggccgcgccccgcacgggcagaagtccgactggatcatgcacgagtaccgcctcgaggcgcccgtcgacgccggagccggcgccgcgcaccacctgctgctccccgccgccgaacatcctccctactacacnntcgncgncgcaggcggcttcttcaatactaccgcaacgatcccgtggcgcggcgggagaccagcgggca

SEQ ID NO: 1270 - protein, 395 aa, Oryza sativa
  Orthologous to G961
MSISVNGQSVVPPGFRFHPTEEELLTYYLKKKVASERIDLDVIRDVDLNKLEPWDIQERCRIGSGPQNDWYFFSHKDKKYPTGTRTNRATAAGFWKATGRDKAIYSSSNRIGMRKTLVFYKGRAPHGQKSDWIMHEYRLDDPSSASASVSVNLPSYYSSSSSSSSPMHGVAGDQGAQEEGWVICRVFKKKNLVHHGGGAAAASHHAAAKLAAAAMEGSPSNCSTVTVSDHVKAQMLHSSASDDALDHILQYMGRSGCKQETKPAAMSASSAAAAAALEQHLSTPQYGKFMKLPPLEHVAGGVGLLAAAGGGGEYCSAADASGIADWDTLDRLAASYELNGALSDVASGKNMAGFFDVVDQPAGAAAFSSGDGDLWSLARSVSSSLHADLTTMNNV

SEQ ID NO: 1271 - DNA, 1465 bp, Glycine max
  Predicted polypeptide sequence is orthologous to G974
tacggctgcgagaagacgacagaccgcgaagagtgaaactgccaaaaagtgaggccaccccaaaaacaaagtgagattataggaaacaaaaatttctttgcttaatactagttcctcctttctcctagcctggtagtcttttgaaaattctttatcttgatcacataattttcattttgaacttgaagaaagttttagtgtatttttttttccttaaagaaacagaacatatcctgttctttctttctctgtttgcatttttgttcacttctttctttctttctttctttcttattatctagttaagcatgacaacatttatggacatgtacaacactactagtagcatcatgacaccggatttcttagaccagtgtagtgatcaagagctgatgaaagcacttgagccttttatgaaaagtgattcatctagcactacttcctcatcaataacaacatacccttcattctcttctttttcttcttctcccaacttgtcctcaacaacatggagcacccaattttgctcctcaagctaccaccaaaagggtccaactccaacccaagctagttccttcaaactgaaccaactcaccccatcacaaatatttcaaattcaagcccaaatccaggttccacgagcccagtttctcagcccaaagcccattcccatgaagcacgtgcgggcttctccttcttcaaagcccacgaagctttaccgtggggtgaggcagagacactggggcaagtgggtcgctgagatcagactccccaagaaccgaacacgtctctggctaggtacatttgacaccgcagaggaagcagcgttggcttacgacaacgcagcgtttaagctaagaggagaaaacgcgaggctcaacttccctcacctgcgtcaccatggagcacgcgcgtacggtgagtttgggaactacaagcctctcccctctgcggtcgatgcgaagcttcaagccatttgtcaaagcttggggaccaattcgcagaaactcaaaactcaaaaccctattgttctagatacacacaaggcagagacagagacatcggagtttcaggattttaataaggttgagaattaccaaacatcatcgtcctcggccttctccgatgaatattcttcttcttcttcttcttcttcacctgaatccgatattaccctcttggatttctcggattcttgtgaaacaatggacaatcttgggttggacttggagaagtacccttccgtggagattgattgggcagctttatctgactcatgaataatcagtggttaacgggtatagtttagatttgatgtgttttaggttgcttttgtttgtttttttcttgttaatcagtgttttagatattgttttggaagttcttctaaatcacagcgcattataatgtcactgtgactgataaattattaagccattaatcgaataaaattttacacaatcac

SEQ ID NO: 1272 - DNA, 1245 bp, Glycine max
  Predicted polypeptide sequence is orthologous to G974
ggttctagaacttccatgagctcacctctgaatggatctgcctcaacttgttcttgtgatttcccttcctcttctttactttctccacaccccaatttctacacacacactccccccccttcctacttactccaaagccaacaatccttaataggctttgagcaaccaccgagttcccttctcgggctcaaccacctaagcccgtctcagatttctcagatccaggcccagatcgaggcccaacagagccaaaaccagaacccacactctctcaactttctcggcccgaagcccgtcccaatgaagcacgtgggcgggcctccgaagcccacgaagctgtaccggggcgtaaggcagaggcattgggggaagtgggtggcggagatcaggctcccgaagaaccgaaccaggctctggctcggaaccttcgacacggcggaggaagctgctttggcttacgacaaagccgcgtataggctccgaggcgacttcgcgaggctgaacttcccgagcctgaaaggctcgtgccccggggaggagtacaagcctgtgcattccgcggtggacgctaagctcgacgcgatttgcgccaacttggcggaaatgcagaagcaagggaagacggagaaaggtgccaggtcagcgaagaaatcgaagcaaggtccgaaccaggaggccaagcccgaacctcaagcttccgctgaaagtgagggttctgcggattcttctccgctgtctgatcttacctttgatgtaaccgagccgcaatgggaacattttaatttgcagaagtttccttcttatgagatcgattgggattctctctgaacttcgtctttgtttttatgtctagtcttgtggctaataataataataatttaggttagtcttgctaggtggctgctgcaattgagtttttgaagattgcagtgcttcttgtaggatttcgatttttttttttttagcatttggttattggctatttggtcaatatgatgtaaatctctctaccttggtcagctgggtttttttttttttattattattttcttgcttggcctgggagaatgacttctagccttctaggtgttgtctatgctttgatgttcatccaagtatgttattattattattattgttgttgatgtaattcaattttatttgcatctcagaatttatgaatatatttgtatttcagcttaaaaaaaaaaaaaaaaaaaaaaaaaaaaaaaaaaaaaaaaaaaa

SEQ ID NO: 1273 - DNA, 1881 bp, Glycine max
  Predicted polypeptide sequence is orthologous to G974
ccacgcgtccgcccagagagagtttctcaccaaacacacacttctcttctcttctcttctcttcattttctgtggttctcactttcttttctctaatcttctaatctcttattttcttcccccctctgttactccccgcttctctgaatccctttctgttaatcatctgtctttcaactcgtgattttttgggtttgcctcaccaaaaagattcaaactttgaaaatttttctcgaaagccaggtgttttcagaatcgagatccagctttttttttgtttgtttttaaaaaattattattttctttcgttcagccgcgagggttgtttttgatccctcaaaagctctctttctttttttctttcttggatttaaggggttgtctattttaaacctctcccatccttttttgttgtaatatttaaaaaccacaggttgatttttttaatctaagatctgtgtgtgtagttggaaaattgaatttttatatggcagctacgatgaatttctacaacgaaacatcacaacaagttcagtcagatccattcagaggagagctcatggaagttctagaaccttttatgaaaacttgtccttcctcaactccctctattctctcctcagattcaccatcaccttcctcttactctcctttactacctccacaccccagtttctccacatacaccccctctgcctacttattccaaaaccaacaacccttaataggctttgagcaacaaccaagttcccttctcgggctcaaccacctaagcacgtctcagatttcccagatccaagcccaagcccaagcccagaactcgctctctcttaatttcttgggccccaagcccgttcctatgaagcacgttggtgggccggcgaagcccacgaagctgtaccggggcgtgaggcagaggcattgggggaagtgggtggcggagataaggctaccgaagaaccgaaccaggctttggctcggaaccttcgacacagccgaggaagccgctttggcttacgacaaagccgcgtacaggctccgaggcgacttggcgaggctgaacttcccgaacctgaaaggctcgtgccccggcgaggagtacaagcctatgcaggctgcggtggacgctaagctcgacgcaatctgcgcgaacttggcggaaatgcagaagcaagggaagaacgagaagggtgccaggtcggggaagaagtcgaagcaaggtccgaacctggaggcgaagcccgaacctgaagcttcgggttccggtgctgctgctctgtctcctgaaagtgagggttctgcggattcttctgctttgtctgatcttacctttgatgtaaccgagccgcaatgggaggatgcttcagcacattttaatttgcaaaagtttccttcttatgagatcgattgggattctctctgaagactctttgtttttttatttttatgtctagtcttgtgggtaattaataatttagttataattaggattgctcttgtggctgctgcaattgagtttttgaagattgcagtgctacttgtaggatttggattatgttagtcttttttctttttcttttttttttttaaatttgcttattggctattcgatggtcaatatgatgtaaatctctctaccttggtcagctggttttttttttcttgcttggccatggagaatgattccgggttaggtctttgtctatgttttagtgttcgtccaagtactattattgatgtaattcaattctatttgtatctcaatttatgaatgtatttgtatttcagcttacatattgtactagtttgtttcacacttgggccctcgtggtagttgtgtttggttcttgtatgaacaatcgattttattttctttgtggc

SEQ ID NO: 1274 - DNA, 1203 bp, Glycine max
  Predicted polypeptide sequence is orthologous to G974
  misc_feature (1058)..(1058): n is a, c, g, or t
  misc_feature (1128)..(1128): n is a, c, g, or t
  misc_feature (1142)..(1142): n is a, c, g, or t
  misc_feature (1158)..(1158): n is a, c, g, or t
gatccaagagtgacccgagacacagattcttaccaaataaacaaacaaaaaaacacacacacacacactttccattttctgtggttcttcttctcacttctctaatcttctcccccctctgttactccccgcttctctgaatccctttctgttaatcatctgtctttcacctcgtgattccaaaaagattcaaactttgaaaatttttctcgaaagccaggtgttttcagaatcgagatccagtttctttttatccttttgttaagaaattattattttctttcattcagccaagagggttgtttttgatccctcaaagcttttttctttcttcttggattaaaggggttgtctattttaaacctcttccatccctttttttttataaaaaaaattattatttttttttgtaatttttaaaagaaacgcaggttgatttttttaatctaagatctgtgtggtgtagttggaaaatttttatatggcagctacgatgaatttctacaacggaacatcacaagaacaagttgagtcagatccattcagaggtgagctcatggaagttctagaaccttttatgaaaactagtccttcctcaacaactccctctattattctctcttcagattcaccttcatcttcatcttttaatttcccttcctcttctttactttctccacaccccaatttctacacacacactccccccccttcctacttactccaaagccaacaatccttaataggctttgagcaaccaccgagttcccttctcgggctcaaccacctaagcccgtctcagatttctcagatccaggcccagatcgaggcccaacagagccaaaaccagaacccacactctctcaactttctcggcccgaagcccgtcccaatgaagcacgtgggcgggcctccgaagcccacgaagctgtaccggggcgtaaggcagaggcattgggggaagtgggtggcggagatcaggctcccgaagaaccgaaccaggctctggctcggaaccttcgacacggcggaggaagctgctttggcttacgacaagnccgcgtataggctccgaggcgacttcgcgaggctgaacttcccgagcctgaaaggctcgtgccccggggnaggagtacaagccntgtgcatttccgcggntggacgctaagctcgacgcgatttgcgcccacttggcggaaatgc

SEQ ID NO: 1275 - DNA, 1785 bp, Glycine max
  Predicted polypeptide sequence is orthologous to G974
ccacgcgtccgcggacgcgtgggcggacgcgtgggcgagaggtacttgctcacagatatattttttttttttgtctccatcattttctcgagagctttcagtttctgtggttcatctttcttcttcttaatctttccccccctctctgtaacatcccgcttctctgaatccctttctgctaatcatctgtctttcaagctaagattttctggtttgtcttttaattcaccaaaaagcaaacttagaaggatttttcgaaagccaggtgttttcagaaacgagatccaggttttattgtcgaatttcgctagtcatattaatatttcatcattttttttttcctttgaaaccagccaagagggttatttttgatccctcaaagctaatttctcattttcttttccgggactgaagaggttgtctatttgaaatctccttcatcctttcctttcttgttgaaaagtttttgtttttgttttaattaaccagcagttcttcagttttagaaagacgcaggttgaattatcatggcagctatgatggatttttacagccagcagcacagagtttcaatttcactcagatccattcaggggtgaactaatggaagttcttgaaccttttatgaaaagtcctttctcaaccccttctccttcaaattcttgttttctttctacctcttactctccttcccccaacaactactctccctccctatactcaaacgggttatcatccatacccaacaccacccaaaacttaattggtttcgggcaagggcagcccacatctcttgtgggcctgaaccacctaaccccatctcagatctctcagatccaggcccaaatccagatccagaatcacagcaacacgctgagcttcctagggccgaagcccatccctatgaagcacgtgggcatgcctccgaagcccacgaagctatacagaggggttcgacagaggcactgggggaagtgggtggctgagattagactcccgaagaaccggaccaggctatggctgggaaccttcgacaccgccgaggaagccgctctggcgtacgacaaggccgcgtacaagctccgaggtgacttcgccaggctcaacttccccaacctccgacaccagggttcctccgtcggtggtgacttcggggagtataagcctcttcattccgccgttgacgccaagcttcaggccatttgcgagggccctggctgagctgcagaaacaggggaagaccgagaagcctccgaggaaaacgcgatccaaactcgcttctccgccagagaacgacaacaacaacgacaacaactcttgtaaggtcgaagctgcttcctcctcttctgaaggttcttcgccgctttcggttctgactttcgctgacgtcagcgagccgcagtgggaaggtgattcggataattttaatctccagaagtacccctcttatgagatcgactgggattctctgtgaagccgtgttttcttagtgtcctatgttgttatgtaagggtattaatcttcattatgtatggtctagtctaggtcttagtgtcttctcaggtggctgctactgcaatggagtttttggcaattgcagagcccagtcttagttaattactagtattctgtgtataatctctctctaccttgggtcatagctggtttttttcttgcttgaccagggagaattagtccacttaatatgtttctcaagtggcatcgctgtaatctactacttttaattataaaaatatggatttattattgtaaaaaaaaaacacc

SEQ ID NO: 1276 - DNA, 1911 bp, Glycine max
  Predicted polypeptide sequence is orthologous to G974
ctcgagccgcgagaggtacttactcacagatatatttttttttttttgtctccatcattttctcgagagctttcagtttgtgtggttcatctttcttcttctccttccctcccccctctgtaacaccccgcttctctgaatccctttctgttaatcatctgtctttcaagctaagattttcgggtttgtctattaattcaccaagaagcaaacttagaaggatttttcgaaagccaggtgttttcagaaacgagatccaggttttattgtcgaatttcgctagtcaaattaattttcataattatttttttctttgaaaccagccaagagggttatttttgatccctcaaagctaatttctctctctctttttttatttccgggactgaagaggttgtctatttgaaatctccttcatcctttcctttcttgtagaaaactttttaaatttttttgtcagtgggtgttttaattaaccacctgttcttcaagttttagaaagacgcaggttgaattaattagtatcatggcagctttgatggatttttacagcagcaggcccagagtttcaacttcactcagatccattcaggggagaactaatggaagttcttgaaccttttatgaaaagtccttctcccaactatttcccttcctccccctccctccctaatctttactcaaacgggttatccagcaacacccaaagcttaattgggcttcgggcaagcgcaacccacatctcttgtgggcctgaaccacctaaccccatctcagatctctcagatccaagcccaaatccagatccaggcccagcagcatcagaatcgcagcaacaccctgagcttccttgggccgaagcccatccccatgaagcacgcgggcatgcctccgaagcccacgaagctttacagaggggtgagaacagaggcactggggaaagtgggtggctgagatcagacttcccaagaaccggaccaggctgtggctgggaaccttcgacaccgccgaggaagccgctctggcatacgacaaggccgcgtacaagctccgaggtgacttcgccagggctcaactttcccaaaccctgcgacaccaggggttcctccgtcggtggtgatttcggggagtacaagcctcttcattccgctgttgacgccaagcttcaggccatttgcgaaggcctggctgagctgcagaaacaggggaagaccgagaagcctccgaggaagtcgcgttccaaactcgcggagaaggttgtttccgacaaggagaacaacaactcttgtaaggtggaagctgcgtcctggtcgtcggaaggttcttcgccgctttcggatctgacgtttgctgacgtgagcgaggctcagtgggaaggtgattcggataattataatctccagaagtacccctcttatgagatcgattgggattctctgtgaagtgtcctattatgtatggtctagtctaggtcttagtgtctcttaggtggctgctactgcaatggagtttttggcaattgcagggctagtactattctgtgtataatctctctaccttgctcacagctggtttttttcttgcttgaccagggagaattagtccgcttaatatgtttttcaagtgcatcgctgtaatctacttcaatttcatcatcttataaaatatattattctactaattctgtgttaacaattcctgaattaatgtatacactcttcattcttcaacatagcatgcaggtctatacaggaaatacactctgttcaacagctgacattcaatgagctacatgacgtcggtcacttctctacgatgttaatcttttttcccactataacactatgtttggtttggaaaagaaagtggaaggaaagaaagtggaagtaaagaaagtgattcgtgaaggct

SEQ ID NO: 1277 - DNA, 903 bp, Oryza sativa
  Predicted polypeptide sequence is orthologous to G974
gcacgagggagagaactagtctcgagtttttttttttttttttttttttttttttttttttttgggtttttgatacagttaattcacagtagttctattacaggtagttaccaacaattgattacaacaacctacatgcacaagtatttgtacatttgtagagttgtacaactactacactaacgagtcactgcttactagacatcggagacgccggacacaaaaacgacgccggcgagcagcctccggaacctaaaaaaccaacacaaaaagaaaaggatctacacaagaacgaacatataatccatcgcctcgccgccgcgcagaatgcctaaaacctcatctgcgccggccggcaatggcgggctatggaggagaagagctagttattgttgttgagcagcgagtcccagtcgatctcgtacgacgggtacttggtgagcgcgaacccctccgcctcgtcccacggcacctcgctgaagtccagctgctccatcgccagcggcgacgccgccgcagacgacgacgacgtctccgagccgccgtcgtcgccgccgccggagtggtcggagccggaggacgacgacgccgcggcgaccaggggcgcattgatgggcatggccctgccggcgccgcccctggacctggatgaggcgttcttggacgcggcgatggtgtcgcagatggcctggagcttggcgtccacggcggcgtcgagcgggccccgcgacgcggcgttgtccgggaagttgagccgcgccgcgtcgccgcggaggcggtacgcggcctggtcgtaggtgagcgccgcctcctcggcggtgtcgaaggtgccgagccagagcctggtgcggtacagcttctgcgcccgcgccgccgccgccgccggagcagccgccctcgtgc

SEQ ID NO: 1278 - DNA, 1844 bp, Zea mays
  Predicted polypeptide sequence is orthologous to G974
  misc_feature (1806)..(1807): n is a, c, g, or t
  misc_feature (1834)..(1834): n is a, c, g, or t
ctcgactggccgtgccgtgagaaaaaacaaccggcagctcaaccaggagattagcacatacttactgctgcatcacaacactggacgacgatgtactagctactagtttactcattgctactcgcagccgccatggccgatgtctaaaatgccatcgagccaccgccactgcaaaccccaaatcgaaaattacacagagctaccattgagctgacactgactgaatcttgctgctgctactactatagcagttgtagttgatcgttcacgagaggatggaatcccagtcgatctcccaggacgggtacttgcgcaggtggaaggtctccgtctcgtcccacggcgcctcggtgaagtccagcttcgccatctccggcacgggcggcgccagcgtcggggaaggaggggagccggcggagcccgactcctcctccccctccgtcgacgccgacgccgagcacttgggggagtccgggggggacccggccgactcgtcgccggacgagccgctcttggacttggactccgacagggactggcagatggcggtcagcttggcgtccacggaggcgtgcagcgggccggcgaggcgcgcgccgcccgccgcggcggagggacgggaagttgaggcgcgccgtgtcgccgcggaggcggaaggccgcctcgtcgtaggccagcgcccgcgccctccgggcgtgtcgaaggtgccgagccacagccgcgtgcggttcttggggaggcgggatctcccgccacccacttgccccagtggcgctggcgcacgccgcggtacagcttcgactgcgccggcggcgacccggacttctttcatcggctgcgcccgcgggcccagggacccccgcgtgcaggcccctctgctgctggtgctggaacatgagctgggcctggatctgctggatctgggccgggccgagctggttcaggcccatcggcccagccacgcccggacgccgtcgaagccgcgtaaggcgacgagtagagtggcggaagctgcgagaaaggcgaggaggtgggggtgggaagaggcgaggtggtgtaggagggagggtgtaggcatgtaagaatctggggccaacgagtagcgatggtagggggaggaagcactcgttataaaaggctcgagtgctttcgcgagctcctgatccgagggggacgaggaggcgataaggtgtggcgctgttattccagtacttgtacatgtatatggctgcggccattgggagctcatatatggagaaagctggactggagctagaagaagaggcctgggcaggaacttaaaacgggaagaaataaaaggaggttgtttatgaaaacaggggtaggaaaaagtttggaaatcaggccctgttcctcaataaaagtagagaaacgaggggtgtgtttgtgcagagaaaaaaaaaaaagaagcggtgagaatccagaagagaaaaaaaggttctctggatctctgctcctcctaggagaggtgtgatgaggtgagaaaaaaaaaaatcctaacccaagaacacgcttcctttgaggattctaataaacccaaaagaagagcctcttgaaccggacctttcttgtgctgcgcgtccctgctgctaaaagaaccagagagttcagagaacgaacctgcgttgctgcgcctcggttgattttttttgctcggatcgctcaaacctcaccgtggagttgggatgggatgtggcttgttgttcttgtggggggggtggggttgagttgggacgcctctctcccaggccggcctcgaggtacccattcggtaggttgttaaannggggggggggggggggggggtgggtgnggggaggggg

SEQ ID NO: 1279 - DNA, 1803 bp, Zea mays
  Predicted polypeptide sequence is orthologous to G974
ctttttttttttttttttttttttttttttttttttttttttttttttttttttttttttttttttttttttttttttttttttttttttttttttttttttttttttttttttttttttttttttttttttttttttttttttttttttttttttggggaacagccgaacacagattgtttatacaacaataaaccatacaatagtagcaccaacagtagcagttcatcaaattacaactcctggacacagctagctagctgattttacaacatacatcatacggagcactactgcttgacaagcatctcctcacatcacaccgtgctgctctttacaacctgtagagcacagcacaccatctagcacaacaaaaacagctaccaggacaacggacacctgaacggccgggggggtggggtcactgacccagtgtgacacgtaccggccaccaccggagaacgccgggacacaaaaacgccgggcttcccgtcggttgtggttctctcctcctccggagaaccaaaccctaataaataacccgagatctacaactgactcaccagtgacaaggaccaaacgaatcggacggacatctacacagaacgaaccaacgaacggacggacggggattagcactaatgatccaactagtgcccgcgcaggatgtctaaaatcccatctgcgcgacggccgttaaccttctttaaccctcctcctgctgcgcgacggcagtgtgggtaggaagggagccagccagccagccagccagccagccaacaaggggcgacggattaattggcgaggagggagtcccagtcgatctcgtacgacgggtacttggtgagcgcgaagccggcggcctcgtcccacggcgcctcgctgaagtccagctgctgcatctccggcaccgtcggccctggcgaggcggacggcgacggggaccgggacgggcacgaggactcggtggcggactcgaggcaggacgaggtcgcgtcgtcggacgacggcgaggagcagcagttgctggtgggggcggacgtcgacgtagcagctgcggcggaggctggcttcttggcgcccttcttggacgcggcgatgctctggcacaggctctggagcttggcgtccgacggaggcgtggagcgggccgcgggaggcggcgttgtcggggaagttgaggcgcgccgcgtcgccgcggaggcggtaggcggcctggtcgtaggccagcgccgcctcctcggcggtgtcgaaggtgccgagccagagccgggtgcggttgcgcgggagccggatctccgccacccacttgccccagtgccgctgccgcacgccgcggtacagcttctgcggccgcgccggggcgggggccgcggacgccgacgccttcatgggctgggcacgcgggcccagcacggaggtctgcgcctggcgacgctgcaggtggaggcgggcctggatgtactgcatctgggaagggctcagctggcccgcctcgtcggccgcggcgaacgggtagttccctccgtaggaggaggcggcggcgacggcttggtggaaggagaacggcgacgaggggctaagtggctggtgcgggtggaggagcggactggatccgtgagcagaggcatcccggataaaaggctcgacgtgctctcatcagctcctcccctgacagatctatagtagcagccatctagactgtttttttttgttttttttgttttttttcctctctctctagcaaaccaagaacaaacgaagamactggcggaacccmacagccacagtaaaaaacagatc

SEQ ID NO: 1280 - DNA, 2146 bp, Zea mays
  Predicted polypeptide sequence is orthologous to G974
  misc_feature (2134)..(2134): n is a, c, g, or t
  misc_feature (2141)..(2142): n is a, c, g, or t
ctttatcagctgaccgatccgttataaaagacgtttttattttctctttttttttttaacagacatacaccaaaagagttaattaagttgcagcagagagatcataacaggggattgcacttactttctcgactggccgtgccgtaagaaaaaacactttttttttttttttttttttttacatacatacgccagaagagttaattaagttgcaacagaggagatcataacaggggattacactgactttctcgactggccgtgccgtgagaaaaaacaaccggcagctcaaccaggagattagcacgtacgtttacttctgcatcacaacacagccgccatggccgatgtctaaaatgccatcgatccaccgcagctgcaaaccccaaatcgaaaattacacagagctatcactgactgaaccttgctgctgctgctgctactactactaaaatactagttgtagttgatcgttcatgagaggatggaatcccagtcgatctcccaggacgggtacttgcgcaggtggaaggcctccgtttcgtcccacggcgcctcggtgaagtccagcttcgccatctccggcacgggcggcgcctgcgtcggggaaggaggggagccggcggaggccgagtcctcatccccctccgtcgacgctgagcacttgggggagtccggcagggacgcggccgactcgtcgctggacggagctgttcttggacttggactccgccaggggactggcagatggcggtgagcttggcgtccacggaggcgtggagcgggccggcgaggcgcgcgccgccgccgcggcggagggacgggaagttgaggcgcgccgtgtcgccgcggaggcggaaggccgcctcgtcgtaggccagcgccgcgccctcggcggtgtcgaaggtgccgagccacagccgcgtgcggttcttggggaggcggatctccgccacccacttgccccagtggcgctggcgcacgccgcggtacagcttcgactgcgccggcgccggcgccagcggcggcggcggcgacggcgacccggactgcttcatcggttgcgcccgcgggcccaggaacgccgcgtgcaggcccctctgctgctgctgctgctgctgctggaacatgagctgggcctggatctgctggatctgggccgcggccgagctggttcaggcccatcggcccagccacgcccgacgccgtcgaagccgcataaggcgacgagtagagtggcggaagctgcgaggaggcgtggaggaggaggtggtggcggcgggagtgggaagaggcgaggtggcgtagctggtgtaagaaggtgtaggcatgtaagaatcttgggacatggatggagaggacgagtagccatggtagggggaggaggacgaagaggaggaagcactcgttataaaaggctcgagtgctttcgcgagctcctgatccgagggggaggaggaggaggcgatctggtgtgcgctggtattgtagtacttgtacatgtcgatggctgcggccattaggtctaaagcttggatggagctagaagaaagaggctgagaggttttctttatggaaaatcaaagtagattttttttttggaaaaccagctctgttcctcaataaaagtagagaaacgaggtgggtttgtgcgaagaagaaaaaaaaacagagagagggtattgcaaaacaaccccctttcgaaggccaaaaggcggcaaggatccagaagagaaaaaaggttctctggatctctgttcctcctaggagaggtgtgatgaggtgagaaaaaaatcctaacccaagaacacgcttctcttgaggattctaaaaaaacccaatagaagagcctcttgaaccggaccttttcttgtgctgtgcgtccctgctgctaaaagaagaaccagagagatcagagaacaaacctggcgtcgctgcgtcgcggatgattttttttttgctcgggtcgctcaagcctcaccgtggagatggatggatgggatgtggctttggtggtgttcttgtggtgggggtgaggcgtgtcctcgtgccgccctcccgcagaaaaaaaggcatccactagttctagagcgccgcacacggacgttttataaacacttggggagagggtgtntcaaaanngtct

SEQ ID NO: 1281 - DNA, 1765 bp, Zea mays
  Predicted polypeptide sequence is orthologous to G974
tgaggtggttggctaaagttgaagacctatgtgagaaatgcctgggtgaactgtaataatacgtttgtcctgcacgagtttgttaactgcgtccctggttctcctcaaaaaaaaaaaaaaaacatgggatccccggcccccggcactcaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagtttctggtctctgatctactcattttcttttcttccccttttggtgacataggtaggtctagttaagatctgtcgtgcctgttctttgattttagctaagaaccaggcgatttagtcttcttcttccttacaaaaaaaatccccagaaaaaaaagttgtgagtagtatattcttgtaccatttgatggccgctgctataaatctccccgggcccagcgaggatctgatgcgagcgatggagtccttcatgcaagacgacgccccatcccctctggccatgccgccggcgccgtctttcccagcggccgcagcccacggggcccagtacccggcgacccacctgagcccggcgcagatgcagttcatccaggcccagctccacctgcagccggacccggggctgggcccgcgggcgcagcccatgaagcccgccgtcccagtgccgccggcgccggcgccgcagcggcctgtgaagctgtaccgcggcgtgcggcagcgtcactggggcaagtgggtggccgagatccggctcccccggaaccgcacccgcctgtggctcgggaccttcgacaccgccgagcaggcagcgctggcctacgaccaggcggcgtaccgcctccgcggggacgcggcgcggctcaacttccccgacaacgcggagtccagggcgccgctcgaccccgccgtggacgccaagctgcaggccatctgcgccaccatcgccgccgcgtcgtcgtcatccaagaattccaaggccaagagcaaggcgatgccaatcaacgcgtccgttctggaagcggcagcggcgtctccgagcaacagctcctccgacgaaggttccggctccgggttcgggtcggacgacgagatgtcctcgtcctccccgacgccggtggtggcgccgccggtggcggacatgggacagctggatttcagcgaggttccgtgggacgaggacgagagcttcgtgctccgcaagtacccgtcctacgagatcgactgggacgcgctgctctccaactagtcgcccttcgccgacagatgtgctgttgtagttcagtagtggcagtatctctggccgccgcagatgaggttttaggcaatctgcaggccgccggcccatgtgtattaagtaggttttgctcagttgttggccccggacttcgccggcgtttttgtgaccggcgtccccgagtgcactgcattggtgtactggtctgtctgtaaaaaaaatggatctgtgacttctatagtgtgtattcaaccattgttcttagttgtgatgttactcgtgctgaaaaaaaccgccgccgggtttcgtcaaaaaaaaaaaaaaaaaaaaaaaaaaaaaaaaaaaaaaaaa

SEQ ID NO: 1282 - DNA, 669 bp, Lycopersicon esculentum
  Predicted polypeptide sequence is orthologous to G974
cagcagatgatgttacagactgcccatcatgcttccaccatgaatttcttggctccaaagccggttccaatgaagcaatctgggtcgccaccaaaacccacgaagctctacagaggtgttagacaacgccactggggtaagtgggtcgctgagatccgtttgcctaagaaccgaacccgcctttggcttggtacatttgacaccgctgaagaagctgctctggcttacgacaaggcggcgtatatgcttcgtggcgactttgctcgactgaacttccctcaactccgccacaacggcaacctaatcggcggcgactttggtgaatacaatccattgcattcctcagttgatgctaagctaaaggacatatgccaaagcttggcacaggggaagagcattgactctaagaagaagaaaaccaaagggttgtcggcggagaaagcggcggtggtgaagatggaggaagaggagagcaaaacagcagaagttggatccgaaagtgacgggtcccattccggttccggtggatcatcgccggtgaccgaactgatattcccggagttcactgaggaagagccaacttgggacatgtcagaaaattttttgttgcagaagtatccatctcatgaaattgattgggcctctctattaaattagaaatatttagaa

SEQ ID NO: 1283 - DNA, 500 bp, Glycine max
  Predicted polypeptide sequence is orthologous to G974
  misc_feature (466)..(466): n is a, c, g, or t
agcggcctccgaagcccacgaagctgtatcggggcgtaaggcagaggcattgggggaagtgggtggcggagatcaggctcccgaagaaccgaaccaggctctggctcggaaccttcgacacggcggaggaagctgctttggcttacgacaaagccgcgtataggctccgaggcgacttcgcgaggctgaacttcccgagcctgaaaggctcgtgccccggggaggagtacaagcctgtgcattccgcggtggacgctaagctcgacgcgatttgcgccaacttggcggaaatgcagaagcaagggaagacggagaaaggtgccaggtcagcgaagaaatcgaagcaaggtccgaaccaggaggccaagcccgaacctcaagcttccgctgaaagtgagggttctgcggattcttctccgctgtctgatcttacctttgatgtaaccgagccgcaatgggaacattntaatttgcagaagtttccttcttatgagatcgat

SEQ ID NO: 1284 - DNA, 760 bp, Solanum tuberosum
  Predicted polypeptide sequence is orthologous to G974
ttttggtgagcctaatttgtatactgatttctgtgcaatcccatcaacggctacccaaatgttttctcaagggtattcatgttttaacaatatgggtgtagctgaaacaggttcaattgggcttaaccatctaaccccttctcagatattgcaaatccaagctcagatccaattccagaatcaacagcaactactacaactgcatcaacaacaacagagcttaggtttgttaacacctacttcaacatattctaagaatctgaattctacgaactttcttggtatgaaaccagtcccgatgaagcaaactggtggtgcttcttcacagaaggctactaagctttatcgtggagttagacaacgccattggggtaaatgggttgctgaaattagacttcctaagaacagaaccaggctttggttaggcacttttgatacagctgaagaagctgctttggcttatgacaaagctgcttataagctaagaggagagtttgctagacttaattttccacatctaagacatcaattaaataatgaattctcgcctttacattcctccgttgatgctaaacttcaagccatttgccaaagcttggctaatcccaaatcagatgaaacttgtgtctaaatctaattccaagccaagaaagtccaaaaccgcagcagcagcagttccagtggattcaattcagctcaagaatcttcatcaaagtccgaaatcaccatagatgattcattgaaaggagaattcagctat

SEQ ID NO: 1285 - DNA, 567 bp, Poplar xylem
  Predicted polypeptide sequence is orthologous to G974
caaatcctccaaatccaagccaaaatccacttccaacaacaacagcagcagaaaatggaaaatcttgctaccaccacatcacagtttgtccataaccaaagggctagtaacttcttggctccaaaacctgtccctatgaaacaatctgctgcttctcctcaaaagccaacaaagctttatagaggagtcaggcagaggcattggggaaaatgggttgctgagattagacttccaaagaacagaactagactctggcttggcacttatgacacagctgaagaggcagctttggcttatgataatgctgcttataagctgagaggagaatatgctaggcttaactttccacatcttcgccaccagggagctcatgtgtctggtgaatttggtgattacaagcctctccattcctctgttgatgcaaagttacaagcaatttgtcaaagcctgggcttgcaaaaacaggggaaaacaagggagcccagctctgttgctaattccaaaaagactgcaacagctcctttgcaagcaaaaattgaagatgattgttctttgagaggcgaattg

SEQ ID NO: 1286 - DNA, 568 bp, Medicago truncatula
  Predicted polypeptide sequence is orthologous to G974
caaccacttgacaccatcacaaatcaaccaaatccaagtacaaatccaacaacaaaacttcaccatgcaacatcaacaaattcaacagcaacaacaacgttgtcggagtaacactttgagttttcttagtccaaagtcaattcctatgaagcatgtgggtggtagtagtgtttcaaaacccacaaagctatacagaggagtgagacaaaggcactggggaaaatgggttgctgagataagactacctaagaaccgaacaagattatggcttggtacttttgacacagctgaagaagcagctttggcttatgataaagctgcttataagctacgtggtgactttgctaggctaaattttccaaatttgaaacaccaaggttcaattattggtggtgaatttggtgagtttaaacctcttccttcttctgttgatgctaagcttcaagctatttgtgaaggtttagctgagatgcagaaacaggggaaggctgagaagcctaagaagatgccggcgtcgaaggcgaaagcctcttcaaaggtggtttctaaagagtctggtgatgatttg

SEQ ID NO: 1287 - DNA, 570 bp, Sorghum bicolor
  Predicted polypeptide sequence is orthologous to G974
tctccttccaccacgccgccgcgtccgcagaagctgtaccgcggcgtgcggcagcggcactggggcaagtgggtcgccgagatccgcctcccgcggaaccgcacccgcctctggctcggcaccttcgacaccgccgaggaagcggcgctcgcctacgaccaggccgcctaccgcctccgcggcgacgcggcgcgcctcaacttccccgacaacgccgcctcccggggcccgctccacgcctccgtcgacgccaagctccagacgctctgccagaacatcgccgcgtccaagaagggcgccaagaagcacgcctccgcctccgccgcagctgctgccgccacgtcgtcgtccgcccccaccagcaactgctcctcgtcgccgtcctccgacgacgcgtcctcgtcctgctgcctcgagtccgccgccgagtcctcgtgcccgtccccgtccccgtccgcctcccccgagtcgtcgacggtgccggagatgcagcagctggacttcagcgaggcgccgtgggacgaggccgccggcttcgcgctcaccaagtacccgtcgtacgagatcgac

SEQ ID NO: 1288 - protein, 233 aa, Oryza sativa
  Orthologous to G974
MGLTHLGPAQIQQIQAQFLAQQQQQRALAGAFLRPRGQPMKQSGSPPRAGPFAAVAGAAQSKLYRGVRQRHWGKWVAEIRLPKNRTRLWLGTFDTAEDAALAYDKAAFRLRGDLARLNFPTLRRGGAHLAGPLHASVDAKLTAICQSLATSSSKNTPAESAASAAEPESPKCSASTEGEDSVSAGSPPPPTPLSPPVPEMEKLDFTEAPWDESETFHLRKYPSWEIDWDSILS

SEQ ID NO: 1289 - protein, 279 aa, Oryza sativa
  Orthologous to G974
MYDMVVDSKELMGALAPSMVSFSYPCSEQSASSLLAGANYLTPAQVLHVQAQLQRLRRPGRRAAASPGAAAPMKRHGAVAVAAAAAARAPVKLYRGVRQRHWGKWVAEIRLPRNRTRLWLGTFDTAEEAALAYDSAAFRLRGESARLNFPELRRGGAHLGPPLHAGVDAKLHAICHGMDLPQPQPQTQSNATTTTMSTTATNTPSPFFSSESPVVKSEPVCSASESSSSADGDVSSTGSSDVVPEMQLLDFSEAPWDESESFLLHKYPSLEIDWDAILS

SEQ ID NO: 1290 - protein, 291 aa, Oryza sativa
  Orthologous to G974
MAAAIDLSGEELMRALEPFIRDASGSPPVCSQFSPTSPFSFPHAFAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 1291 - protein, 240 aa, Atriplex hortensis
  Orthologous to G974
MSYSYPPPLPSNTLNNFLSPKPVTMKTTGGPPKPTKLYRGVRQRHWGKWVAEIRLPKNRTRLWLGTFDTAEEAALAYDKAAYKLRGDFARLNFPNLRHEGSHIGGEFGEYKPLHSSVNAKLEAICESLAKQGNEKQGKSGKSKKKDVANNNNNTSSSSSSSCCTTATAAADAPQQQQRMPENGGDVKTESTSDSEVGSGGSSPLSDLTFGDNEEMGSENFLLESCPSHEIDWDAILSSES

SEQ ID NO: 1292 - DNA, 458 bp, Glycine max
  Predicted polypeptide sequence is orthologous to G975, G2583
acgagaacactctatccctcgttctttctctctctctctctctctctctctctagccagctttggttagacaacatagttctgaccaacatggtgcaatcaaggaaattcagaggtgtgaggcaacgccattggggctcttgggtttctgagattcgtcacccattattgaaaaggagggtgtggcttgggacattcgagacagctgaggaagcagcaagagcatatgatgaggcagccattttgatgagtggaagaaatgcaaaaacaaacttcccagttggtgaaaaccaaatagtgggaaatcacagttcaaacacttcctcttcctccactacaacattgtctgcagttctgagtgcgaagctgagaaagtgttgcaagtccccttcaccttccctcacttgcctgaggcttgacactgagaattcccacattggtgtgtggcagaagcgagcg

SEQ ID NO: 1293 - DNA, 514 bp, Glycine max
  Predicted polypeptide sequence is orthologous to G975, G2583
gttacatatataaataaattaacttttccttctttttttttctcttttctcttcctatctttttgttgagtgcaggaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtg

SEQ ID NO: 1294 - DNA, 867 bp, Glycine max
  Predicted polypeptide sequence is orthologous to G975, G2583
tgttttattttacatctctctctctctctctatatatatatatataatcaacaccatccactactttctcacgcgccattaacaaagatatggtacaaacaaagaagttcagaggagttaggcaacgccagtggggctcctgggtgtcagaaattcgccaccctttactgaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtggctttgcagatgattgaagaactacttaattggaactagaagaagaagaaaaaaaaaagggaaccttaatccgtgtcatatatagttcttgaatagtagtccttttttcatgctatccttttcaattcgtttacttttgtgctttctgtaaaaaaaatgtttgtcaaagtgctgatatctatatgatgatggccagtttgatagttacttatattatacactttttaagatatattgtgattgatggtaattatgcatc

SEQ ID NO: 1295 - DNA, 817 bp, Glycine max
  Predicted polypeptide sequence is orthologous to G975, G2583
aattcggctcgagcgacagaagggggtcaacactgaattcaaaatcactttcgaccatattctcttcttcttctctctctccatcatggtgcaaacaaggaagttcagaggtgtcaggcagcgccattggggttcatgggtatcggaaattcgccacccttttctcaagaggagggtgtggctaggcacgttcgaaacagcagaagaagcggcacgagcttacgaccaagccgcgatattgatgagcgggcgtaacgcgaaaaccaatttcccaatactccaaaccccggagggtgacccaaagacgacgctaacacccatcgatcacgagacctcatcatcgtcgacgaccacctcgaaggaactggaagagattcttcacgccaagctccgaaagtgcgggaagcttccgtccccttccatgacctgcctgaggctcgaccccgagaattctcacatcggagtgtggcagaagcgcgccggccagcgttccgattccaactgggtcatgatggttcctcccctcggaaaaaaaggtggtgctaatgaaggaggtactggaggagatgcttcttgttctaactcctttccgttctccgagtgcgatccgaccccgcaagtggcaaggcaggagcttctgaggacggagatggacgaggaagaaagaattgcgctgcaaatgatagaagaactcctcagcaggaactgccccactagcccttcattcaataacttatattaattaagggaaatgtttcctgaagaaggataattctattcagtttctttaagggtctttagagataaattatgctgg

SEQ ID NO: 1296 - DNA, 1128 bp, Glycine max
  Predicted polypeptide sequence is orthologous to G975, G2583
ttttttttttttttaactgaaaatatatttattatttatgataaataaaccatgaacgtttcaaacaagcagcagacgatagggcctttacatatgaactctgaaaataatattctgtatacatctctcttattttcttatgtatattttcctatgcatgcatgtaatatgtatgtgtatatatatattatctacacttataataaatatgacatacatgaaaacagatatgatatgatagatatgatgtggttatatataattagcctataactaccacttccctttttttcccaaataatgacaacccttgttgaagatgaagattaaacatgcatgtgaataccataacgctgtgtggaaaaaagaagcttaaagaaaaaagtggtcatgatcagcaccatccctttcttgaatgttgttgttaaatgatgggctagggcagtttctgtcgttgaggagttcctcaatcatctgaagggcaattctctcctcttcgtcaatctctcctctcacaacttcttgatgatgaagattacctgtcacagccagtgatggagactcaatgtggtgatgttcagaagaaggtagagaagaagaaagagaactactactgctactatcagcttgatgatgagtgtcattattattaacattaacactcttctttcccagttgaaccgtcatgacccaatttgaatcagaacgcctcccagcacgtttttgccacactccgatgtgggagttctccgggtcaagcctcaaacaagtcatagaaggtgaaggtaccttcccacattttcgaagctttgcatgtaagatttcctccagatccttcgaggtggtggagggagtgtcctcactggtagtgctctttggatcaccttctggagtttgagttattgggaaattggtcttggcatttctcccactcatcagaatcgcagcttgatcataggctctagcagcttcttctgctgtttcaaatgtccctagccacacccttctcttcagaagcgggtggcgaatttcggatacccatgaaccccaatggcgttgcctgacacctctgaacttctttgattgcaccatgatgttgttagagtttgttaattgctcgagccgaat

SEQ ID NO: 1297 - DNA, 479 bp, Oryza sativa
  Predicted polypeptide sequence is orthologous to G975
cggcacgaggggaggatgctcactgtctgactgactgactggctgctgctgctgctcattccttctcctactctgcctgcctcctctgctgtgtccctgggagaattcttcagggacagtatccctgcagaggtgagatcatgggacagtcgaagaagaagttccgcggaggcaggcagcgccactggggctcctgggtctccgagatcaggcaccctctccttaagaggagggtgtggctgggtacctttgagacggcggaggaggcggcgcgggcgtacgatgaggccgccatcctgatgagcggccgcaacgccgagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctc

SEQ ID NO: 1298 - DNA, 438 bp, Oryza sativa
  Predicted polypeptide sequence is orthologous to G975, G2583
ctgcaggaattcggcacgaggctcctccgttcagttcagaggcgcctagcaatagcagctcattgcctcatctctgcctcccctgtccttctgggggcagagaatctctccactgctggaaaaatggtacagccaaagaagaagtttcgtggagtcaggcagcggcactggggctcctgggtctctgagatcagacaccccctccttaaaaggagggtgtggctgggcacctttgagacggccgaggaggctgcgcgagcctacgatgaggctgctgtgctgatgagtggccgcaacgccaagaccaacttccccgtgcagaggaactccaccggtgatctcgccacggccgcagaccgggacgcccgtagcaatggcggtagcaggaactcctccgcgggcaacctgtcacagattctcagtgctaagctccgcaag

SEQ ID NO: 1299 - DNA, 434 bp, Zea mays
  Predicted polypeptide sequence is orthologous to G975, G2583
tctgaggacggcggcctcgtcgtacgcccgcgccgcctcctctgccgtctcgaaggtgcccagccacaccctcctcttactgcatattcgattcaagcatgcatgcccaccacgccgccatcgtcagaacgcatggcgaaagagaaagaccgaggcatctactactactactagagagcagcgtggctagctagtagagctgagggaagaagatctagcatggggggccaccagtttcttacagcagcgggtgcctgatctcggagacccaggagccccagtggcgctgcctgacgccgcggaacttcttctttgattgcaccatgatgcctgcagatccccgcgctctgcagggcagggacgggccggccggcaagcactgcagattctctgccaggggaaggaaggaaggagtgagcagcagtccagtcagt

SEQ ID NO: 1300 - DNA, 1039 bp, Zea mays
  Predicted polypeptide sequence is orthologous to G975, G2583
attgggtacctcgaggccggccgggcacacggccccacacacttcacttcataggcgccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctcaaaaaaaaaaaaaaaaaaggccccta

SEQ ID NO: 1301 - DNA, 334 bp, Brassica rapa
  Predicted polypeptide sequence is orthologous to G975, G2583
tctggcagaaacgcgccggttcaaaatctgattctagttgggtcatgacggtggagctcggtccctccggctcagtggagctcagtccctccgggtcctcccaggagccaactagtactacagcttcaaaagacgatgttgttggaccggccactgaggttggtggcggcggagaagaaggattaatggatgaggaagagaaggttgctttgcagatgatagaggagcttctcaatacaaactaagtatcatttcttatatttatactaatatacctatttttattgctgatatacagccataatttatccgtttatacctttatattttacat

SEQ ID NO: 1302 - protein, 243 aa, Oryza sativa
  Orthologous to G975, G2583
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 1303 - DNA, 1410 bp, Glycine max
  Predicted polypeptide sequence is orthologous to G979
tcaccatccatctttgttctttctcgtgcatggtgcaaccttctccatggccaaaaaatcacagctgcgtacccagaaaaacaatgttaccaccaatgacgataataatcttaacgtaaccaacactgtgaccaccaaggtgaaacgaacaaggagaagtgtccctagagactccccacctcaacgcagctcaatataccgaggagtcactaggcaccgatggacaggccgatacgaagctcatttgtgggacaaacattgctggaatgaatcacagaacaaaaaagggcgacaagtctaccttggcgcttatgacaatgaagaggcagcagcacatgcttatgatctagcagcactgaaatactggggtcaagataccattcttaattttccgttatcaaactacctgaacgaactgaaagaaatggagggtcaatcacgggaggagtatatcggatcgctgaggaggaaaagcagtggtttttctcggggaatttctaaatacagaggtgttgcaaggcatcatcataacggaaggtgggaggctcggattggcaaagtttttggcaataaatatctttacctcggaacttatgctacccaagaagaagctgctactgcctatgacctggcagccatagaataccgtggactcaatgctgtcaccaatttcgatctcagccgttacattaagtggcttaagcctaacaacaacaccaacaacgttatcgacgaccagattagtattaatctcactaacataaacaataataataattgcactaacagcttcaccccaagtcctgatcaagaacaagaagctagcttcttccacaacaaagattcactcaataatactattgtagaagaagtcacgttggtgccacatcagcctcgtccagcgagtgccacgtcagcattggagcttctacttcagtcatcaaagttcaaggaaatgatggagatgacatctgtggccaatctttcttcaacacagatggaatctgagttgccacagtgcacatttcctgatcacattcagacgtactttgagtatgaagattccaatagatatgaggaaggagatgatctcatgttcaagttcaacgagttcagctccattgtgccgttttaccaatgtgacgagttcgagagttgaagaagtcaggtttatataatgcatggaaaaaagaaactctgatatgtttgtttatttgtttaatttgttgattatgttaaagaccatattcataaatctttagctaattaaggtttaagtttttagaagagagatcatgtcattcacaactattataataagtggacttgttttcaatttgtgaacatgaaagtttattctttttatagcaacgtcgtcattaatcacataaaaatgaatattaatgcggc

SEQ ID NO: 1304 - DNA, 4176 bp, Glycine max
  Predicted polypeptide sequence is orthologous to G979
gccctttttttttttttttttttttttttttttttttttttttttttcaacatctttcatattcatcccgtctaatcctctgtgtctcattcctatatttcaatttactttcatataataagcttatataaatatattattttcttatacaaacattttttgttttcaatttttattaattcttatttttctttatcttgttaaaagtttaacttattattcaaatttcattttttcttttggatggattttggttgacaacgtcagtgatcccagtgaaagcaatacctcgccggtgggagagttgtacttgtccttattatcggagccctgctcattgctgagcccaatatatctccacaactattaacctacctacgcaacttgtctttgaataatttaagaggaaaaaaaaaaccacacttattaatttctttttattttatcctttttcacggctcttcatggcttcatcttaccacacttatcctatatatatatatatatataggataagatcatctcacaccaagtataagtttcatgacttacacaaaatctcagccattaatctaagtaaatccaacaaatcataatatttaaacaaaataaaaataaaaaatatgaaaaagtaatcacgtgagttaagactcttcctgtgtgtaaattttgaagattaatgagttagcttttcataaaataaaataaaaaactgtttgggggtttaatcccttaaacacatcaatcacctcgtcaaaagacagtaatttgtcgcttgaataaggattaatgctgttatgattggtaattacatatacaagtttttttttataaaaaaagacaaacaagtatagttaaaaatgaaaattaatgttaaagtaacatgaaaatgtgttagctttagtgcgcctgtgtgtaaattaatgttaaagtgacatgaaactatgttagttttgttttgggtttgattccgtaaacacatcaattatttcgttgcaaatttgcataaaaagacaaaatgtgtttgtaatacaattgtgggaggcaaaaatttaaaattaatcgtgatcatatgactaattaagaaatgaaaaaaaataattatatgttaataatataaaataattttatattatcattcaataaaaaattattatttaggataaattattaattttaataaaattatcttaaaaattatatcaataataatttacaattaaatgacacacaaaatatcatcattaaacatttaaaaaatatttttattaatctttaaaacttaacaaattaaatatgatttaataatttaacatttatctttaaaaaaatattattcttattgcttataataactaaatgttgtgacatctacccacgcttgtggagacatacataataaaactaaattgttaaaatgaggcagttgtacttgtatgccatgcatcttgttctatcgcaaataaaatgatccaatccctcttccccccttgtatgttacttttaaagaatcttccactcgatctctaaaatgtttactcttaccccctaatttctttatcatcttttttggttgattacccccttttgaaaaataacgtattggccagaagaagtcctccaattctaaacatcaagctcgtaatgaaaaattggtgcaccaaaggagcccaggtcaccaaaaatgatatcatcattttcagtgtagatgcctgaatcttgattttcaaaaattgtttgaatgtcttcagggaatgtgcgacgagaaggatttgattctgaagatggtgctacaccctcttctgtgatctcatcactagccgaacctagctcaagttcagcattagagtttacattttcattgctaggaatagtttgatgattttcttctgttttaggacgtggccaattgatataacggctcaggtcaaagtttgtaaccgcgttaagtcctctgtattctattgctgccatgtcatatgctgcggctgcttcttcttgtgtagctacaatacgacataataacatatggacacacacatgtaagcaaatttaattgtattattgtttgcatatgtcggtctaggatttctctttttcttcttccgatttggtttatattaaaatgactagaaaagaatgatatcattattaaatagctctattaagcagttgaagtttggtgatctatatcacaaccaatatgatctgattgcatatgttgacctttatatttgtcctactattttgatccgcgggaccatgttgaaaccaagtaggtactttcttgttagaaccggaaagaatggtcaaatacattttcaaaatttcaggtatgggtacatcctctcttaattaattaaacatcgctacacctatattagctactttatttcgtttatattcaaccaatacataaacatacaatttaatttgttcattatttagagtgctgacataggcccatatcacatgcatgttttataattcgtagcaaatataaccaaatataaatgatgataatgaaatgctatatatgaaccatgtaaatgcattcaaatgctaaggtaaggccatatgcttctgtctaagagaattgtacatcaaatgcatagaaaatgaccttttgattaggattttaaaaaacatttcgtcccctgaactatataattgacaaattatatgtatagacgcacactttaaaatcacatattcaatttttttttaaaaaataactaacaatattcttattttgagacatcttgagatttgaataacaataatataatgcaggaaaattacttttcaaaactgttaataatatatttctgtacacatttttttattatataaattttagaaataaatgtaattatggtccctattttattttattcatattttaaaattgaaacatgtagtacttttgttttaaaaaatatacaattttagtctttcccgttttaaaatagatatttagtcttcttattttaaaaaattgtaattttgatcaaattctcaattttatcaatgttttatttttttcttttggtccaattgaattataaatctaatatattcatttaaggtatcatcaaaatttgatttaattagttacaaaataagaaataaaagaaataaagcatatacaaaattaaagattaaattaaaattatagattttctaaaaaaggaaaccagaatcgtcaattttttaaaatataaaaattaaatatttatattttgaaatagaaaaaccaaaattacaaattttttaaaataagaaaaataaatgttttaattttaaaatagaaaaattaaaattatgaattgactaaaattacatttaatcctaaattttatgtgagtcacactcaatgatataaatttattctttatttaacgaaattcacataaaatttcaataagaagtagcatccatctatgcatgcgctttctttacattagatcatagacaatgaaattaccgtaagttccaaggtatagatatttgttgccaaagacccttccaattcgagcttcccatcttccgttatggtggtgtcttgctacgcctctgtattttgaaactcctcgagagaatccactgctttttcttctcaaggatccaatatattcttcttttgactggccctccatctccttgagcttttcctcataatttgataatggaaaattgagaatggtatcttggccccagtacttcaatgctgccaagtcataggcacgtgctgcggcttcttcatcatcatatgcccctagcaaacccaagtttattgcaatcattaaatcgtcccccatccgccaatttaaggggaacaaataatgaaggtttttgttatatatgcaagctaattaattaatactctcaaatcatacctagatatactgcatccagttgttttccatagccattttcaaccaacccaacataattaatatgacaataaatcaaataatcatataagtgaaggaaatcagaaatctatatggagattatagagagcaaaataatgaagagccttgtcttcctttcttgctctgtgattcattccagcaattcttatcccacaaatgagcctcatatcgaccagtccatcgatgcctaaaacaatcacatgcacatatttgagcccacgcgtccgcggacgcgtgg

SEQ ID NO: 1305 - DNA, 684 bp, Glycine max
  Predicted polypeptide sequence is orthologous to G979
accacaatggtatgttctaaaaacatttcgtacactcgtgtgtgtatatatatattcgtgcacgccccactttctgaattcaacaaagatatcaatggtttattttgttgaccatgatgatctaccgtaaaacagattgaaaaattgcaaaacctagcattttgcagtgaacagagcagggttcaagtaccttgctacgcctctgtattttgaaactcctcgagagaacccactgctttttcttcgcaaggatccaatatattcttcttttgactggccttccatctccttgagcttctcctcataatttgataatggaaaattgagaatggtatcttggccccagtacttcaatgctgccaagtcataggcacgtgctgcggcttcttcatcatcatatgcccctagatatactgcatccagttgttttccattgccattgtcaaccaacccaagataattaatatgacaataaatcatataaagcgaaggaaatcaggaaaattaaactaaagattatagagagcaaaataatgaaaaccttgtcttcctttcttgctctgtgattcattccagcaattcttatcccacaaatgagcctcgtatcgaccagtccatcgatgccttgtgacacccctatagattgagcttcgttgaggaggtgagtctcttctcgagccgaat

SEQ ID NO: 1306 - DNA, 926 bp, Oryza sativa
  Predicted polypeptide sequence is orthologous to G979
tggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaagggcgagaccgccgccgcgagcagcgacgactctagctccggcgtctgcggcggcggcggcggcggcagcggcgaggttgagccgaggcggcggcagaagcggccgcggaggagcgccccgcgggattgcccctcccagcgcagctccgcgttccgcggcgtcacacggcaccggtggacggggcggttcgaggcgcatctctcgcgcgggaacacctggaacgagtcgcagagcaagaagggcagacaagtttacctcggggcttacgacggcgaggaagcggcggcgcgcgcctacgacctcgccgcattgaagtactggggccacgacaccgtcctcaacttccctctgtcaacatatgacgaggaattgaaggaaatggaggggcagtccagggaagagtacatcggatcgctccggaggaagagcagtggcttctcaagaggggtgtccaagtacagaggagttgcaaggcatcatcacaacggcaaatgggaggctcggattgggcgtgtgttcggcaacaaatacctctatctaggtacttatgcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgc

SEQ ID NO: 1307 - DNA, 651 bp, Zea mays
  Predicted polypeptide sequence is orthologous to G979
aggataactttggcgacacatagctctcggaattcgattcagatcaagtaaggcggacaggcttatctgggagcatatgacagtgaagaagcagcagcacatacgtacgatctggctgctctcaagtactggggacccgacaccatcttgaattttccggcagagacgtacacaaaggaattggaagaaatgcattttgtgtctgtggaagaatctttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgtcatttctgcgattgagtatcgaggcgcaaacgcggttactaatttcgacattaggtaattacattgaccggttaaagaagaaaggtgttttcccgttccctgtgaaccaagctaaccatcaagagggtattcttgttgaagccaaacaagaagttgaaacgagagatgcgaaggaagagcctagagaagaagtgaaacaacagtacgtggaagaaccaccgcaagaagaaagaggagacggaagaagagaaagcagagc

SEQ ID NO: 1308 - DNA, 670 bp, Zea mays
  Predicted polypeptide sequence is orthologous to G979
cgcatggttcctcttccgctgctgccgtcctgcgatcgaccgggttggcgggcggtccggcgcgtgcctgcagtttatctcggcgcgtacgacgacgaggacgcggaggagcgcgcgcacgacctggcggagctcaagtactggggccccgccggcaccgtcctcaacttcccgctgagcggctacgacgaggagcggagggagatggaggggcagccccgggaggagtacgtcgcgtcgctgcggcggcggatcagcggcttcgcgcgaggggtgtccaagtacaggggcgttgccaggcatcatcacaacgggagatgggaggcgaggatcgggcgcgtgttaggcaacaagtacctctatctcggcacttacgcaacacaagaggaggcggcagtggcgtatgacatggcggctatagaacaccgcggcttcaacgcggtcaccaacttcgacatcagccattacatcaaccactggcatcgacattgccatggcccctgcgacggcagcctcggcgcgatggacgtcgcaccgaacgtctcgctcgaactagacctactcgagtgcccagtcaccgtccggctcagcctcgaggagaccacgggcgacgatgaattccacaaccgcgaggactacctggggcaccttttcggcgtgcagcagcttc

SEQ ID NO: 1309 - DNA, 2042 bp, Zea mays
  Predicted polypeptide sequence is orthologous to G979
tcaacaactatctcaacaagttcagatgatgcagggaatggtgatgcaggtaataattttagtaatccgctcaaaatttgcccaatctcagaatttgcccatatttttttatctaactcgctctgagccttagacaacccaaaatcggtctggtcaacgttgagtgatttctgcatttattaggaggttgtcacagcctgtgatatgaacatacatactatggtgatatgaacatacatactatgtagtcatatgtatgaagaaaaaaaatagacaatgtttttttttcctcagagtaaatatagaatggtgaaaacaaaggttccttaatctggagcttactagggttacagccttggtaaactgttcaaacgaacaaatctatgctgcactggctgcgttaccatgatcatgccatgtaaactcagtgataaactgcacaagcacaaccacttcagattcaggatgtgattagttgaatctaggctaagtgagacaatgacaaacccttaacgttagccaagcagcctaggggcaaattcaaagaattaaagaacatcgacacacttgtctaacgccaaactgccatgggctttctacaagaaagttctcagctgctctggtgcagtggcactgtggcattagacagatcaaggattacccaagacaggacacctggaaagcgaaaacctcctcgggttccagaattagttgcacacactgatcatcgctggaggttgtatcccctcttccatatccgaaagaacatccttcagctggacatcacctgcctcaaacagactgaaatctgccagacctacaccatccttgcttccttcgtcagccgcagaacacccatcgaacaggcatccgatgttgcagtcgaagtctgcgtcagcgaaccactcgctcagattgattgagctgccaaagtttggtctcgacatggtgtctagctcgtaatccatgcaagggctccacaagccctcttcgatgctgtcgtcgactgtggtgaggggctccgcggtgtcgtcaggcaccgcgttctcatcgggttctgcactgccatccggtgtcttggcttcgcttgactccggctcttgctctgtagttccggtttcgctctgatcaggttgaggttcttggttgagtgccggcaccacctgtggctcctgttggagctgtgccaggaacagcgggtggtccaggtagcagctgatgtcgaagttggttacagcattgacgccacggtattcaatggccgcaaggtcataggccttggctgcctcttcttgagtgtcaaatgttcccaagtagaggtacttgttcccaaagactcgcccaatccgtgcctcccacctcccgttgtggtgatgcctggcgacgcctctgtacttggagacgcccctggagaagccgctgctcctgcggcggagggaggccaggtactcctcccgggacacggcctccatctccggcatctcgctggagtaatcctccacagggaagttgagcagagtctcaggaccccagtacttgagagctgcgaggtcataggcacgagcagctgcctcctcgctgtcatacgcccccaggtagacttgcctgcctttcttcttgttgtggagcgcggcgaggcagtgcttgtcccagagatgcgcctcgaacctgcccgtccacctgtgcctggtgactcccctgtagacggagctcctctccccggcggcgggaggaggatcagaggggtccttgcgggccctcttattaggctcggcgccggccttggccgtcgccgccctccgccgcctctttcccggagggacgaggacggtgtccgcggagacgcaggacgaggaggacgacggcgacggtggcggaggagactgccgttgagatctctccatgtccgtggtctccgtcccccctcctcctcgatgaacggtggtggtgcagcgcggacgcggttgtgcaggggagccgagtggtgaatctgacctggcggcgaggcgggggaggagcccggccggcctcgaggtacccaa

SEQ ID NO: 1310 - protein, 426 aa, Oryza sativa
  Orthologous to G979
MVSMRKKKKAFAVAAATTLLSPPRSSSSSSSTASSCIVPPRTESGKKKSKHRKRAKDGTGGDDDDAAVAAAPRKGSSIYKGVARHRGSGKYEAHLWDKQGWNPNQTRKRGRQGAYDTEEAAARTYDLAALKIWGSDHVLNFPIDTYRKELERMQRMTREEYLATLRRKSSGFSRGVSKYRGVAKHHHNGRWEARIGRAVGKKYLYLGTFDTQEEAATAYDLAAIQLRGRSAVTNFDASCYTYTDHLPPPPPPQPPSVCKTEPELEPPQPAAPPGSESLLRPKMEPCDDWEPPAICPSLRDADDADHAIAEILPALCMDRADFEARYPARRARDAAADGWSTSSDDVAAASVDDDVLRSLPDDVGFVDDVESLFLDAPGPAAAAAAAAMPDDVERAVQRAPSAASRRANAAAVSYAISSLASGRWWY

SEQ ID NO: 1311 - protein, 443 aa, Oryza sativa
  Orthologous to G979
MAKRSSPDPASSSPSASSSPSSPSSSSSEDSSSPMSMPCKRRARPRTEKSTGKAKRPKKESKEVADPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGMAEYNLFEECNMLEKDISDFLDKDISDFLDKDISISDRERISPQANNISCPQKMISVCN

SEQ ID NO: 1312 - protein, 429 aa, Oryza sativa
  Orthologous to G979
MVSMRKKKKAFAVAAATTLLSPPRSSSSSSSSTASSCIVPPRTESGKKKSKHRKRAKDGTGGDDDAAAVAAAPRKGSSIYKGVARHRGSGKYEAHLWDKQGWNPNQTRKRGRQGAYDTEEAAARTYDLAALKIWGSDHVLNFPIDTYRKELERMQRMTREEYLATLRRKSSGFSRGVSKYRGVAKHHHNGRWEARIGRAVGKKYLYLGTFDTQEEAATAYDLAAIQLRGRSAVTNFDASCYTYTDHLPPPPPPQPPSVCKTEPELEPPQPAAPPGSESLLRPKMEPCDDWEPPAICPSLRDADDADHAIAEILPALCMDRADFEARYPARRARDAAADGWSTSSDDVAAASVDDDVLRSLPDDVGFVDDVESLFLDAPGPAAAAAAAAAPMPDDVERAVQRAPSAASRRANAAAVSYAISSLASGRWWY

SEQ ID NO: 1313 - protein, 399 aa, Oryza sativa
  Orthologous to G979
METYGLVKDELLHGIGGGQGRLYCEVKPTAAPAVITAAGGGAKSVKRRKREPSAAAMSAVTVAGNGKEAGGSNAANKRSSRFRGVSRHRWTGRFEAHLWDKGTWNPTQKKKGKQVYLGAYNEEDAAARAYDLAALKYWGPTTYTNFPVADYEKELKLMQGVSKEEYLASIRRKSNGFSRGVSKYRGVARHHHNGRWEARIGRVFGNKYLYLGTYSTQEEAARAYDIAAIEYRGINAVTNFDLSTYIRWLKPPSSSSAAGTPHHHGGGMVVGADRVLAPAQSYPISAAADDDVAGCWRPLPSPSSSTTTALSLLLRSSMFQELVARQPVVEGDDGQLAVVSGDDADADADSDVKEPPPESEYGEVFASDEAAAAAAYGCSMYELDDSFALIDDSVWNCLI

SEQ ID NO: 1314 - protein, 416 aa, Oryza sativa
  Orthologous to G979
MAKRRSNGETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 1315 - DNA, 1182 bp, Glycine max
  Predicted polypeptide sequence is orthologous to G987
  misc_feature (1175)..(1175): n is a, c, g, or t
  misc_feature (1177)..(1177): n is a, c, g, or t
gattttggcatccgttatggcttccagtggccagctcttatttatcgtctatcaaaacaacccggtgggcctcccaagctgcgcattacagggatagagctcccacaacctggtttcaggccagcagagagagtccaggagacggggcttcgacttacaaggtattgtgatcgctttaatgttccatttgagttcaatgccattgcacagaaatgggaaactatcaaaattgaggacttgaagataaaggaaaatgaacttcttgttgcgaatgctatgtttcgatttcaaaatctacttgatgagacagttgtggtgaatagtccccgggatgctgttttaaagttaataaggaaggcaaatcctgctatctttttacatgctaatgtcaatgggagctataatgctccattctttgtgacacggttccgggaggcccttttccattattctactttgtttgatgtgcttgataccaatgttgcttgtgaagatccaatgaggttgatgtttgagagagagttctttgggcggcaggtaatgaatattgtagcttgtgagggttgtgagagggttgagaggcctgagacatacaagcaatggcaggttaggaacatgagagctggatttaaacaattgcccttggataaacatctcattaacaaattaagatgcaagttgaaagatgcgtaccacagtgatttcatgcttcttgaagatgacaactacatgctgcaaggttggaagggccgagtagtttatgcttcctcctgttgggtgcctgcataggccttgacaatgttcttcccaaggtagttaattaggagaagcgtttcatgagttgtaggggagacatggacttccaaaattcttgtggttgacatattctagaagctgatccctgctaatgtaatgacatagcatagttcaatttcagttctcagaatatttttaaattggtcaagtcataagtgtgtgtataatataactgataactggtgctgtgtggatgacatatttcaatgttgaacaattccttcttgagttcttctgataggcactcatgagcagcagaatcctgagattgtgagattttaggtctaaaatttgaactggtttctaagtttgtatattaagttaatattttattctgttcaattaattatttagttaananaaaaa

SEQ ID NO: 1316 - DNA, 1741 bp, Glycine max
  Predicted polypeptide sequence is orthologous to G987
atggaggtaagggtcgttcaaagaaacaagggatcaggaagaaggaaacggtggatttgaggaatcttctattgatgtgttcacaatctgtgtatcccagtgacatcagggctgccaatgaattgctaaagcagattaggcaacactcttctcccattggggatgcatcacagaggttggctcattactttgccaatggcctcgaggcacgcttggttggggatggtacaagtacccaaggaatgtatacttttctgagctctaagaacaacactttttctgagttactcaaggcataccaggttttcagttcctccagccctttcaagaagtttgcatatttatttgaaaatacaatgattatgaaagcagctgcaagtgcagaaaccgtccatattattgattttggcatcctacacggtttccagtggccaatgctcattaggcttttgtcaaatagggagggtggacctcccaagcttaggatcacagggatagagtttccccaacctggctttcgtcccacagaaaaaattgaggaaacgggtcgccacctggctaactattgtaagcgttacaatgttccctttgagtataatgccatatcatcaaggaactgggaaaccattcagcttgaagccctcaaaattgcaagcaatgagctagttgctgtctactgtcaccaggggtttgagaatttactggatgagtgtactattgaagtgaacagtcctagaaatgcagtcctgcatttgatcaggaagataaatccggatatttttactcactccatcactaacggatcatataatgcccctttctttaccacgcggtttagggaggctctctttcattattctgccatttctgataagaatgacactgtcatatctcgtgaaaacgaaaggaggttgatggttgagagagagctctatggcagggagattatgaatgttatagcatgtgaaggttctgacaggattgagaggcctgagacctacaaacggtggcaggttaggaatatgaaggctggtttcaagcagctaccactgaatgaggaattaatggccaaatttaggagtaagttaaaggaataccacagagattttgtcttagatgaaaataacaactggatgcttcaaggttggaagggccgcattttgtttgcttcctcttgttgggtgccggcataatgagatgctactgtgactcggttcagaattcatactatactaaaggtatgattccaagaatcagtcattggctttaactctatccacttctttttttccctggttctgatattcttggtctggctacctacttactctaccttcagcttttgtgatgaagattgtaccaagctttgcaccaagttccttggtaaaattatagcatcacttttctggtagattaagacttgtgaaggtaatacaatttcgttagtgatattgataagaagggcatattagtcatcagagtaggagggccattatagcatgtttgcccaagtacttgcaatcctattattgagttattttctctttaaccaacatgtatcaggcatttcacgtccttctatttaagtttgttaatttcttttacaggatacttgtcttttgagacaaattagttgagaagatgtgattaatttgaaacagatgatgactatgttccgtttgttttttccggtgatattcttgcttgcagttttgtatttctatatatagcaacttatgtg

SEQ ID NO: 1317 - DNA, 1023 bp, Glycine max
  Predicted polypeptide sequence is orthologous to G987
gaattcccgggtcgacccacgcgtccggccatagcatcgcgaaactgggaaaccattcaaattgaagacctcaaaattgagcgcaatgagctgcttgctgtgaactgtctggtaaggtttaagaatttgcttgacgagtcaattgaagtgaacagtcccagaaatgctgttctgaatttaatcaggaagatgaaaccagatatttttgttcacagcgtagtaaatggatcttataatgctcctttctttctcacacgcttcagggaggcactgttccattattcttcaatttacgatatgtttgatactctcatatcccgtgaaaatgaatggaggttgatgcttgagagagaatttttgggccgggagataatgaatgtggtagcatgtgaagctcttgagagggttgagaggcctgagacatacaaacaatggcaggctaggaatactagagctggttttaagcagctcccactggataaggagataatgaccaaatttaggggcaaattaagggaatggtaccacagggattttgtctttgatgaagatggaaactggatgcttcaaggttggaagggtcgcattttgtatgcttcaacttgttgggtgccagcataatgatgtgtgtgactcaactcttgtttcagaattcatactggatggaaggtcaccttcgctgttgtgaactgtgatgaatattcttcccaggtttgcaccaagtgaccctgtataatagtgccagaatttttcccagattagcattaaatcctacaatgacatggacgcgaacattaggagtcaaaattgttatttacgatgcttttccttttcttttcactctctaaccggcatgtactataggcacttcaggatcctaagaagtacttagtaaattggttaaaaggttttttcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccg

SEQ ID NO: 1318 - DNA, 1055 bp, Glycine max
  Predicted polypeptide sequence is orthologous to G987
gaattcggctcgagattcaatttgcaacctaagtgaggatgcaaaaacaattcacatcatagactttggcatccgctatggcttcaaatggcctgcacttatcagccgtctatcaagacgccctggtgggccacccaaacttcggatcacggggatagatgtgccacaacctggtttaagaccacaagagagggtgctcgaaacagggcgcagacttgcaaattattgcaagcgtttcaatcttccatttgagttccatgctattgcacagagatgggacaccatcagagttgaggacctcaagatagaaacagacgaatttgtggctgtgaactgcttgtttcagtttgagcatctacttgacgagaccgtggtgttgaataatcccagggatgctgttctgaggttgattaagaatgcaaatccagacatatttgtgcatggcattgtcaacggatcctatgatgtaccattctttgtgtcacggttccgggaggctctctttcattacactgcattgtttgacatgcttgacaccaacgttgctcgtcaagatcccatgaggttgatgtttgagaaggagttgtttggacgggagatagtgaacatcatagcttgcgaaggttttgagagggttgagagaccacaaacatacaagcaatggcagcttcggaacatgagaaatgggtttaggctgcttcctctggatcatcgaatcattggcaaattaaaggataggttgagagatgatgcgcacaacaataatttcttgcttgaggttgatggcgactgggtgctacaaggttggaagggtcgaattctatatgcttcctcttgttgggtacctgcatagcataggccttgaacattatttattccagattacaaaaatctagtcttacacacaactattagtacgtctccttcaatctccctagctcatttgttgttttttatgataaggaaaaaccaaagttatagttagtttctttcaatgtgtagtttgtttagtacttacatatctaacaaattcagcaaatacaattgagagccgc

SEQ ID NO: 1319 - DNA, 2281 bp, Glycine max
  Predicted polypeptide sequence is orthologous to G987
gggaatgattcaccacttgtaacataaacgagaaaataaagtttagagtacagcagtgagcattaagcaaatgaagatttataataactaccaacttctttctatgttgctcctaggcatcactagaaaactagtacattaatgtggatattagatatccttctaaaatcagtgatttcagaggagtttaagtcttctactcttgttcataaaagtgcacatataagagggtattttcactattcaaatagaaacaaaatatgatcatgattcacttctattcaaggataaatatacccttagtgcaccttacacctaaaacaattttccttgccaatgagtgggttaggagttggtcattcctcaagcaggaacccaagaggaaacagcaaaaagaattcgccctttccatccttgcaaaacccacttgccatcctcatcaaccacaaaatctttatgatgttccttcttcaccatttccttcactctattcacatgctctggggccaatggaagttgcttgaaccctgctctctggttcctaacttgccactgcttgtaggtttctggcctttcaaccctctctgccccctcacatgctatcacattgattgcatcccttccgaacacccctttctcaatcataagcctagatggatcttcacgaggcacgttaacttcaaacatgtcaaacaatgatgagaagtggaagagtgcttccctgaaccttgtcacgaaaaatggtgcattgtaagtgccattgacgaccccgtgcatgaagatgtttggattgatcctcctgatcaacctcagcaaagcatctcttggacagtttgcagtcacggtttcatcggaaaggttcttcaatctgtacaaacagttaaccacagttacttcactcctatcaattttgaggtcttcaagtcttatagtctcccatttttgtgcaaggcaattgtactcaaatgggactccaaacctcttgcagtacttctccagccaccgccctgtctcctcaaccctttccgccggcctaaatcccggctggggaagatcaattcccatcatacgaagctttggaggcccgcccggcctctctgaaagccgttggatgaggcaaggccactggaaaccatagctaatcccaaagtcaataatgtgaagactgctttcattttgcgctagcttcagaatagtgcggtttgccaagaaattagacatccttagaaatggtgatgccgagatatacactcggtatgctttcaacatatctgcggcagatgctgactgaaaggaaatgaactttggtgtcccagcagctaaccgtttctcgaggccatcggcgaagtaatgagccaaacgctgaagtccatcgccaaaaggtgaagagtgctgcctaatctgcttcagtgtttcatttgcagtcctttggtcaaagctagccacagcctgtgcacattgaattagcaaagtccataaatccaccgtcgtcacgcttgcccttgtccccttattggaacctctctttgatcgtgttttcttcccattagatcctcctgagtcagcaatctgcgatggtgatggttcacggccagcataaaaaatggatggactcttaccatccttacaaagcagcacctcatcaaacatgctagatggctccgaatcatcggagtagacagaagaaagcttgttgcttctctctcttcttcatgtgacatatcattcatgagataactcctcttctccctcaatcctgtggctgttacagaaccctgcatcacaccatcctcaatcacacgcggcttgttctgtgggtgaatcaaattccaggctccatttgaaaaatggaccccagcttgtgtctctctaaacggatcaggagctacatatgcgtgttccggagaatcaattagagatctttgtaggaaagaggaatccaagtcactagcaccgttaaaccaatcagactcgcatgaattatcagtggtataactgctaaaactctcagaactagtagttccaccaaaattatcatctgggtcaggattatcattaaattgaccagttgatgaagggtaactacgaaccaatgcatcatagaatgatttttcagcagcctgaagtctcaaacaatcctgcaacatgcagggttttcgctccaaatcaacttcttcatccatgaggatgtcactaatgtatctgagaatgggattggagtgcttagtactctctgcatgttctccattcgagcttgtcccagaagaaggaccagaatcag

SEQ ID NO: 1320 - DNA, 723 bp, Glycine max
  Predicted polypeptide sequence is orthologous to G987
ccacgcgtccgacggctttcagagaggccaggcgggcctccaaagcttcttatgacaggaattgatcttccccagccgggatttaggccggcggaaagggttgaggagacggggcggtggctggagaagtactgcaagaggtttggagtcccatttgagtacaattgccttgcacagaaatgggagactataagacttgaggacctcaaaattgataggagtgaagtaactgtggttaactgtttgtacagattgaagaacctttccgatgaaaccgtgactgcaaactgtccaaaggatcaatccaaacatcttcatgcacggggtcgtcaatggcacttacaatgcaccatttttcgtgacaaggttcagggaagcactcttccacttctcatcattgtttgacatgtttgaagttaacgtgcctcgtgaagatccatctaggcttatgattgagaaaggggtgttcggaagggatgcaatcaatgtgatagcatgtgagggggcagagagggttgaaaggccagaaacctacaagcagtggcaagttaggaaccagagagcagggttcaagcaacttccattggccccagagcatgtgaatagagtgaaggaaatggtgaagaaagacatcataaagattttgtggttgatgaggatggcaagtggggtttgcaaggatggaaagggcgaattctttttggctgtttctcttgggttcct

SEQ ID NO: 1321 - DNA, 941 bp, Oryza sativa
  Predicted polypeptide sequence is orthologous to G987
  misc_feature (789)..(789): n is a, c, g, or t
  misc_feature (794)..(794): n is a, c, g, or t
  misc_feature (866)..(866): n is a, c, g, or t
  misc_feature (928)..(928): n is a, c, g, or t
acggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgangcgangctggcaggtactggtagtcaaatttaccaagaactacacgataactcggcttccatgcactgatgtgctgnaagcgtaccagctttatttggcagcttgcccatttaagaagatctctccattacttttgccnatcaaacaatttt

SEQ ID NO: 1322 - DNA, 1106 bp, Oryza sativa
  Predicted polypeptide sequence is orthologous to G987
tttttttttttttttttccacttcaaggcaattattatttaaaaaaccattttcacacacatcaatgggcaaaaatgtttgaccctctgttgcaacatggatcatgaatagaccaaataagttggccgaaaagatagttctcaggttgacaacagcacaagactagccaaaacccagttcaacattttgagcatattacaatgttactgtctgccacagtgcagtaagcacctagtaaaaacagagtaactggtgtcaattacaaccggatcaactgactggattgatcgcaagaaccggtgacgctgcagcgaacatcatccggaccaggacctaagtctattttctaagtggtagtgtggcactaagctgcaacatgacaacagaagcaactaattaacatcacataaaaacatggatatctacatgcatgcttggttatcttatggcttcaacaacttgggctaccaattctccctcatagcctcaagtcattgggtccatcaaaccaacaccaacaccatcgatcttcatacatgacatactgccactagccatcttattgaaatacctagatcttatatttgtcgcgatgccaaaaaaaaaaactactaaaaataagagagagcatcatttggcgtccatgttgagatggcatagagtattcgtcccttccatccttgcaagagccattggtgatctatatctatcacgaagtccttgtggtagcagtccttgaccttgttccgcactacctgaacaatttctggattcaatggcagttgcttgaagccagcccgttgattccgcacctgccattgcttgtatgtctcagggcgctccacccgatctatgccctcacacgcaatgacattcagagcagctcgtccaaagatgttttgctcaatcagcagccgctgttcgctttcccttggggtacttgcatccagaacatcgaacaaggccgagtaaaagaacaaagcctcccggaaccgtgtcacaaagaatggtgcactgaatgagccattcactattgcatggatgaacacatgaggctgcatcttccggatgttgctgagcacaatatcccttgggctgtcgatcac

SEQ ID NO: 1323 - DNA, 1278 bp, Zea mays
  Predicted polypeptide sequence is orthologous to G987
cttttttttttttttggtgacagagattttaggccccttctattagtttttttaggagctcctctccatttctagaaaaagcccatcaagaagcttccccgttattagatttttctaggagctgttggaggcccaccatagagggcctttagtcatgggtcagcatgttgtgcaacccatgtggataggccatagagaacacgtcccttccacgtgtgtagcaaccacccctggtcctcgtcgatgccgaagtccctatggtacttgtccttcaccttgtccctcaccaccttcacgacgtcagcctgcagctggagctgcttgagccccgcccgacggttccgcgcctgccactgccggtaagtctcggggcgctccactcggtcggcgccctcacacgcgatgacgttcatggcggcgcggccgaagatgtccctctccagcagcagcctctccgggctgtcccgaggcacggtggcgtccagcaggtcgaactgcgccgagtagtggaacatcgcctcgtgccgaattgtcgggaagtaggtcgtgccgtagccgccactgacgacgccgtggatgaacacgtcaggccgcatccggcggatgttgcagagcacctggtccctggcggtgggacgacgacgcccactaggcccggcggcggcggcggaggagctgatctcgacctcgatctcgtccgtgagcagcctgaaatggcagaggctgatcacgacgagcacctcggcagctgggtcgatgcccaggtcctctggagacaccgcctctcgcttggccgcgatgccccggaactcgaacggcacgcccagctgacgtgcgcaatcgctgaggcggcgcccggtgtcctcgatctgctgtgcggggcgaaagccaggctgcggcaggtcaatgccggtgatcctgaccagctccggcggtccgccctccctggcggcgaggccgcgcagcagcccgggccactggaagccgtagccgaggccgtagtcgacgatgtgcagccggcggcgcctgccggcgagcgcgaaagcgtcgtggatggtcttgttggcgaaggcgaacgccaccctcttgcagcagcaggtggtcatgtagaggcggtacgccctgaggaagtcggcgacggaggtgcggcggagcatgagcgactggtacaagcggctgcccgtgccggcgaggcgcgcctccaggccgtcggcgaagcagtgcgccagcctctgcgcagcgtcgcccgtgggcgaggagtgccgcccggacgcgtgg

SEQ ID NO: 1324 - protein, 1363 aa, Oryza sativa
  Orthologous to G987
MVIELPFDNQYTTTETEQPHDGSSCSSQQQLSLYNYSPSDPQLFSQPTTGSRTYLSGAVTIPGICNDKSNLGQQQFQIDAALSLGYQRIRSSDALCYISRVLMEDVDERVDLHQGEAALQAAEKPFYDILGQVYPPSLNRLALHSANEPDTPDESSSRNNYHNRYHSSHSSFNMLQPLPTPLSPYSYGRSLFLPNQHLVSTAWTSTFGIPGFQIRRGAEEAKRFVPIIDKLVIDLDTDRGLSISKMTTKAKVGDKKRYAIFELTDQRHSPYTTDLDILEGRNSKRYAITYCEIIRNDMFDRVLLCYGVENFAEASNLRKIMTKQARKNSLNGQTRGSAQRKLRGMKQLKKDVVDLRNLLIHCAQAVAADDRISASELVKKIRQHSSPDGDSNQRLAFYLVDGLEARLAGIGSQVYRKLMASRTSAESLLKAYSLYLSACPFERASFAYANQTILDASKGQQPRKVHIVHFGICTGFQWPSLIQRLANEEGGPPKLRITGIDMPQPGFHPCEIIEETGKRLADYANLFKVPFQYQGIASRWETVQIEDLNIDKDEVLIVNCMFRMKNLGDEMVSMNSARDRVLKIMRMMNPRVFILGIVNGSYSSPFFITRFKEVLFHYSSLFDMIDANVPRDNEARKMIEGGLFGQEALNIIACEGAERTERPESYKQWQARCLKAGFKQLPVDPATLKEIINMKKGIYHEDFVADEDGAWLLQGWKGRVIYAISTWKPNESYLDQCLPEFGGYPCQKYDLHSRILMEEDIDEKISIKKGQDALQATEKPFYDILGKAYPSSSKETAINGDSQADYPDNGSSSYHEQACSGSFVSDLLGSQDAHSITTDWSSEFDRLALQFRRGVEEAKRFIPNIEKLVDDPEKNGLYACKQTTETTEQKGKHENKIRNHPHDPHVEHIELMEARNSKHMAISTSETIRDEMFDSILLCNRQLPGEVANLRGMMAKEASDNPKKFQSKGYGKGQRKPHSSKKKQKEAIDLSVLLIQCAQAIASNNHPFASELLRKIRHHALPDGDGSQRLANCFADGLEARLAGTGSQMYEKLMAKQTSTRDMLKAYHLYFVACPFEMVTYYFSNKTIIDALEGKTTLHIVDFGILFGFQWPCLIQRLAKREGGPPKLRITGVDVPQPGFRPHERIEETGKRLAEYANMFNVPFQYHGIASRWETICIEDLSIDKDEVLIINCMSRMRKLGDETENIDSARDRVLHMMKRMNPQVFILGVVNGLYSSPFFLTRFREVLFHYSSLFDMLDNNVPRNHEARILVEKDLFGNDALNAVACEGAERIERPESYKQWQMRILRAGFKQRPVNQAILNRSVHYKEFYHEDFVIDEDSGWLLQGWKGRIIQALSTWKVET

SEQ ID NO: 1325 - protein, 423 aa, Oryza sativa
  Orthologous to G988
MLGSSPARDRGGGDDAEASEQPQPQPQPPLSPRAGGGEARGLVLACADLVHRGDLDGARRVAEAVLAAADPRGEAGDRLAHHFARALLALRGGGKGGHGGGGGGVVPSSAAYLAYIKIAPFLRFAHLTANQAILEAAAADAGGAHRRVLHIVDLDAAHGVQWPPLLQAIADRADPAVGPPPEVRLTGAGTDRDVLLRTGDRLRAFSSSLNLPFRFHPLILPCTAELAADPTAALELHPDETLAVNCVLFLHKLGGDGELAAFLRWVKSMNPAVVTIAEREGVLGGDVDDDNVPDELPRRVAAAMDYYSSVFDALEATVPPASADRLAVEQEILSREIDAAVAAPGAGGGGRARDFDAWASAARAAGLAPRPLSAFAASQARLLLRLHYPSEGYKADDDGGRGACFLRWQQRPLMSVSSWQPQP

SEQ ID NO: 1326 - protein, 411 aa, Oryza sativa
  Orthologous to G988
MLRSLHSSSSSDTDNNSGGCKNNGGGGGEAAAAVEGGGDQRAVAAAAPSTRDLLLACADLLQRGDLPAARRAAEIVLAAAASPRGDAADRLAYHFARALALRIAPFLRFAHLTANQAILEAVDGARRVHILDLDAVHGVQWPPLLQAIAERADPALGPPEVRVTGAGADRDTLLRTGNRLRAFARSIHLPFHFTPLLLSCATTAPHHVAGTSTGAAAAASTAAAATGLEFHPDETLAVNCVMFLHNLAGHDELAAFLKWVKAMSPAVVTIAEREAGGGGGGGDHIDDLPRRVGVAMDHYSAVFEALEATVPPGSRERLAVEQEVLGREIEAAVGPSGGRWWRGIERWGGAARAAGFAARPLSAFAVSQARLLLRLHYPSEGYLVQEARGACFLGWQTRPLLSVSAWQPSSS

SEQ ID NO: 1327 - protein, 447 aa, Capsella rubella
  Orthologous to G988
MLTSFKSSSSSSEDATTETPPPPFCQLASSSSSSAATSASHHLRRLLFTAADFVSQSNFTAARNLLSILSLNSSPYGDSTQRLAHLFTKALSLRINRLQQEQDPTVATCTTNEMTMSTNSTVFTSSVCKEQFLFRTKNNNSDFESCYYLWLNQLTPFIRFGHLTANQAILDATETNDNGALHILDLDISQGLQWPPLMQALAERSSSPNSPPPSLRITGCGRDVTGLNRTGDRLTRFANSLGLQFQFHKLVIVDEDLPGLLLQIRLLALSAVQGETIAVNCVHFLYKFFNDDADLIGHFLTVIKSLNPRIVTMAEREANHGDHSFLIRFSEALDHYVAIFDSLEATLPPNSRERLTLEQRWFGKEIMDVVAAEATERKQRHRRFEIWGEMMKRFGFVNVPIGSFALSQAKLLLRLHYPSEGYNLQFLNDSLFLGWQNRLLFSVSSWK

SEQ ID NO: 1328 - DNA, 515 bp, Glycine max
  Predicted polypeptide sequence is orthologous to G1040
gaattctgcattagggaacaacggctccaccatggcggcgtgtagggctgccacggccacaaggtttaatgggttctccggcgatgctttcaaatcttattttccattgcaccaatatggggtgggcccttcagaagcctcttctgggttcatgagatcaaggtttctgcagaagcttcccaacaagaggagcatgagagcccccagaatgaggtggacaagcaccctccatgcgagatttgttcatgcggttgaacttcttggtggccatgaaagagctactccaaaatcagttcttgagctcatggatgtgaaggatctaacactagctcatgtgaagagccatttgcagatgtatcgaactgttaagaccactgacaagcctgcggcatcttcaggtaattcgtattgcttaatcctcaactatttttttttctgtttttagcagccttatctttttcttaagcatgcacaaattaatataggttttttcatataatggaaataatgccact

SEQ ID NO: 1329 - DNA, 928 bp, Glycine max
  Predicted polypeptide sequence is orthologous to G1040
caagaatgcgttggactagttctcttcacaatcgctttgttcatgctgtgagctacttggtggccatgaaagggctacccctaagtcagttttggagctcatggatgtcaaagatctaacactagctcatgtcaagagtcatttgcagatgtatcggactgttaagaacactgacaaacctgcagcttcttcagatggggatgaagatttcatgtccttaacagtaccaaatgatcaaaataacagttttttacccaatcagagaggaacttcaaatgcatctatagataatgatatgggctacacttcaagcaatctatgggttaattcttcttcgagcgctagaggagcacggatacaagctaactcaagagatttggatgagcttagtccacaagaaatcctatcatctcagcatactgggaaactttctgagggtagcaactatatacaaacaagaatcttcaacaaggatcaaaatccaagcttggagttcaccttagggagatcaaattggcacaacagtgaacatgcctaattttaattggtttacatatatgatcactttattactagccaaattaatagaaaagattaatatgcacaggtatataaattaatatataggtagtgcttttgtcaagacaaagatgtctgcacttttccacaaatctaaaagcatctctgtatattctttttgggccaaagcttattataggttgtgttagtcattatataaatgttgtagttaaagtaaaagttgaagaaaagaaggaaccagatgtataataaggcctttgttccctcctttttaattcttttccttctttttctctacttttccctagaggttcctacatatttgtccgtatacataactttttttaggctcaaaaaaaaaaaaaaaaaactcgagactagttctctc

SEQ ID NO: 1330 - DNA, 866 bp, Glycine max
  Predicted polypeptide sequence is orthologous to G1040
acgcccacgcgtccgggacaagcaccctccatgcgagatttgttcatgcggttgaacttcttgggggccatgaaagagctactccaaaatcagtcctcgcgcccgtggatgtgaaggatctaacactagctcatgtgaagagccatttgcagatgtatcgaactgttaagaccactgacaagcctgcggcatcttcaggccattcagatgggtctggagaggatgatttatctccgatggttagcaccgccgatcgtggtggtctccgacaatttcccaaccacagagggcggccggagtgggcggcacaacaagacatggactactcttccaccaccactactctatggagtaattcttcaagttgtggggagtcacggctaagacctagttctaacgacatagatggtctcagatcacctatcctccattcacaaacaatatcaggagggcatcaaattcaggagtgtgattcaatccaactcaagagcaacatgccaggttctaatttggagtgcaagatcccaagcttggaattcacattaggaagaccagattgggatggcaaagaacaagcctagctaataattttgataattggttcccttgcttaatttcttttaattttgcaatttatttataaaccatggtgacaacttcgtcatcttatgaaatgtagagctaattatttagataaatataaattggtgtctaggagaggaagaaaagaccctccgtgcgtagttctacttagctagctttcgaaaagtgtttttgagtttatgaacagttttgtttatattttattttgtttttatttatttgtgaggatgagaaggagggaaattaagatgtggcaattaaca

SEQ ID NO: 1331 - DNA, 394 bp, Glycine max
  Predicted polypeptide sequence is orthologous to G1040
acgaaacacgattcgctcgaggagggcttccaggatgcgttggacttctaccctccatgctcgctttgttcatgctgttgaactcttgggtggccacgaaagggctacacccaaatccgttcttgaactaatggatgtcaaggatctcactttagctcatgttaagtctcatttacagatgtaccggacggtgaaaactacagatagggcggcggcttcatcagggcaatcagatgtgtatgataatgggtcatctggtgatacttctgatgacttaacgtttgacataaaatctttaaaaagggctgatctattaattaagcaaggaagatcaagtgttaatcaaaataagaaatatcatgggcctttggggtaactctttaaaggaaacttg

SEQ ID NO: 1332 - DNA, 849 bp, Glycine max
  Predicted polypeptide sequence is orthologous to G1040
ttttgccaaagttgccagcaaagaggagcatgagagcaccgagaatgcggtggacaagcacactccacgctcgatttgtccatgctgtggagcttcttggtggccggctcgaggctacaccaaagtcagttcttgagctcatggatgtgaaggatctcacattagctcatgtcaaaagccatttgcagatgtatcgaactgttaagaccactgacaagcctgctgcttcttcaggcctttcagatggatcaggagaagatgacatgtctccaatgggaagcagtggtggaatgcgtcaattttcagaccaaagaagcctttctgatcgaccactgcaacaagatatggactactcttcaggcaacaacactctatggagtaactcttcaagcagtagagaaacatggcaacaaaataactctaatgacgtagatggtttcagacccccaatcttccagtcacaacaaatatcaggagggcatcaaattcaggagtgtgattcaacccaactcaagaacagtttgtcaggatcaaatttagagtgcaagaacccaagtttggagttcacattaggaagaccggactggaatggcaaagggcaagcctaattttcattggttccctttattgtctctagctagtttgcttaattagtttaattacaacccggtaacatgtgacaaacttcataatctttcctgaaatagaaaggtggtactatatataaaaatatatattcaggcagaaaaagtaaaagccctatatagttccgctaagtttatccttttttggaagttttatgacttcatgaacaattttgtttagcctttttcttgtatttaacatttt

SEQ ID NO: 1333 - DNA, 425 bp, Zea mays
  Predicted polypeptide sequence is orthologous to G1040
cttaattattggtggtacatactagaataataacttaatctgagaagacatttaaattaatgcagcaatgcgaacctatcagtagtgttgactgagtttttgttgcagatttaaattagtagccgccgtccccttcaccagcgcctcttcttctgagaatgaccatgtctcccgcatggccgccatggcctgctgctgctgctacacatgatctggctgtactacccttcactgttctgtacatctgcaggtggctcttgacgtgcgctagtgtaagatccttcacgttcatcagttccagtactgacttcggtgttgctctctcggggccgcccaggagctcgacggcgtgcacgaagtgcgcgtgcagcgcgggggtccacctcatccgcggggccctggagcttctcctcccgccgccggca

SEQ ID NO: 1334 - DNA, 587 bp, Zea mays
  Predicted polypeptide sequence is orthologous to G1040
  misc_feature (33)..(33): n is a, c, g, or t
gttgtcccccaggccgcgctccggctcgcggcngaacggggcgcgcgcgcgccccggatgcggtggacgacgtcgctgcacgcgcggttcgtccacgccgtcgagctgctcgggggccacgagagagctacgcccaagtcagttcttgagctaatggacgtgaaggatctgaccttggcccatgtcaagtcgcacttgcagatgtatcgcaccatcaagaccaccgaccacaagccagctaattctgcttcatcctacgggcaagcagcagccgcgaaaccggtcatcgacatccccgaccccgacgacgacagcctgttcgacctcatcaccaccagcgccgggtctgatcagtcgtcgtcgtcggctcagcactctaaccctgacggcggcggcggcaacgagcatggctccagcatgtgcgctctgtggtgcagctcctcgacaagcatcagcagggggggctggttccatgacagaccaagagacgatgatgccgccactcccggtcccggcgacgacatcaaatccttcgaggacgtgcaatcacacagccttcttgacgatgtcgccgacctcaactcgtc

SEQ ID NO: 1335 - DNA, 722 bp, Zea mays
  Predicted polypeptide sequence is orthologous to G1040
cgggaaacccaaacacccatacaagaatgatatgccactcatgacctgatcactccagtcgaccgcagccggccattgctacctctgtggcttagtcttctgcaagctttcctcttccttctcggctttgaacaaccaagaagctcagctagcacaccgtcgtcgacgttgcaacaaaccccaaccgctaccatgaccaccaccacgatgacgacgacgacgacagcagctcctgatctctccctccacatcagccctccgtcgccaccggagccgaggctgctgctggggttggagctcgacgacgacacggcggcggcggtggcggcgaaggccgcgacgaagaaggcggacgacgcggcgatgcgggagtacaacaacctccgccaggtgcagcggcgccagctgcaccagccgagccagacggcgggccacgggttcaagaggggcacgtcgggcagcgccgccgccggcgccggcgggaggagaagttccagggcgccgcggatgcggtggaccaccgcgctgcacgcgcacttcgtgcacgccgtcgagctccttggcggccacgagagagcaacaccaaagtcggtgctggagctgatgaacgtgaaggatcttacactggcacatgtgaagagccacctgcagatgtacagaacagcgaagcagcagggcgcagacagaccatgtgtagcagttgcaggccatgggcatgccag

SEQ ID NO: 1336 - DNA, 1357 bp, Zea mays
  Predicted polypeptide sequence is orthologous to G1040
  misc_feature (1218)..(1218): n is a, c, g, or t
  misc_feature (1330)..(1330): n is a, c, g, or t
ccctaccactcctcgtcgtcgtggccctcgtacctgcagtcgacgacgacgtcgccccttggcgccgtggcgccgccggcgtccgaccccacggcgtcgtcgtacctctcgccgtccgcgtaccaccggatgctgtcgagcaccggccggctccacctccagggcgtgctcgccgacacgctccgcggctacggcggcgcgcaccaccaccgccagcacttgggcagcctggccgcggcccgctacatgccgaaactcccggcttcccggcgcggcatgcgcgcgccgcggatgcggtggacgagcagcctgcacgcgcgtttcgtccacgccgtcgagctcctcggcggccacgagcgggcgacgcccaagtcggtgctggagctgatggacgtgaaggatctgacgctagcgcatgtgaagagccatttgcagatgtataggaccgtgaagagcactgataagccgcctgcagcaacctcatcagtaggagggggagggccgcctgtggacggtcctcgcggccccggcgacgacgaccacccgagcgattggcggcgggctccatcctcatcagctggtcgggacgtcagcccgcaggcgttcactggacaccggtcagccttctcggacggcgcggcaagccatgcgggcggcgacgttgaatgctcctccgccgccgattccgacggtggcaggccgcgcagcgcttgtacgccaaggctgccgcctccaagtgcgtgcaatgcagcagacacccttcattcagttggcggcccatattccactactgaggatatggagcctgcttgtcgatcagctggcttccaacattcactcaaccatggaatgagctgccctcctagcctggagttctcgctagggcggccaaactggaatggtgcagaatagcatcaccatcagctagctactagacacatgcatggatatatggcacattattagttcaacacttcatctagactgcttacaacacctgattggtttttgcatctattagaaatttagatagttccatgtttaatccaaaaatatcatatatatagtagatttatgacaacatgtacgtgcacgtgtgaaatattactactcacaccaataacgaaaaccacaagggataaaaaaaaaaaaaaaaaaaaaaaaaaaaaaaaaaaaaaaaaaaaaaaaaaaaaacaaaaaaaaaaaaaaaaaaaaaanaaaaaaaaaaaaaattatattaaaaaaaaaaccaaatattaaaaaaaaggggggggttttttttttttttttttttaagaaattatgtttttttttttattgggaagggagngaaaccccagggaaaaaaagggttttt

SEQ ID NO: 1337 - DNA, 956 bp, Zea mays
  Predicted polypeptide sequence is orthologous to G1040
gactcatgacctaatcaccaagatccaatccctcccccttcgagcaagaacaggcgacaaggctggacctgctgccaattcacaagtgcagcagcagaagcttgtcgttgcacaatggctactactgctgctgcagcccccgacctctcgctgcatatcagccctccctcgccgcccgatgatgctaggagcagtgacatgctcttctccaagcagacgctgtgcctcggactcgttcagacgacgacggcggcggcggcgcatgatcaggatggccaatgcgacgacgtccagcagcagcagcggctgcaccagcctagccagatccagaggttcaagaaaacctcgtcatcgtcggcgccgttgttatctgccggaggaggcacgacgagatctgggaacggcaacagcgggggcgggaagaggagctccagagcgccgaggatgaggtggaccacggctcttcatgcacacttcgtccatgccgtagagctccttggcggccatgagagagcaacgccaaagtcagtgctggagctgatgaacgttaaggatctcacattggctcatgttaagagccacttgcagatgtatcgaacagtgaagggaacgacggcagacagatcatgtgctgcaggccatgtccagatgagagacatgggctttctgcacaggggttgtgaactgaatggcttcgaagcgtttagcaacggtacttctaatgctaccgccaataatagggatggaggaccagcagaggcgcgcatcagcaagacgctgccgcccccccgccgctcgtcctaggccagcaggacagtgcgcggcgtctgcatccaggcttccccgacacggccatcagcagcagcagaccgtcatcctggagcgcaggcgtggcaagccgctggtcgtcgacgacggcggcggcgccttcgccgtcaagtggcaggagtagcata

SEQ ID NO: 1338 - protein, 233 aa, Oryza sativa
  Orthologous to G1040
MATTAATAPDLSLHISPPSPPDMAAGGETMEQLAEPKLCLGFGTAAAAAAEQYNNGGCNLQQQQRLHQPSQIQRFKKSASGGSPVCSGGATGTGGVAAARSGNGGGGGKRSSRAPRMRWTTALHAHFVQAVELLGGHERATPKSVLELMNVKDLTLAHVKSHLQATYLLDLVQMYRTVKGTTDRTCAEGHGQMRDMGFLRRGGGGVDGFDVLGNTSSIAIANIRAFNLKDANI

SEQ ID NO: 1339 - protein, 191 aa, Oryza sativa
  Orthologous to G1040
MKKGKRKKKGKIDKKEKGNRPSEEYNPNHSTAWPWSSMCWRSPGAAPPPPPAALDPTTSSLLSPSAYHRMLSSTGRLHGVLADTLRGYAGAAAVAGSIGYGSAAAAAAAMGGYGGAGAGGGFASSRFMPRLLPASRRSMRAPRMRWTSSLHARFVHAVELLGGHERATPKSVLELMDVKDLTLAHVKSHLQ

SEQ ID NO: 1340 - DNA, 651 bp, Glycine max
  Predicted polypeptide sequence is orthologous to G1047
  misc_feature (497)..(497): n is a, c, g, or t
  misc_feature (508)..(508): n is a, c, g, or t
  misc_feature (516)..(516): n is a, c, g, or t
  misc_feature (519)..(519): n is a, c, g, or t
  misc_feature (590)..(590): n is a, c, g, or t
  misc_feature (602)..(602): n is a, c, g, or t
  misc_feature (613)..(613): n is a, c, g, or t
  misc_feature (616)..(616): n is a, c, g, or t
  misc_feature (621)..(621): n is a, c, g, or t
  misc_feature (623)..(623): n is a, c, g, or t
  misc_feature (625)..(625): n is a, c, g, or t
ggctcgagctcctctcctccatcacctctagtttttgtataacccccgtcactctgctcccttaattaattagccaccatgctctccgccctcactccttccgaccccttctctcccttctcccccttctccgccggcttcacgccgtgggatgacaacgacgattcccacgccctcttctcccccaaaccggtctctgcttctagctccgcctctgactataaatccgaaccgaacccaaccgaacacgtatgcgcctcgtcctcggtgatgatggacgagcggaaacggcgccgcatgatatcgaaccgggaatcggcccgcaggtccaggatgcggaaacagagacacctggagaatcttcggaaccagttgaacaagtgcagggtcgaaaaccgggaactcggtaaccggttgcagttcttcctgcaccacctgaaccgcctccgaaccgaaaacgaatggctccgctccgagcgaaccctgctacgccaaanagtcgccattntaacacanatnttgatttttcaaccaattcaaaccaccttctccctgctgcatgaccacatgcaccaacaacaacacacctngctcatgacaantaatccagtantantaaanananattatatatatatatatattatatat

SEQ ID NO: 1341 - DNA, 459 bp, Zea mays
  Predicted polypeptide sequence is orthologous to G1047
ctcgaggccggccgcgtcgtcacggcggcgctggccgaggccgaggccgaggcggcgagggacgcggacccggaggacgaggagcggctccggcgtcagcgccgcaaggtgtcgaaccggctctcggcgcagcggtcgcgcgcgcggaagcagcagcggctggaggagctccgcgaggcggcggcgcggctccgcgccgagaagcagcagctggaggcccggctgcaggccctggcgcggcacgacctcgccgtgcgctgccagaacgcgcggctcggcgccgaggcctccgcgctcgcgcgccgctcccgcgaggcgcgcaggctcctcgcgctgcgccgcctcgcgttcgccgccctgcagccgcggcccggcgtcgctcccgcgcccgcgccgccggcgcccctgctgggactggcctcgctcctgacgcatgtggcttggtggggtcgtgctgcc

SEQ ID NO: 1342 - protein, 151 aa, Oryza sativa
  Orthologous to G1047
MTSGFGFTPWAADTCPTLEQLMASSASPSPSSSLDDNAAAAEEENGEVEEEEERRRQRRKVSNRLSARRSRARKQQRLEELRGESARLRAENRELAARLHAVARHGLAARCQNARLRAEAAALARRLLALQRLARGRHMMITASPPQFSRR

SEQ ID NO: 1343 - protein, 168 aa, Oryza sativa
  Orthologous to G1047
MAGLPFPSDSDTALEAFLADIGFGAPCPEAAPAPSPSHPDTTAAAATDEPVMAGDDQADEERRRRLRRRISNRESARRSRARKQRHLDELRAKASALRATSRDLVARLRGARARAALVALTNAQLRDEAGKLALRLAAARRVIALRQLYSAAAAGGGFEMQALASLIA

SEQ ID NO: 1344 - DNA, 1492 bp, Glycine max
  Predicted polypeptide sequence is orthologous to G1051, G1052
  misc_feature (1474)..(1474): n is a, c, g, or t
  misc_feature (1489)..(1489): n is a, c, g, or t
ctagctattcggctcgagcaagagggtcaaaagaatcttggcaaatagtaatgcaaatgcaacatgttctagtgagaaaatcacagaccccaagagggtcaaaagaatcttggcaaatagacaatctgcgcaaagatcaagagtgaggaaactgcaatacatatctgagcttgagcgaagtgtgacttcattacaggccgaagtttcagtgttgtctccacgggttgcatttttggatcatcaacgtttgcttctgaatgttgacaatagtgctttgaagcaaagaatcgcagcgctggcccaagacaagattttcaaagatgcacatcaagaagcactgaagagggagatagagagacttaggcaagtttatcaccaacaaaacataaagaagatggacaatgctgcagggtcaccaccatcccaatccccaccatctccatcaccaaaaccacgatgtgaaactcacactgaaaaggaacagcttatcaatgtttgaagtttgaatttgaaccctccatttgaagactcactcactcaccctttatagactatgatcaaattaacatatcaaccacctagcttgttcaaaaaaatatcaaccacctagtgtatgctagtttagatgatctgtgattcctttcaatattaaaaaagaaattgcagaattttgaaaataggagaaaaggagaaaaaaaatatgtacaaaacttgaatgcatttataggtgattttggtattattatttttttatcagaatctgagttttatctcgataatctgtgtaattcatcaaatgccaacacaaatgccaacacagattaagtaaaaccctaattttgattagaaaataacaccaaaatacctattaaagtgcaattaagttttgtgattagaagaaaaaaaaaatgttgtgtgactgcttgtagttgtaatgtaatgaatgtcatcacgtactgttgggtagagagagggtgagaatttttattaggcaatcgatgatttgatgaagggaaatgttgttaaatgagaagagggtcatcacattacattataatgtggtgtggtgaggccacattggtggtggtaggcttttgctatcaaactgagacagtcacgtgatgtgtttactttaaagaaaagggggaccactcaagttgcatgattgagaatgcagggaaacacatgtgcaccagtgacatcaaagagagggtggaagaaaaaaacagttgtgtctgctttaactagattctttcagttattttttattatttcttattattatttgttttcttcttgattattttcttttaatttaatttttattttttcttgggttttttttcttccaatattcaagttggaaaacaaagactagtgggcgtgtgtgttgggatggatgaaaggaaggtatgtcattatcagtgaaagtctcatggctcttctctgagttttgttgcactttgtgttactncttttaaggcatgtnatt

SEQ ID NO: 1345 - DNA, 957 bp, Glycine max
  Predicted polypeptide sequence is orthologous to G1051, G1052
  misc_feature (885)..(885): n is a, c, g, or t
  misc_feature (941)..(941): n is a, c, g, or t
acgaggttgcttattcaatagcgatttcagcgctgtacgttgccgataaaatttttgagctgagatattgtcgtgggtccctttaggctcattttgtttcctctatcatttttggagtatttgatttgatctcccgtccgctggctaggtgtttttgtatcgatgtttatatatatatatatatggacacagacattgcatgtatatatatatatatatgcgtagattatcataaaacacatgtaagttttgtgtttgttggtttatatatatagttctctctttcattcttgttcttcttcattcatcttttcatcttcttgtctgagagttgtgttgattgattggtgtgacccaaaaaatggctcaattgccaccaaaaattccaaacatgacacccaattggccagacttctcttctcctcaccaaaagatgccttccctcaaaaccatgtcacctaaccaaaacccttcatgggtggatgagtttcttgaattctccgcggcgagacgtggggcccaccggcggtcggtgagcgactccatcaccttcttggaggcaccattgctggaccaccatcattgcaaaggtggcagtgttggtggtggtggcggtagcggcgacaacgagttcgagaggtttgatgatgaacaattcatgtccatgtttagtgatgaggcttcagggaataataataataataataataataataataataataataataccatgatggaaaacgcgttatcctcttccaacccttctacaccttccgatcacaacagcatcaatgatgagaaggaaatgaacaacaaggaagaggaagggaagaagcaagtgaagaatgagtccgaggaggatgaggatgaaagccaatgcanacaagatatcacgcaacttgcccaacatgatgatagtaaaaacaatagtgatgcanatgcaacatgttctag

SEQ ID NO: 1346 - DNA, 1471 bp, Glycine max
  Predicted polypeptide sequence is orthologous to G1051, G1052
gttcttcttctccttgtggccttcttccctctaacattccctgtggtttctctgaacatatttatataaaggttgtcctgtagccttagaggctcatttggtttaatttgcctatgtcatatcatatgtactccttttttcatttcctctctcatttttggagtatttgatttgatgtgcatatatatacacacacattacaggtatatatatgcttagataatcaaaaaatatataccaagttttgtgtttggtttatatatatagttctctctttctctctctttcattcgtattcgtcttcttcatcttcatcgtttcatcttcttgtcacagtgtgttgattaattggtgtgactcaaaaaatggctcaattgccaccaaaaattccaaacatgacacccaattggccagacttttcttctcttcaccaaaagatgccttccctccaaaccacgtcatcaaaccaaaacccttcatgggtggatgagattcttgagttctcagtggcgaggcgcggggccccccggcggtcggtgagcgactccgtcactttcctggaggcaccattgctggaccaccatcattgcaaaggtggcagtgttgttggtggtggcggcggcaacaacgagttcgagaggttcgatgatgaacaattcatgtccatgtttagtgatgaagcttcagggaacaataacaataataataccatgatggcacacacgttgtcctcctccaacccttctacaccctctgatcacaacagcatcaatgatgagaaggaaatggaaaataaggaagaggaagacaagaagcagttgaagaatgaatcggaggatgaggataaaagcctatgcaaacaagatatcacacaacttcccaacaatgatgacagtaataatactagtaatgcaaatgcgacatgttccagtgaaaaaatcacagaccccaagagggtcgagagaatcttggcaaataggcaatctgcgcatagatcaagagtgaggaagctgcaatacatatctgagcttgagcgaagtgtgacttcattacaggccgaagtttcagtgttgtctccacgggttgcatgtttggatcatcaacgtttgcttctgaatgtcgacaacagtgctttgaagcaaagaatcgccgcgctggcccaagacaagattttcaaagatgcacatcaagaagcactgaagagggagatagagagactgaggcaagtttatcaccaacaaaacataaagaagatggacaataatgctgcagcgtcaccaccatcccagtccccatctccatcaccaaaaccacgatgtgaaactcacactgaaaaggaacagcttatcaatgtttgaagtttgattttgaaccctccctttgaagactcactcaccctttatagactatgatcaaacatatcaaccacccagtgtaagctagtatagatgatctgtgattcttttcaatt

SEQ ID NO: 1347 - DNA, 1254 bp, Glycine max
  Predicted polypeptide sequence is orthologous to G1051, G1052
tccacgcgtccgtccacgcgtccgattatgttgttttatgttcgtgtggctttcttgcctctgacaacattcccctgtgattgctgggaacatgcacatacatatatatttataaaagggttgtgttagagcctagaggctcatttgtttccatttcttcttctcgcgcattgacacatccttgttgtgctgcatgccttatgcaatatatttgcacatacaataatgtgtgcatatatacatatatatgtatatatatcatttgttagggacatgttaatgtactacaacaaaaacattaacatcatctgaggttaatttgcattttgcaacaacagttactgatttggcgtgtttgaactttgaattcaaatgacgcaattacctccaaagatcccaaacatgtcaccaagttggccagatttctcttcacaccaccagaagatgcaattgccacctctttaattcggcggctgcaacactaacaattatcagcacaaccagaacccttcttgggtggatgagtttcttgacttctcctcggcccggcggggcgctcaccggaggtcggtgagcgattccatcacctacttggattcaccagtgaagtgtggagggaataaaaacaacaacaacaatgagaacgagtttgacaagtttgatgatgaacaattcatgtccatgttcacggatgaagtagtgctctctggggtccccttgccaccaccaaccaccttgtcctcctctaacccttcaagcccttacgatcagaacttcatcaatgatgagaaggagaagaaggaggaggaagaggagcaccaccaccaccaccaattgaaaaatgaagcagatgaggttgaaagccaatgcaaacaggaaattatgcagcttccaaatgacaccaatacttgttcttccagcgagagaattactgaccccaagagagtcaaaagaatcttggctaatagacaatctgcacaaagatcgcgagtgaggaagctgcaatacatatcagagcttgagcgaagtgtaacttcattacaggccgaagtttcagtgctgtctccaagggttgcatttttagatcatcaacgattgcttctaaatgtcgacaacagtgctctcaagcaaagaatcgctgcccttgctcaagacaagatcttttaagatgctcatcaagaggcactgaagagggagatagagagacttaggcaagtttattacccacaaagccttcagaagatggaaaatgct

SEQ ID NO: 1348 - DNA, 498 bp, Glycine max
  Predicted polypeptide sequence is orthologous to G1051, G1052
cacatcacgtgaaagttttctagttagcatgaagggacattcattcattcatccatctacagcactattccttgtctcttccccctcaactgaggagctgctccttgttgtccttgcatcccaatggttgagacactgctatcggctgctgatgatgatgaagttgcattggttgttgttgtggctgtgatgttggtgtggtttgttgaagattgctgttcatcttttgtaggttctgttggtgatagatttgccttagtctctctatttccttctttaatgcttcttggtgagcgtctttgaaaatcttgtcttgggccaaagcagcaatgcgttgcttcaaggcactattgtcgacattaagaatcaaacgttgatggtccaggaatgcaactcgaggtgacaatgctgatacctccgtctgcaaagttgttacgctcctttcaagctcagaaatgtattgcagctttcttacccttgacctctgagctgattgcc

SEQ ID NO: 1349 - DNA, 427 bp, Glycine max
  Predicted polypeptide sequence is orthologous to G1051, G1052
ggtatacatatatataatagcatttgttcgggacatgttaatgtactattgcaacaacaacaacattaacatcatctgaggttaatttgcaactacacttcctggtgtatttcaattaattcaaatggcgcaattacctccaaagatcccaaacatgtcaccaagttggccagatttctcttcacaccaacagaagatgcaattgccacctcttaataacaacggcaccatcaccaacaactatcatcagcacaatcagaacccttcttgggtggatgagtttctcgacttctcctcggcccggcgcggcgttcaccggcggtcggtgagcgattccatcacctacttggattcaccaatgaaatgtggaaggaattaaagcaacaacaacaatgggaaccagttttacaaggttgatgatgaacaa

SEQ ID NO: 1350 - DNA, 379 bp, Glycine max
  Predicted polypeptide sequence is orthologous to G1051, G1052
  misc_feature (356)..(356): n is a, c, g, or t
ttcttcattcatcttttcatcttcttgtctgagagttgtgttgattgattggtgtgacccaaaaaatggctcaattgccaccaaaaattccaaacatgacacccaattggccagacttctcttctcctcaccaaaagatgccttccctcaaaaccatgtcacctaaccaaaacccttcatgggtggatgagtttcttgaattctccgcggcgagacgtggggcccaccggcggtcggtgagcgactccatcattgcaaaggtggcagtgttggtggtggtggcggtagcggcgacaacgagttcgagaggtttgatgatgaacaaatcatgtccatgtttaatgatgaagcttcanggaataattataataataataat

SEQ ID NO: 1351 - DNA, 547 bp, Oryza sativa
  Predicted polypeptide sequence is orthologous to G1051, G1052
  misc_feature (503)..(504): n is a, c, g, or t
ctcgggtggcgtttctggatcagcagcggacgatcctgaccgtcggcaacagccacctcaagcagcggatcgcggctctagcacaggacaagattttcaaggatgctcatcaggaggcgttgaggaaggagatcgagaggctgaggcaggtataccagcagcagaacaccaagttgtccggtggtctggccgctgaccacgcacatgtccatggcggcccgccgcctgtgcgagcagagaaggagctcatgagctagctgatcaatttgcctactgtcccctgtgcagtctgccttagcattaactttggagggaacattgcatcatgaacctgtggatgttttcttcttcttcttttttttttgtttttttattcttttacattgacttgtgtattcttgattcggttgttgattggagttctggtttacaatgggaattgtgggagatgtcaataagaaaatgtgaactgcaataagattaactgtgatttttgaaagccnnaattaataataataaaaatatttaaatttaattatataataaa

SEQ ID NO: 1352 - DNA, 1490 bp, Zea mays
  Predicted polypeptide sequence is orthologous to G1051, G1052
  misc_feature (35)..(35): n is a, c, g, or t
  misc_feature (67)..(67): n is a, c, g, or t
  misc_feature (71)..(71): n is a, c, g, or t
  misc_feature (96)..(96): n is a, c, g, or t
ggtacctcgaggcggccgggaattcccgtccgtcntcatcccctcgcctcggcacaagctacccggngggnccggacgagtggtgccgtggcggtnctcgtagctactgcactgcatcactataaagctaagctccaggccccgcgcccccccgcgatcgcgagatctagcgagcgagcgcgcacactgctggcggcaccaggctacgacgatcgagagagccgccgtgccagcacattgtccattgtccgcgcggcgggggatcgggcggacgcgcacataatatggcgcagctgccgcccagggtcccgaccgcggtgcaccgctggccggagggcggccaccacggcgcggcggcgtgggccgatgacttcgccgagttcgctgcgtcgcggcggggcgcgcaccgcaggtccctgagcgactcggtcgccttcgtcgaggtggcgcccgcggccggcgagttcgacaggctcgacgacgaccagctcatgtccatgttccccgacgaggccgccgccggcggcggcggcggcgggtcgtccgcggcagggtccgagaacaacggcggcagcagcgacagttacggcgataggcgcggcggcggtggccctgcggcgggaggcaccagcaccaccaccagctgcaatggcttcgatggtggcgagcacaacgaagccgcggacgcgcaggcgacggggcaagctgccgccgccgccgccgcctccacggagctgatccgggaccccaagagggtgaagaggatccttgccaaccggcagtcagctcagaggtcgcgggtgaggaagctgcagtacatctccgagctcgagcgcagcgtcacaacactgcagaacgaggtgtccgcgctgtctccccgtgtggcatttctggatcagcagcgtaccatactgaccgtcggcaacagccacctcaagcagcggatcgcagctcttgctcaggacaagattttcaaggatgctcatcaagaggcgttgaagaaggagatcgagaggctgcgccaggtctacgagcagcagaacctcaagatgtcagccggcgctgctgcctctgaccatggcccgccaccggtgcgcgcggagaaagagctcatgagctagctacccagtcgatccacgcgtgcccgctgtgcagtgcagcccgcccgccttatcattaattaacatggagggaacattgcatcatgatttctctttttttcggattatgtggatgttttcttctttctttctttcttcttccattgacacgtgtgcgttaattctttgtatgttgattttgggatttggttcactgtgcaaattgtggtaaagtcatcagggaaactgatctgttgtgtaaatcacttttttgaagcattacattcctgggaatctggttacccatgatttttttgtggtctttctttttttcccctttagtagtgtgattagataccacaatatttggcaggtttgagttcgatgtaa

SEQ ID NO: 1353 - DNA, 990 bp, Zea mays
  Predicted polypeptide sequence is orthologous to G1051, G1052
  misc_feature (61)..(61): n is a, c, g, or t
cattgggtacctcgaggccggccgggatcgcgagatctagcgagcgagcgcgcacactgcntggcggcaccaggctacgacgatcgagagagccgccgtgccagcacattgtccattgtccgcgcggcgggggatcgggcggacgcgcacataatatggcgcagctgccgcccagggtcccgaccgcggtgcaccgctggccggagggcggccaccacggcgcggcggcgtgggccgatgacttcgccgagttcgctgcgttgcggcggggcgcgcaccgcaggtccctgagcgactcggtcgccttcgtcgaggtggcgcccgcggccggcgagttcgacaggctcgacgacgaccagctcatgtccatgttccccgacgaggccgccgccggcggcggcggcggcgggtcgtccgcggcagggtccgagaacaacggcggcagcagcgacagttacgccgccgcctccacggagctgatccgggaccccaagagggtgaagaggatccttgccaaccggcagtcagctcagaggtcgcgggtgaggaagctgcagtacctctccgagctcgagcgcagtggcgcttccctgcagaacgaggggtccgcgctgtccccccgcgtggcgtttctggaccagcagcggaccatactgagcgtcggcaacagccacctcaagcagcggatcgcagctcttgcccaggacaagattttcaaggacgctcatcaagaggagctgaagaaggagatccagaggctgcgccgggtctacgaccagcagaacctcaggatgtcagccggcggcgccgccgcttctgaccatgggccgccaccaccggtggtgcgcgctgagaaggagctcatgagctagccagccagtccatgcgtgcccgatgtgcagtccgccttatcattaacatggaaggaacattgcatcatgattttttttttcagattctgtgaatggtttcttccttcctttttttggg

SEQ ID NO: 1354 - DNA, 728 bp, Zea mays
  Predicted polypeptide sequence is orthologous to G1051, G1052
ccacgcgtccggttgttcctaagcgcgccaagaggaccctggcgaaccggctgtccgcgcagcggtcgcgcgtgcgcaagctgcactacatctcggagctggagcgcagcgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatgctcatcaggaggcactgaggaaggagatcgagaggctgaggcaaatctaccaccagcagagcctgaagagcggcagggagcccgacgcggccccgtcggtccgcgacgacaaggacatgatcggcagcgaggggaccgccgcgcccggcccgccctcgtgatgaggaggaggtggttgggggcgacacgtccagacatccgagtcggtcgctgtagtcggggatggccctgtcgcccgccctgcagcccatcacagcgaggttgccgctgccgctgctaggattggtgtgtgtgtgccgtgtgcgtgtccgtgtgtgcattctttgggggtgtgtaacgtgatgtgatgtaaagagaagaggaactgcatcggtttggtttggtttggttatccttgcatgcatatgcatctgcatcctctcctgctgccttccaccacctcccctgaattgtaatttttggtcgagcattttggg

SEQ ID NO: 1355 - DNA, 1650 bp, Zea mays
  Predicted polypeptide sequence is orthologous to G1051, G1052
tcgaggccggccgggccgggaccatttttcctccgttccattcttctctcctcgcctcccctcgcctcccctcttgaaccctccgccgctccgaggaaaatccgatttgaattgaaaatcatccggagacagagatcttttcttcctcgaagctatcttctctgtcgactcgatccatagctgctcgcgtccctgttcctcgccggctggcaagtggcggcgacgggacgaggtcttcatcgcctcttcgcgagcgacgatcacccactagtttggtcggtctgaggcacatgatgatggccaacgcgaagctccacaagcaggccctgctgccgccgcggagccccttcccgacggcggcgccgtacgccgaccgcggcccaatcgcgcggccgcaggttggctccacgcaccaccgccacggccaccaccagcgcacgtcgtccgagagcttcatcgaggagcagccgccgtcgtggctcgacgacctgctcaacgagccagagacgcccgcggcgcggcagagcggccgggctgggcaccgcaggtcgtccagtgactcgtttgcgttgtttgacggtggagctgctggtgctggtgcttacgccaatggtttcgaggggatgggggagaggaggtgggcaacctgcgccgtggggtggtgtgcaggagtactatgccaagctggccccgattgggagggcacatggccggccgtgggagcaaggcatgccgaattcggcgggcttcaggcatggtggtggcctgccgatgcccacaaaagataaggttggtgggcatcatgggccaccgaaagtgtcgagggagcatgaccatggcatggacaagagaactgatgatgctggccatgatcaaaaggttggagccaaggagggtgtgccgccgaagcatgcacagtcagaggcggacaacaagcgtgctaaacagcaatatgctcagaggtctcgtgtccggaagctgcagtatattgcagagcttgagagtagagtccaggcattacagtcagaaggggtagaagtgtctgctgaaatggagttccttagccagcagaatatcatgctagacctggaaaacaaagccttgaagcaaagagtggagagtctagcacaggaacaacttattaagcgttttcaacaggagatgtttgagcgggaaattggtcgtctcagaacaatatatcagcaacagcagcaacaacaggctcctgctcttgttcgtagtaacagcagggaccttgatgtgcagttcgccaacttgtctctgaaacacaaagaccccaacacgggccgggatgctctctctgggcctcttcgtacttagttctttccatccttccgttcttgtgggttctatcagtggccaccactgtgtctgtcatctccaccaagaaaggagaagtgcacttggattgtgtgaaaaacaccggaaaaaggctaatagctatggatctgatgtttattatttcgggatatgcacctggcggtcatcctcagctcgcgtccattggtgatgctcgaccagtcggcggtgtttagggggttttgtttttagctagatgcttttcaagcatcattgtaccatttttcatgctagggttctaatctgttactacccccgttttcctgaact

SEQ ID NO: 1356 - DNA, 919 bp, Zea mays
  Predicted polypeptide sequence is orthologous to G1051, G1052
  misc_feature (846)..(846): n is a, c, g, or t
  misc_feature (848)..(849): n is a, c, g, or t
  misc_feature (851)..(854): n is a, c, g, or t
cccacgcgtccgatctcggagcttgaacggagcgtcaccagtctccagatggaggtgtcggcgctgtccccaaaagggtcaagaggatattggcaaacaggcagtcggctcagaggtcacgagtgaggaagctgcagtacatctcggagcttgaacggagcgtcaccagtctccagatggaggtgtcggcgctgtcccctcgcgtggccttcctcgaccaccaccgctcactgctcaccgtcggcaacagccatctcaagcaaagaatcgcggcgctcgcccaggacaagatcttcaaagacgctcaccaagaggcgctggagaaggagatccagcggctgcgccaagtgtaccagcagcagcaggtcaaggtggccaccaccggcggcgccgacatcgccaccgccgcctcgccgtcgatgcaggccaggcaagagctgctcgcgtgcgagggcgctgctattcgatagcggaggcggcggcggcggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaaatgcatcgatgccaagttgtgaatgaattgtactattcagttatttggaccggcttagtcggaatatagtgagacggagtttgttggtgtgagttatccgttcttaatttattgttgtttagattgattttatttaaaaaaaaaaaaaaaaaaaaaccaagaaaaaaaaaaaaaagaaaaaaaaaaaaaaaaaaaaaaaaaaaaaaaaaananntnnnnaaaaaaaaaaaaataaaaaaaaaaaaaaaaaaaaaaaaaaaataatgggggggggcctttttagg

SEQ ID NO: 1357 - DNA, 1175 bp, Zea mays
  Predicted polypeptide sequence is orthologous to G1051, G1052
  misc_feature (1170)..(1171): n is a, c, g, or t
  misc_feature (1173)..(1173): n is a, c, g, or t
cccagcgtccgccccgcgtccgcagctagcagaagcacagtcgagcactccaccatccagcttcgcatcccgcaagttcccagtcagccgagcagccagcggcggtgccaagaaggccgagctgcgagctccactccccacacctcagaagaaaaaggtgatggcgcaactgccgccgcgggcgccgagcgccgcgccgcaggaccactggccgccggcggcgggggagttcctgggcttcgccgcggccaggcgcggcgcgcaccgccgctccgcgagcgactcggccgcgttcctcgaggccgtgcccattgacgacgacgtcgtcacgcgcggcggcggcggcggcgacgacttcgaccgcctcgaccacgaccagctcctgtccatgttctccgacgtcgacgtctccgtctccgtctccgtctccggcagcgccggggagagggcgcagctcatggacgcggggggtgcggacgacggggtggcggactcgtcgccggctgccgcggacggcgtcgctgagcccaaaagggtcaagaggatattggcaaacaggcagtcggctcagaggtcacgagtgaggaagctgcagtacatctcggagcttgaacggagcgtcaccagtctccagatggaggtgtcagcgctgtcccctcgcgtggccttcctcgaccaccaccgttcacttctcaccgtcggcaacagccatctcaagcaaagaatcgcggcgctcgcccaggacaagatcttcaaagacgctcaccaagaggcgctggagaaggagatccagcggctgcgccaagtgtaccagcagcagcaggtcaaggtggccaccaccggcggcgccgacatcgccaccgccgcctcgccgtccatgcaggccaggcaagagctgctcgcgtgcgagggcgctgccattcgatagcggtggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaaaatgcatcgatgccaagttgtgttggaccggcttagtcggaatatagtgagacggagtttgttggtgtgaaaaaaaaaaaaaaaaaaannanag

SEQ ID NO: 1358 - DNA, 624 bp, Zea mays
  Predicted polypeptide sequence is orthologous to G1051, G1052
cggacgcgtgggcggacgcgtgggcggacgcgtgggcggacgcgtgggcagcgctgtcccctcgcgtggccttcctcgaccaccagcgatcgctgctcaccgtcggcaacagccacctcaagcaacgaatcgcggcgctcgcccaagacaagatcttcaaggatgctcatcaagaggcgctgaagaaggagatcgagcggctacgccatgtgtaccagcagcagcagatgaaggtggccaccaccggcggcgccgacatcgccgcggcggcttccatgcaggccaggcaagagctgctcgcgtgcgagggcgctgccattcgatagcggatcgagggcggaggcgttcaactggcagtgccacaacaacaacaccagcaccgaactttgtgccgggttcctccttttctcagtcagacaagttgttcgtcgtgcgtgggaaatacacgtcgcctgttagtagcctattgattttatttctgtgcagtcttaattaattcgtatatgtgatgtattcgtcctcctccacccagagcaaaaaaacaaaaagaaggcccccccgtgctgggatggagacttgttgtgaatgaatgaatgaatgtatttggttatttggccgggcttg

SEQ ID NO: 1359 - DNA, 300 bp, Oryza sativa
  Predicted polypeptide sequence is orthologous to G1052
agaggattttggcaaacaggcagtcggcgcagcggtcaagggtgagaaagttgcagtacatctctgagcttgagcgcagcgtcaccactctccagatggaggtgtcagcactgtcacctcgtgtggccttccttgatcatcagcggtcgctgctcaccgtcggcaacagccatctcaagcaaagaatcgccgccctcgcacaagacaagatcttcaaagatgctcaccaggaggctctgaagaaggagattgagcggctacgccaagtgtaccaccagcagcagatcaaggccaccggag

SEQ ID NO: 1360 - DNA, 326 bp, Zea mays
  Predicted polypeptide sequence is orthologous to G1052
agcccacgcgtccggtttccggcgttgcgccaccgttcccgcgtgttgcgttgattcctcgggtcgaaccaacgcgcggcgcggggtcccggtcgcggccatggcgcggctgccgcccaagatccccaccgtagcgccggcgtggccggagttcgggggcgggcaccaacagcagcgcagcccctccgtgggcacgttcctcgccgccgcgcccatgcagccgtcgtgggtggacgagttcctcgacttctccgccgccaagcgcggcgcgcaccgccgctccgtcagcgactccgtggccttcctcgagcccgaacccggccccg

SEQ ID NO: 1361 - DNA, 627 bp, Zea mays
  Predicted polypeptide sequence is orthologous to G1052
gggccggccaaggcgtcggggtaaatctcggacctggagcgcaccgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatggtgaccgccattgccggccgcccctgctcctcccgactacgaccctcgccgctcatcaggaggcactgaggaaggagatcgagaggctgaggcaaatctaccagcagcagagcctgaagagcggcagggagcccgacgcggccccgtcggtccgcgacgacaaggacatgatcggcagcgaggggaccgccgcgcccgggcccgccctcgtgatgaggaggaggtggtggggcgacacgtccagacatccgagtcggtcgctgtagtcggggatggccctgtcgcccgccctgcagcccatcacagcgaggttgccgctgccgctgctaggattggtgtgtgtgtgccgtgtgcgtgtccgtgtgtgcattctttgggggtgtgtaacgtgatgtgatgtaaagagaagaggaactgcatcggttcggtttggtttggtt

SEQ ID NO: 1362 - protein, 346 aa, Oryza sativa
  Orthologous to G1051, G1052
MAQLPPKIPVAAPGHHQHWASAGGAGDAAWADEFAEFAASRRGAHRRSLSDSVAFVEVAPAGCGAGGEFDRLDDDQLMSMFPDEGGSSAPGSDNGGSDSDGGGDKHAAAQSDDGQHAAGEPTQEQAAATSPTELIRDPKRVKRILANRQSAQRSRVRKLQYISELERSVTTLQKWRQFETDRWTQPHWLAGNSTQCGEEMSESNEVSVLSPRVAFLDQQRTILTVGNSHLKQRIAALAQDKIFKDAHQEALRKEIERLRQAVLACYRLTAPDLLCMIWFPLLGERNHRRRKTCAAYRYRGTPLLLQFQGQVAQRAIQHLHYSEFAVYGSGSAMINHATCGVLVSRY

SEQ ID NO: 1363 - protein, 324 aa, Oryza sativa
  Orthologous to G1051, G1052
MAQLPPKIPTMATAWPEFGGGHHHHAAHGHHHQRSPSMGAFLAAPLPPFPLPPPAPANGGAQQQQQQQQHQPSWVDEFLDFSATKRGAHRRSVSDSVAFLDPVSDDNAGVGAHDFDRLDDDQLMSMFSDDLQPPPPQQQPAAPAASASSPSDHNSMNDEKQDKGETDEAQSECDGATPGQPASPATVDPKRVKRILANRQSAQRSRVRKLQYISELERSVTSLQTEVSALSPRVAFLDHQRSLLTLGNSHLKQRIAALAQDKIFKDAHQEALKKEIERLRQIYHQQSLKNAESQPADAAPVRGRDNADLIGSEGAAAAAPCPHS

SEQ ID NO: 1364 - protein, 287 aa, Oryza sativa
  Orthologous to G1051, G1052
MGAFLAAPLPPFPLPPPAPANGGAQQQQQQQQHQPSWVDEFLDFSATKRGAHRRSVSDSVAFLDPVSDDNAGVGAHDFDRLDDDQLMSMFSDDLQPPPPQQQPAAPAASASSPSDHNSMNDEKQDKGETDEAQSECDGATPGQPASPATVDPKRVKRILANRQSAQRSRVRKLQYISELERSVTSLQTEVSALSPRVAFLDHQRSLLTLGNSHLKQRIAALAQDKIFKDAHQEALKKEIERLRQIYHQQSLKNAESQPADAAPVRGRDNADLIGSEGAAAAAPCPHS

SEQ ID NO: 1365 - DNA, 1154 bp, Glycine max
  Predicted polypeptide sequence is orthologous to G1062
ggttttccccccgagggaagaggcggctcgaggagaaggacgaggaggttgaggatttgagtttcgatggctccgggttgaactatgattctgatgacttgactgagagcaattataataatgtttctgagggtaatactgggaagaatggtggggttagttccaacgcgaacagcaccgtcatcaccggtttggatcaaaaagggaagaagaagggaatgcctgctaagaatttgatggccgaacgacgccgtaggaagaagctcaatgatagactctacatgttgaggtccgttgttcccaagattagcaaaatggacagggcttcaattcttggggatgcaattgagtatctgaaggagcttctgcaaaggatcaatgatctgcataacgagttggaatcgacaccagtgggttcttcactcactcctgtctcaagtttccatcctttgacgcctactcctcctacgctgccaagccgaatcaaggaagaactgtgccccagctcattgcccagccccaatggccaacctgctagggttgaggttcggctgcgcgaaggaagggctgttaacatccacatgttttgtgcccgcaagcctagtctgttgctctcaaccatgagggctttggataaccttggattagacattcagcaggctgttatcagctgcttcaatggatttgctatggatatttttcgagccgagcaatgcaaagaaggtcaggatgtccatccggagcaaatcaaagcagtactcttggattcagctggctacaatggcatgatgtaactagttttgacaagaaacaaactggtagctgctatttcacagtcaatttggcaagttaaatcagaatcagtttttactttgttatgttcacaattcaagtgtacgatactagctctggtaacttgagttaaagttgaggtagaagaaattttcacatgaattttacccccggcagcggcagttactatttggtacctttcacttgctcatgtcgaaccgaatcttgatgctactacttcgacttcaattagttcagggacatttctgaaggcgcgttttgacgtgaagtttgtatttatgtttgtcgaacctattgtcctctttatacagttttcgcccaggacaaaactttaaagcaaa

SEQ ID NO: 1366 - DNA, 673 bp, Glycine max
  Predicted polypeptide sequence is orthologous to G1062
gatagactctacatgctgagatccgttgttcccaatattagcaaaatggacagggcttcaatccttggggatgcaatcgagtatttgaaggaacttctgcaaaggatcagtgagcttcacaatgaattggagtcaacaccagcaggtggctcttcaagctttcttcatcatcctttgacacccactactctaccagcccgtatgcaagaagaactttgtctcagctcgttgccaagccctaatggccatcctgctaatgctagggttgaggttgggttgcgcgaaggaagaggtgtaaacatccacatgttttgcgaccggaaacccggactcttgctctctaccatgacggctctcgacaaccttggactagacattcagcaggcagttatcagctatgtcaatggatttgctatggatattttcagagctgagcaacgcaacgaaggtcaggatgtccatccggaacaaatcaaagcggttttgttggattcagctgctggcttccatagcatgtcctaattgcaaaaaacaaactactactgaaaataccttttcaattagtcaatttagcaatcttaatgtttttaacgctcaaaattcaactgtactatatacaggctcttttaacttctgctcagttgaattaggagaaaatttattttaccaatta

SEQ ID NO: 1367 - DNA, 961 bp, Glycine max
  Predicted polypeptide sequence is orthologous to G1062
caaaaaagaaacgaaaagaaataaaacgatttattacatctcttaataataaagacaacagcataagttcgctttcgtcagaagcagaattgaacaaaatatcaaagctaactcctaaaactacagatttaactaacctatttgatctgggcctaaacagttcaaaggagaagaagaagcaatgcatttacaaactgcaagctacagcaactacggttggctcctctatcagggggaagcatttatcaagcattccaatcacatcataccatggaagccagcagaatccgagagcaccgctttaatttgctcagggaggacatcctggccttctctgcattgctcagctttgaacacatctaaagcaaagccattaaaacagctaataacagcctgctgtacatccaatccgaggttatccaaagccttcatggtagaaagcaaaagacctggtcggcgggtgcagaacatatgaatgttgacagttctcccttcccttactctaacctcaacctttgcagcttggtttttagggcttggcaaggtgccaggatacagttcctccttgacccggcagggaagggttggcagggtgggtgttagaggctgaaagcttgtagaagaagaaggtgtcagcgacgagccaggtggagttgactctagctcgtgatgaagatcattaatccgcggcagcaactccttcaagtagtcaattgcatccccaagtattgaagcccggtccatcttgctaatcttggggacaacagacctgagcatgtacaacctatcattgagcttcttccggcggcgcctctccgccatgagattcttggcgggcagccccttcttcttccccttgttatctccaccattctcactcagcttcaacccattgctctcattctgctcatcagactcatagttcaacccggacccacgcgtccgcggacgcgtgggtcga

SEQ ID NO: 1368 - DNA, 426 bp, Glycine max
  Predicted polypeptide sequence is orthologous to G1062
ggggcccaacccacccttttccagaagagagccgcgctcaggaagaacatgaacatgagtgacaataagaagaggaaggagaaggatgaggtggtggttgaggatgtgagtttcgacgggtctggcttgaactacgattctgacgacttaactgagagtaattataatgaccctaaggagaagaatggtggtgggggggttagttccaatgccaacagcaccgtcaccggtttggatcagaaagggaagaagaagggaatgcctgctaagaatttgatggcccaaccacgccccccgaagaagctcaatgacagactctacatgctgaggtccgttgttcccaagattagcaaaatggacagggcttcaattcttggggatgcaattgagtatctgaaggagcttctgcaaaggatcaatgatctg

SEQ ID NO: 1369 - DNA, 1517 bp, Oryza sativa
  Predicted polypeptide sequence is orthologous to G1062
  misc_feature (828)..(828): n is a, c, g, or t
cagagcgctgcgaggcaaggaggcgagcaagaagcggcggcgaggttgccatggacgaggcggaggcggcggcggcggcggcgaagatggacgagctggcgggaggaggaggaggaggcggcggcgactggtcgtacctcgcggcggacgcgctggcggcggcgtcgttcacggcgttcccgttccaccaccaccaccaccaccaccaccgcgacgtgctctcggcgtcgaccccgtcgtcgctgctcctcaacatggacgcggccaccgccgcggccatgttcgacttccaggcggccttcccgtcgtcctccgtcccgccgccgccgcccacgacgacggcggcgctcccgccgttccacgacttcgcctcctccaacccgttcgacgacgcgccgcccccgttcctcgcgccgccggggcagaagctcgggttcctggggccccccggcggcgcgttcggcggcgggatgggggtgggacgacgacgacgagatcgagcagagcgtggacgcctcgtccttgggtgtctcggcctcgctggagaatgccgcgcccgtggcggccggaggaggcggcggcggtggcggcggcggtgggaggggcaagaagaaggggatgccggccaagaacctcatggcggagcggcggcgcaggaagaagctcaacgaccgcctctacatgctgcgctccgtggtgcccaagatcagcaagatggacagagcttctatccttggtgatgcaattgagtacttgaaggagctcctgcagaggattaacgatcttcacaatgaacttgagtctgcccctagctcttcgcttactggnaccatcatgcggctgagcttccacccatcaacacccacattgcagacgtttcctggccgcgttaaggaggaactttgcccaacctcatttccaagccctagtggtcaacaagccacggtcgaagttaggatgagggaaggtcatgcagtcaatatccacatgttctgcgcacgcaggcccggcattctgatgtccacattgagggctctcgacagccttggcctcgggatcgagcaggcggtcatcagctgtttcaatgggtttgcaatggatgttttccgcgccgagcaatgcagggatggtcctggactcgggcctgaagaaattaagaccgtgctcctgcactctgctggccttcagaacgcaatgtaatcagcaagtcagaaagcagtcaagaccaatgcactgggatttgatcagtgatcatttgcatcagatgatctggtttatcaaaaagttatagtaagtatggcatatatgctgtttatctaggagaactgatgagatgaggctcgccatctagagacatgtgtgatgatgatgatgtaactgggtttctttctttctgttgtcgttttttttttctgaatgttgtttgtgatgtaataggatctttgtcccattgaaaccatgtccattatcatgatgagaatatgaacccagtgtttttggatgaaaaaaaaaagaaa

SEQ ID NO: 1370 - DNA, 484 bp, Oryza sativa
  Predicted polypeptide sequence is orthologous to G1062
  misc_feature (32)..(32): n is a, c, g, or t
  misc_feature (39)..(39): n is a, c, g, or t
  misc_feature (46)..(46): n is a, c, g, or t
  misc_feature (78)..(78): n is a, c, g, or t
  misc_feature (150)..(150): n is a, c, g, or t
cggagtcggagagagacacaagccaacctcgnaactcgnaagcagnagcaaacgcgaagcagaagcaagcgccatggnacgccgagaatggccatgggcgagagcttcgcctactactgggagacgcagcgctaccttggagtccgaggnagctcgacagcatgtacctgccgacgcaggatgactccaactacgagtcgagctcgccggacgggtcgcactcgtcgtcggcgccggcgccggcggccgtgggcggggacgcagccgccgcggtggcgggtagcggtggcgggatgacgacgatgatgatgggcggcggcggcggcggtggcgacgacgccggtggcgcgaacaagaacatcctcatggagcgcgaccgccgccgcaagctcaacgagaagctctacgcgctccgcagtgtcgtgcccaacatcaccaagatggacaaggcgtcgatcatcaaggacgcgatcgagtacatcca

SEQ ID NO: 1371 - DNA, 280 bp, Zea mays
  Predicted polypeptide sequence is orthologous to G1062
  misc_feature (200)..(200): n is a, c, g, or t
  misc_feature (203)..(203): n is a, c, g, or t
ggaagaagcttaatgaccggctctacatgctccgctccgtcgtgcccaaaatcagcgagatggacaaggcctccattctcggcgacccgatcgaatacctgaaagagcttgctgggaagatcgacgacctccaaaacgagctggagtcaccaccatccccagcttccacggcctcgctgccttcgacgcccacgagcttncgncctctgacttccacgcttgccgccctaccatctcgcgtgaaggaagagctgtgcccgagcgcgttgcctagccctac

SEQ ID NO: 1372 - DNA, 849 bp, Zea mays
  Predicted polypeptide sequence is orthologous to G1062
  misc_feature (777)..(777): n is a, c, g, or t
agatttaagggaagcaggatattctattgctgggagtagaacttgggcggcatggatcagcttgacgagcaatcgttcctggacgagctcatgtcgctgcgccgggaggaggcgccgtcgccggctccgtggcaggcgtatccgggcagcggcatgatgacgacgagcgacctcctcttctacggcggcgagggcaccaccgaggcgagcagcggcatggactttgccgggccgtttcagcagcccatggcgccaccgccggccacatctccgcaccggccgcacgagaagttcaacttcgactgcctcagcgaagtatgcaacccttacggcagctgcgtcggcggcgtacctaagcctggggtcgtccacgcggctggccaggcgtatgccctccaggatgccatggcgcagaacggcacgagtggcggcaagctgcatcacggtggtggcaggcgtcgtcgtccccggcgccgttcgtgttcgcaggtgtcgccggggagagctcggagatgaccaggggcgccttctccggcgcccacgctagaagcaagctcaacggtggcactacgtccaagaacctcatggcggaaaggcggcgccggaagcgtctcaacgaccgcctctccatgctccgctccatcgtgcccaagattaccaagatggataggacctcgatcctcggggacaccatagactacgtgaatgagctaaccgagcggatcaaacccttcgagggagagatcggcgccacgcccggaggatctgaacctgctngacaccacgaagaatttctccagcgggtacagtgaggagatgccgatgaggaatccaccaagtttgtcatcg

SEQ ID NO: 1373 - DNA, 1264 bp, Zea mays
  Predicted polypeptide sequence is orthologous to G1062
  misc_feature (1261)..(1261): n is a, c, g, or t
ggtgggttctttgcgccgctgccggcctcgggcttcaacgacgccgggatgagctgggacgacgaggacgagatcgaccaaagcgtcgacgcctcctcgatggccatctcggcctccatggagaatgctgcgggcgcggtggcgggggcaagtggcgccggcggtggcagcgggagaggcaagaagaaagggatgccggccaagaacctcatggcggagcgccggcgtcgcaagaagctcaatgaccgcctctacatgctgcgctcggtggtgccgaagatcagcaagatggatagggcttctatccttggcgacgcaattgagtatctgaaggagctcctgcagaggatcagcgatcttcacaatgaacttgagtcagctccgagctcttcgcttgttggaccaacatcagctagcttcaacccatcaacaccgacattgcagacatttcctggccaggtcaaggaagaactttgcccgggctcattcccaagccctactggacaacaagccacagtcgaagtcaggatgagggaagggcatgcagtcaatatccacatgttctgtgcgcgtaggccaggcatcctgctgtcgacaatgacggccctcgacagcctaggcctcgacatcgagcaggcggtcatcagctgcttcaatggctttgcgatggacgtgttccgagctgagtgcgcggatggtcctggaatggtgcctgaagaaattaaggccgtgctgatgcacaccgccggcctccacaacgcaatgtagccggtccgaaaacgggccaccgccaggatgacgacgatcctcctcctttctactaagggcttcggttcggaagcggcataagattaagctgtggtggccattggttttctggggcaagtgatgaattttaagatgatgaggctcgccatctcgggcatgaggcatgagtgatgatgtaactatgggattcttttttttcttctcattagcctaatgtcggattttctcctctctgatacacttgtggtgtaatagaatctatgctgcgtgttgaacaatatatggtggtgaatggtgatgcggtagctagcatcaaactcagtgcctgttggtcagagatcgatggtgcaaagagagacgagttcattcatcagcgtccagcaatgattttgactggctatgggtccgtccgtccttgattcgaatcaaatgaattgaatcctctggcttcttgttccccaaaagttgtgggatgttgggggtattaatattnggg

SEQ ID NO: 1374 - DNA, 976 bp, Zea mays
  Predicted polypeptide sequence is orthologous to G1062
  misc_feature (3)..(3): n is a, c, g, or t
ggnagggtaagaggaaggggttgccggccaataacctcatggcagtatcgcccgtcgccggtaagaagcttaatgaccggctctacatgctccggtccgtcgtgcccaagatcagcaagatggacagggcctccattctcggcgacgcaatcgagtacctgaaggagctgctgcagaagatcaacgatcttcagaatgatctggagtcgtccccttccacggcctcgctgcctccgacgcccacaagcttccaccctctgaccccgacgctgcccactttaccgtctcgcgtgaaggaagagctgtgcccaagcgcattgcctagccctacttctcagcaaccgagggttgaggtgaggatgagggaaggccgggcagtgaacatccacatgctgtgcgctcgcaggcccggtctcctgctctctgccatgagagcgatcgaaggcctcggcctcgatgtccagcaagctgtcatcagttgcttcaatgggttttccttggacatcttcaaggccgagctgtgcaaggaaggccctgggcttctgccggaggagatcaagtccgtgctcctgcagtccgctgggttccatggcggcgtgatgccgtgagctaggacaacaagaccgctgaaaaagagacagagagagagagaaaagaaagaacaatgtagctaaggggaagtttacatgaactggtgtttccagtctcagggttggttttcgtcttttaacagtttgagaccgttacagacctgctagtcttcctttaattagtctgatagagtagaaaataatgccggtgttctccttcctggtctgttctagttcttggtacatgcttttgccctgttcagttagctagctctatctcatgaaattccgaatcgaaatcaggtgccagtcaaatccgtgtcaggctctgttcggttgttatggatttgagctctggattgattcctaaaaaaaaaaaaaaaaaa

SEQ ID NO: 1375 - DNA, 489 bp, Zea mays
  Predicted polypeptide sequence is orthologous to G1062
cgctgtcaggccacagattcgtcatccgactccgatgaggctgcatcctgtcgtcctcgactgttgactgctgtcgaggtatgctgcgcccgccatggagaatcagtgaacttttaccagagcgtcgacgcgtcctccatggagaatgctgcgcccgcggcggcagcgggggaggcaagaagaaagggatgccggccaagaacctcatggccgagcgccgccgtcgcaagaagctgaatgaccgcctctacatgctgcgctcggtggtgcccaagatcagcaaggcttctgtaacacgggcgcttaagaaaggcactacactcgattctgtcatagagatgctgaagggggttacacctgagcttttcttgccccattgttcttttcacatactataatccaaatctgaaacgtggtgtgggaaacttcatgtctattatgatattatcaaacaagctggcagacatggtaaacttccattttgggttg

SEQ ID NO: 1376 - DNA, 657 bp, Medicago truncatula
  Predicted polypeptide sequence is orthologous to G1062
acttcccctgttttcatgggtgggtccctttcagcttctgagtttcctccgagtcttgaactcgatgctgctccagtaccaccttttagtgcttcgttttctatgcctcttgagctagctcaacctcaaccgcaacaacatcatcatcaacagcaacagcaacaaccaacgacgctgtttcagaagcgtcgtggggcgttggagattccgaggttggagactgtggggaacaagaagaagaggaaggtggagaagagctgggaagaagaaggaagtggtggtggtggtggtgatgatgtggatgatttttctgagttgaattatgattctgatgagaatgggaatgatttgaataattcaaatgggactgttgttactggtggagatcagaagggaaagaagaagaaggggcttccagcgaagaatttgatggctgagaggcgcaggaggaagaaactcaatgatagattgtacatgcttaggtctgttgtgcctaagattagcaagatggatagggcttcaatactcggagatgcagttgactacttgaaggagctgctgcagcggattaataatcttcataatgaactggaatcaactccacctggctcattgcttgcaaccttctgcaagtgcaagctttcacccgttgacacc

SEQ ID NO: 1377 - DNA, 753 bp, Lycopersicon esculentum
  Predicted polypeptide sequence is orthologous to G1062
gggaagagaaagtggggtagtggggaagaacttgatgatgtgagctttgatgggtgcacattgagttatgattcagatgaccttactgaaaatgttactaataaggtggatgatactgttaagaatggtggaaatagctcaaatgcaactagcactgtcacctgtgggaatcagaaaggaaagaaaaagggacttccggctaagaatttgatggctgaacgacgacgtaggaagaagctaaacgataggctttacatgttgaggtctgttgtaccaaggattagcaagatggacagggcttcaatcttaggggatgcaattgagtacttaaaggagcttttacagaaaatcaatgacctgcataatgaactggagtccacgccacctagctcttcactgacccaaacaacaagcttctatcctctaacaccaactggaccagctctgccaggccgcatcaaggaagaactctatccgagttcatttgcaagcccactgtctagcccgactggacaacctggcaagggttgaagtaaaggcaagagaaggaagagctgtgaatatccatattgttttgcagccgcagaccaggcctcttactctcaacaatgagggcactcgacaacctcggactggacatccaacaagctgttatcagctgcttcaatggatttgccttagatatctttagagctgagcatgcaaagaagtcaagactttcatcctgatcaatcaaagcagtactgctggatt

SEQ ID NO: 1378 - protein, 412 aa, Oryza sativa
  Orthologous to G1062
MASLLGLLFSSLLFSERCEARRRARSGGEVAMDEAEAAAAAAKMDELAGGGGGGGGDWSYLAADALAAASFTAFPFHHHHHHHHRDVLSASTPSSLLLNMDAATAAAMFDFQAAFPSSSVPPPPPTTTAALPPFHDFASSNPFDDAPPPFLAPPGQKLGFLGPPGGAFGGGMGWDDDDEIEQSVDASSMGVSASLENAAPVAAGGGGGGGGGGGRGKKKGMPAKNLMAERRRRKKLNDRLYMLRSVVPKISKMDRASILGDAIEYLKELLQRINDLHNELESAPSSSLTGPSSASFHPSTPTLQTFPGRVKEELCPTSFPSPSGQQATVEVRMREGHAVNIHMFCARRPGILMSTLRALDSLGLGIEQAVISCFNGFAMDVFRAEQCRDGPGLGPEEIKTVLLHSAGLQNAM

SEQ ID NO: 1379 - DNA, 423 bp, Glycine max
  Predicted polypeptide sequence is orthologous to G1063, G2143
atggcggcgatgcagccgatacacatagacccggagtcggtgaagcagccgaagcggaggaacgtgaagatttcgaaggatccacagagcgtggcggcgcggcaccgcagagagaggatcagcgagaggataaggatactgcagagactggtcccgggagggactaagatggacactgcttccatgttggacgaggccattcactacgtcaagtttctcaaaacgcaggttcagtcactccaacgcgcttcctccgctaacaacaatattaggccacttggtactagtactgttaacgcaacaggaatagggttccctgttgctatgtctaccacttccaattccaccccttattttcctctgcctaaaccttaccaagctcgccacatggagaatatgcacgatagatatgattaaggttgt

SEQ ID NO: 1380 - DNA, 931 bp, Glycine max
  Predicted polypeptide sequence is orthologous to G1063, G2143
acgagagctcctcatcaacaaccagcgcttccaccctattcaacaacaatgtaacaaccacaattccaccgacgacaacaccgtcaaataatgttgtccaattttccaacattgatgaccttttccaacaacaaccacctatgtcacagtcccttcaacttcaaccctacccttctgaaaagaagaagaagaacaacaattcggctcctcctcgatggcggcgatgagggagatgatattccgaatagcggttatgcagcccgttcacatcgatcctgaatccataaagccacccaagagaaggaacgtgaagatctccaaggatccgcagagcgtggcggcgcggcacagaagagaaaggataagcgagagaataaggattcttcagagattggtccctggcggcaccaagatggacactgcttctatgttggacgaggccattcactacgtcaagttcttgaagaaacaggtgcagacgctggagcaagcaggggcaaatacgtcaccacacagtaatactaatagtcccaataatcacgttgttggtgctgctggttttccgctagggatgtcttctaactactccaataatagtagtgttaattattcttctttgttgatgaagggtggttgccaaccttgtcaaatgttcggttccacttctaaacaattgctcagctaatagttgttaggggaagtttgagagggaatttgcttgtttttgtgatgagaaagcaatgggttgtgtagtgttgatcaattggtgtatgcatgggtttggtggatcgggaagaacatgtttctccatgttaatgccattgttgcaatgatcttttgcttttacaatggtgggggtgggtgtaatcgaaatttcattaacataatggatgagtatgttctacaaaaaaaaaaaaaaaaaactcgagac

SEQ ID NO: 1381 - DNA, 1137 bp, Glycine max
  Predicted polypeptide sequence is orthologous to G1063, G2143
aattcggcaccagtaatcccgcaggctgcagcactttctgcaatctgtaatccgtgcactagtgtttcatattattcttcttatctctcttctgcaaagtgcaaaccctacttactactttcacagctccttcctctgatcctcttccttcccatactctctgctcctaactttttctctcttctcccctttcttccattcctccttgtctctcgcaacgcaaaattcatggacgtggataaactgaaaacttccactagtgacagcagcatggacatgatgatgatgatgatgcaaatggaaaagttccctgaattttgtgaacctttttataacaacaacactactactactactactactactcttctctacccagaaaacgagtacttcttaaactccaccaccaccactctacccgtgttccccaacgtcaacaacccaaacgttataacgccaccacccaccactttgattaatccaccaccaccttcctccaatttcgttctacaacaacccatgacacctcatcttgaacccaacccggagaagaagaattctgtggcggctatgagggagatgattgtccgtgtagcagtgatgcaacctggtcatatagacccggaatccatcaagccaccgaagagaaggaacgtgaagatttcaaaagatccccagagtgtggcggcgaggcacagaagagaaaggataagcgagagaataaggatacttcagagattagttcctggtgggaccaaaatggacacggcttctatgttggatgaagccattcactacgtgaagttcttgaagaagcaagtgcagacgctggaacaagcaggggcaagtagacccttgaatgttgttggcttccctactactgcgtccaacgccaataataataatagttattctggttttgtgaagagttgtcagccttatccaatgctgggttctgcagcttctaaacaattgcttagttgagaagtgtttgtttgatacatgcatgaaaaatgaaaatcaatgaattatatatgtggtttttattttattttttatcttcatagtattgtgatcgatcgtgcatggattataaagacagtgtttgtcagtgtaattgtcattgtttcgagaatt

SEQ ID NO: 1382 - DNA, 742 bp, Glycine max
  Predicted polypeptide sequence is orthologous to G1063, G2143
cccatactctctgctcctaactttttctctcttctcccctttcttccattcctccttgtctctcgcaacgcgaaattcatggacgtggacatactgaaaacttccacgagtgacaacatcagcatggacatgatgatgacgatgatgcaaatggaaaagttccctgaattttgtgaacctttttataacaacaacaacccatgacaccccatcttgaacccaacttggagaagaggaattctgtggcggctatgagggagatgattctccgcgtagcagtgatgcaacctattcatatagacccggaatccatcaagccacccaagagaaggaacgtgaagatctcgaaggatccgcagagcgtggcggcgcggcaccggagagagaggataagcgagaggataaggattcttcagagactggtccctggcggcaccaaaatggacacggcttcgatgctggacgaggccattcactacgtcaagttcttgaagaagcaggtgcacacgctgggacaagcaggggcaaataggtcaccacacagtagtaataataataataatattctcaatactactcacgttgttggtgctgttggttttccgctagggatgtcttctaattactccaataatataattagtaatgttgttaattattctttgttgatgaagggtggttgccaaccttgtcaggtgttcggttccacttctaaacaattgctcagctaattatagttgag

SEQ ID NO: 1383 - DNA, 544 bp, Glycine max
  Predicted polypeptide sequence is orthologous to G1063, G2143
acgagagctcctcatcaacaaccagcgcttccaccctattcaacaacaatgtaacaaccacaattccaccgacgacaacaccgtcaaataatgttgtccaattttccaacattgatgaccttttccaacaacaaccacctatgtcacagtcccttcaacttcaaccctacccttctgaaaagaagaagaagaacaacaactcgatggcggcgatgagggagatgatattccggatagcggtgatgcaaccggttcacatcgacccggaatccataaagccacccaaaagaagaaacgtgaagatctcgaaggatccacagagcgtggcggcgcggcaccggagagagaggataagcgagaggataaggattctacagagactggtccctggcggcacaaaaatggacactgcttcgatgctggacgaggctattcactacgtcaagttcttgaagaaacaggtgcagacgctggaacaagcaggggcaaataggtcaccacacagtagtaataataataataatattctcaatactactcacgt

SEQ ID NO: 1384 - DNA, 622 bp, Lycopersicon esculentum
  Predicted polypeptide sequence is orthologous to G1063, G2143
tgtggtatcccttttagcccatctttcattctaatatttctatatatcctcttgtttttttatttttaccttacaaaaacaaatcatggatttacaaaatattgctcactcactagaacttggattctccaatagcaatattgaaatgatacctttacaatcaccactccataactccaattacttaatgaattctcctccatctaatttctcattcatgggcaatccaattgaagagccagccgcgatgccaatactctcatcgatcgatgaaattatagcatcgactcatggtaatggaaatgattactcatgtttgcagaggaggaattctatggaggctatgagggagatgatttttcgtatcgcgatgatgcaaccaattcacattgatccagaatcagttaaacctcccaagaggaaaaatgttaagatatcgaaggatccacagagtgtggcagccaggcatcggagggaacgaataagcgaaaggataaggattttgcaaagactagtccctggaggaactaaaatggatactgcttcaatgttagatgaggctgtccattatgttaagtttttaaagaagcaacttcaatcactagagcaagccgcggttaat

SEQ ID NO: 1385 - DNA, 2015 bp, Glycine max
  Predicted polypeptide sequence is orthologous to G1064
aatccggctcgcgctctctctctctctctctctccacacagagaaaacaacccagctgcaataagctcccatctgaaaggaattccatgctccacaaaacacacaaacagagaaaagagagacccactagcccactaagcgatacaaattgagggtcacctcatcacacctccttagctactacacacaaacacaacaacatacatagcaaaaaaataatatagaaaaagaaatctagtggcagtactactacttactacttccactatagctgctagctaccagataggaggaccagagtaagggtgagactttttttttttaataccccaccaattcatttatttttcttcttttttttcattaaaaaaaaaaagtgcttatagagaagcttggttatatgagataacaagatcatggaaattggaggctgatcatcaaaatgggatccgaagcaggcccaatttccctctgcagctgttagagaaaaaggacgttgatgacgtcaccgaacaaccttgttccaccaccagcgtggtaactactgctgctgctactattacttctggtaacaacgacctccacgtggcggagcagtcgaagaagcctccgccaaagcggagttccacgaaagaccgccacacgaaggtcgatgggcgaggccgccggattcgcatgccagcggcctgcgccgcaagagtgttccaactcacgcgtgagctgggacataagtctgatggtgagaccatcgagtggctcctccagcaggcggagccggcggtcatcgctgccacaggcaccggcaccattcccgccaacttcacctcccttaacatctccctccgcagctccggctccaccatgtcggcgccttctcactacttccgcggaaactacttcaaccctagcacgttctccacctcagccgccgctgcttccgcggcggcggtggcacagctaaggagccgcgcggagtgggaccggaacatgagcatggtgatggaggattctcgtaggagcatgctggagaacacttcttccatctccgcaattttgaatttcaaccctatgggtaacgtcaatgtaattcaacaagcgaaacaagagcttcgagaagaatccgccgccgccggtggcggcggcagtcttgattcggtggcttcggattccgatggaagcttagggagaaagagaaggccagagcaagagctatcacaaatgggaagctacttgatacaatcaagcacagggtcgcttccgtcgagccacgcttccaatacggcggcgttttggatggtggccggtcacggcaaccaagccatgagtggtggtggtggcagcgatggtagcagcgataatcccatttgggcaattccctctgttgggaatagcggtgtgtatagaggagctatgtctgccccaggtggcattcatttcatgaattttgcttctccgatgaaccttatccccggagctcaactaggttccgccatggttgggggcggaagtggtggcggcaacagtggttctcaacttctaagtgaaagtaacttaggcatgcttgcagcccttaatgcctacaggcagattccggctaacggcgtctcggagtctccggccagcgccgggcaacctcacggcggagacgatggacgtgattcctccggtcaacattcctgagggtaaaaataatcacaagtgtatgatctgatgctagcttcttaatttttcttttaattactagtatattattactagtgctactattactactattagttctacaactaattagtggtttctataatatatatatatatatatatatatatatatatatatatatatatatatatatatatatatatattaaatacgtacttatatatgttatgtccatttgcaaaaacatgcaagaagcgcaagtttgattgcttattgagttcagtttgtggtgtgatttttgggcggccgctgatcatgttagggttcaatacgtatactttaccaatggt

SEQ ID NO: 1386 - DNA, 1637 bp, Glycine max
  Predicted polypeptide sequence is orthologous to G1064
ggctcgagaaaagtgcttatagagaagcttggttatatgagataacaagatcatggaattgggcgctgatcatcaaaatgggattcgaagcagactcaatttccctctgcagctgttagagaaaaaggacattgatgacgtcacggaacaaccttgttccaccaccagcgtggtaactgctactactactgctattactactactactacttcagataacaacgacctccacttggcggagcagtccaagaagcctccgccgaaacggagttccaccaaggaccgccacacgaaggtcgatgggcgaggccgccggatccgcatgccggcggcctgcgctgccagagtgttccagctcacgcgtgagctgggacataagtctgacggcgagaccatcgagtggctcctccagcaggcggagcccgccgtcatcgccgccactgggacaggcaccattcccgccaacttcacctccctcaacatctccctccgcagctctggctccaccatgtcggccccgtcgcactacttccgcggaaactacttcaaccctagcacgttctccacgtccgccgccgcggcggcggcggctcatctgagaagccgcgcagagtgggaccggagcatgagcatggtgatggaggattctcgaaggagcatgctggagaacacttcttcaatctccgcaattttgaatttcaaccctatgggtaacgttaatgtaattcaacaagcgaaacaagagcttcgggaagaatccggcgggggcggcggtcttgaatcggtggcttctgattccgatggaagcttagggagaaagagaaggccagagcaagaactatcacaaatgggaagctatttgatacaatcaagcacagggtcgcttccggcgagccacgcttccaatacggcggcgttttggatggtggcgggtcacggcaaccaagccatgagtggtggtggcagcggcggcggtggcaacaatggtagcagcgataataatcccatttgggcaattccctctgttgggaatagtggtgtgtatagaggagctatgtctgctccaggtggcattcatttcatgaatttcgcttctccgatgaaccttatgcccggaggtcaactaggttccggtatcgttggtggcggtggcggcggtggtggcaacggcggtgctcaacttctaagtgaaagtaacttaggcatgcttgcagcccttaatgcctacaggcagattccggcgaacggcgtctcggagcctccgggcagtgccgggcaacatcacggcggagacgatggacgtgattccaccagtcaacattcctgagggtcaaaataatcacaagtgtatgatctgatgctagcttcttaatttttcttttaattactatattattcctagtgctattattactactattagctctactactaattagtgatttgcataatatatattaaatacgtaattatatatgttatgtccatttgcaaaaatatgcaagaagcgcaagtttgattgctttggtatattgagttcagtttgcggttttggttggacctttggtgtgattttgctgaggttgatcatggtagggtttaattcgagaagaaatttatacccgtatatttttacc

SEQ ID NO: 1387 - DNA, 563 bp, Glycine max
  Predicted polypeptide sequence is orthologous to G1064
ggctcgagctcctccccacaccctcctccgaaccttcccccaaaaaaccaccccccaaaagaacctccaccaaagaccggcacacgaaggtcgacggtcgcggtcgtcgaattcgaatgccggctctctgcgccgctagggtgttccagctcacgcgtgagctgggacacaagtctgacggcgagaccatcgagtggctcctccaacaggcggagccatccgtcattgctgccaccggcaccggcactatccccgctaacttcacctccctcaacatctccctccgcagctccggctcatccatgtccgttccctcccaactacgatccagctacttccacaactcaaacttctccctccaacctagaagaagcctattcctagaaaacaccaacactccttccacaacaacaacactccttcatttccaatccaacaacaacaacgccatcttccaacccaagcacgaattgcgcgaatcttcatcactagacttgtcctcagagaacaacaacgaagagggttattttggaagaataagaagacccttggagcaagaccta

SEQ ID NO: 1388 - DNA, 633 bp, Zea mays
  Predicted polypeptide sequence is orthologous to G1064
  misc_feature (615)..(615): n is a, c, g, or t
ccgtactgccttgccccctactttgcctcgcttagcttaggcggcgctgatacccactctcgccgtccttgttgccgcggcgctctgctcacgatggagttccgcgatgcatgtgctgctcgcggctcggggcgcgcgtgctggtcgacgcgccgcaagcgcacgagatggacatgggtgagacgaccgcgccgacgcccgagacgagcaccacaacctgggccgcgcagtatgatctggtcgaggctaaggtcgaccagtagttcatgctccacgaccaggagcaggagcagtaccagcttcagccgaacctgcggatacatattgaccaggcgtcagcggcagcccaggacgatcgcggtggacttaaggagcagcagaagcatgatgcatgtggtggggcagatcgggggattggatgcagcaggcgctcgcccccaagcggagctacaacaaggaccgtcacaccaaggacgacgggaggggccgacggatccggatgccggcgctctgcgccgagcggatcttacagctcacgcgggagctcggccacaagtccgacggcgagactgtgcagtggctgctgcagcaggccgagccggccatcgtcgccgncaccggcacgggcaccat

SEQ ID NO: 1389 - DNA, 1835 bp, Zea mays
  Predicted polypeptide sequence is orthologous to G1064
atcttctccttcccccggcaatcgtcctagctgcaacgcactcggcccgtcgacaaacccagccagaactccataaaatagtgtcgatcaccacaggcaaacctccctccccgtttctctctctttcactctttttctctctccaagaaataattgactccaacgccaagcgccacaagcacaagcccttgcttgcttgatgtcactctttcgctctcgctagctctaacgccaccgctgacggcgctgccgagcctccagtccaccgcccaacgtcatacaccaagtcaggtcagcagccccacaagaacacttcgtaggtcagcaaatccattattagtaccgatatttctccaggtccctgaagagaaagcatcgtcttgtgtatttatatataccatggcctgatcggctatggacgtcaccggagatgccggcggaggtcgccgccccaacttccctttgcagctgctggaaaagaaagaggaacagccctgctctacgtccccagcggttgctgtgggtgctggggctaatgggtcgggagagatgcagatgaagaaggtggcggcgccgaagcgcacatcctccaaggacaggcacacgaaggtggacgggcgcgggaggcgcatccggatgcctgcaatttgcgcggctcgggtgttccagctgacaagggagctggggcacaagacggacggcgagacgatcgagtggctgctgcagcaggcgaagcccgcggtggtggcggccacgggcacgggcaccatcccggccaacttcacctcgctcaacatctctctccgctcctcgggctcttccttctccatcccagcgcacctccgtgcggccggcccacgcttcggcggcgcgcggggggacccgtgggagcgcgtcgtgggagtgggactcgggttcggcgccgccgccgaggaccctccgtccgctacgtcctcggcgtcgtctcctctgctgctgagtttccactccggcagcgtcggtcttgacgtgtcgccgtcgccgtcgtctgccgccgccggctccgacctgtcgaagaaacggaggtgggagcaggaaatgcagcagcagcatcagcagcaataccaccagcagcagcagatggccgggtacacgacgcagagccaaatgccaggcgccgtgtggatggtgccgagcgcgagcagcaacgctcaagccgccgcagcggctggcggtggcggtggcggcagcaacgccaacgagtcgatctggacgttcccgcagccagcaagcggcggcggcggcggcgcggcgaccgtgtaccgcggcgtgccgagtgggctacatttcatgaacttccccgcggcgcccatggcgctggtccccggtggtgggcagcagctcgggctcggcggccccgtgcccgtgggcggcgccggcaacgacagtagtggcagtgccagcggcggcggcggcggcgagggccacatggggatcctcgccgcgctgaacgcgtaccgagcacatagtgccgtctcggacgctgcgccggagcagaacggagcggaaggcggctctcgtcagcaccagcagcacggcggcggcggtgagcgacaggagagcgtgagtcctcccagcgacggctcgtagcgtcttcggagttcggaggcgtgtgcgtgcactggtctgctatggcgtctctctctctttctctctctctcctgtgttaattagtctgtgcttctcgacttatcgtttgcggtttttgttaattggttgcactgttgtggcctcctctggctccttcacattcttgcaaggatcatacagagtttggtttaaaaaaaaaaaaaaag

SEQ ID NO: 1390 - DNA, 671 bp, Lycopersicon esculentum
  Predicted polypeptide sequence is orthologous to G1064
gtgaaaatttagttattaagagtgatcatggaaggaggaggaggtgacgatcatctccaccatcaccatcacaatcaccagcaccaccaacatcaccagcaatatcgtcctaacaacttccctttccaattactcgaaaaaaaagaagacgaaccttgctccagctcctccgcagctaataatattaattatccttcgctagccatttccccatccgatacaaatacgaatataaaccctaatagtaacgaccttcaaattacagttgcctctactgagactgctaaaaagccagctcccaagagaacttccactaaagaccgccacactaaggttgatggccgtggcagacgtatacgtatgccggccctttgtgctgctagggtttttcagctcactcgagaactcggtcacaaatccgatggtgaaaccatcgaatggcttcttcaacaagctgaacctgcagttatagctgctacgggaacaggtacaattccggcgaatttcacgtcactcaacatttcattacgtagttcaggatccagcatgtccgtaccatctcaacttcgatcttcgtatttcaatccgaatttttcactgtcccaaaggcgcagtttgtttcagggtatcggtttatcatcagacagatctgcaactacaacgttgctgaa

SEQ ID NO: 1391 - protein, 381 aa, Oryza sativa
  Orthologous to G1064
MDHGGGGGGGGAAPSSSNIGGGSGGGGGGGGRENHPHHPFYYSGPAAAAAAAAAAQQQQQTFMGALAITPVVAEQPQGSSGGGEKKVVAPTTPAAAGAAATTTLAKRPSKDRHTKVDGRGRRIRMPALCAARVFQLTRELGHKSDGETIEWLLQQAEPAIIAATGTGTIPANFSSLNISIRSGAASASSASNPNRASPFPALALHPHHQQHDGGPLQEDDDRQDPSAPKAREQQPTTPQAAAAAAAAAAMWAVAPNTAAPGGAFWMLPVSASSAAAARPTEQPMWSFAGGGGGAATVQAPLQFMSTRVNYPGSAGAGMSDTNLGMLAALNAYNRGGAGDQQPQQQPEMDQQGRNDDDDDDGDDSGDEDNGGANNNNNNSSQ

SEQ ID NO: 1392 - protein, 314 aa, Gossypium hirsutum
  Orthologous to G1064
MEGGGSDDHHHHHHSHHHHHQQPLHHHHHHHHRPTFPFQLLEKKEEDNQPCSSSSSLPFPSLPVSSSSADQHTSTRSISTHQISPETSKTPPPKRTSTKDRHTKVDGRGRRIRMPALCAARVFQLTRELGHKYNGETIEWLLQQAEPAVIAATGTGTIPANFTSLNISLRSSGSSMSVPSQLRSSGFSSNFSMQQRRSLFPGIGLETTPTPTTFLNFQSSSTSLGISEEAEESSLGRKRRPEQDLSSQHHQNGELLVASSTVHSGESPRSSSGNFWMVTNSNNQAMSGGDPIWTFLQLITVVCIGELCLVGCIS

SEQ ID NO: 1393 - DNA, 1325 bp, Glycine max
  Predicted polypeptide sequence is orthologous to G1069
  misc_feature (831)..(831): n is a, c, g, or t
  misc_feature (842)..(842): n is a, c, g, or t
cacaatcacatatataaatattatatatataacacacaaagttacaaaccaaaccctaatcaccttatttccaacccttctcattatttttttcttctctgttgactcaaaaacaatactatatctatcactcttaccattaatcaatcatctccctccgatcttaatttcttccatataacgagagagagagagagagagttaattagttttcctgcaacttcaacttttgttatggccaaccggtggtggaccgggtcggtgggtctagagaactctggccactcgatgaaaaaaccggatctggggttttccatgaacgagagtacggtgacggggaaccatataggagaagaagatgaggacagagaaaacagcgacgagccaagagagggagctattgacgtcgccaccacgcgccgccctaggggacgtccaccgggctccagaaacaagccgaaaccgccgatattcgtcacccgagacagccctaacgcgctgcggagccacgtcatggagattgccgtcggagccgacatcgccgactgcgtggcgcagttcgctcggaggcgccagcgcggggtttccattctcagcggcagcgggaccgtcgtcaacgtcaatctccggcaacccacggcacccggcgccgtcatggcgctccacggccgcttcgacatcctctccctcaccggctcctttctccctgggccgtcccctcccggcgccaccgggctcacaatctacctcgccggaggccaggggcagatcgtcggcggcggggtggtgggcccgctcgtgggcggcggccccccgttttgggtaatggcnggctacgtttntccaaatgctacgtacgaaaagattgcctctagagggatgatgatcaggaacacggcggcggcggaggctctccgccgggaattaccggcggtcccggcgaggcctcgtcgtcgatttcggtttataacaataacgttcctcctaatttaggtctttcgaatgggcaacatctgaaccatgaagcttattcttcttctccttgggttcattctcctcatgccagacctcctttctaattcaacgtgctagctagctagagaggaacgtgttacatatattattattacatagaaggatgataatattatgatatgatataatgatatagtgtgtttgtatatttaatttacttgcgatctcgtctcacctggacagtgaccatgccgttgcttctttctgtaatttcttcagttttaccccagtgatcactttttagttttcactcttgccatctctgcttctatatatttccttcctttcta

SEQ ID NO: 1394 - DNA, 734 bp, Glycine max
  Predicted polypeptide sequence is orthologous to G1069
cccacgcgtccggaaaatatctagctaagccctttgtttcttataagctatgtgggtttgacttcttttttttttttttgctctcttgcaatttcaacaagtgaaagaaaactcggaagacaaaaaccaaaaatccaaaactaaaccactatcagctacatagtcttcgaagaagcaactgtggcaaatccttggtggacgggtcagggagggttatctggggttgaccacccaggaacccattcacctggcctaggcaaacgcccctcagaccttggaatcagcgaaaacagtggtgggcacaatagagaagaagatgaagacaatagagatgaaccaaaagagggtgcagttgaggttggaacccgcagaccaagaggaagacctcctggatccaaaaacaagccaaaaccacccattttcgtgacaagggacagcccaaataccctgaggagccacgtgatggaggtaactggaggagctgatgttgcagaaagtgttgcccaattcgcaaggaggcgtcagcgtggggtttgtgtgctcagcgggagtggctcagtggccaatgttactcttagacagccttctgctcctggtgctgtggtggcacttcatggaaggttcgagattctgtccctaaccgggactttcctacctggccctgctcctccaggatccacaggactcaccgtgtatctggccggaggacagggccaggtagtgggagggagtgt

SEQ ID NO: 1395 - protein, 266 aa, Oryza sativa
  Orthologous to G1069, G1073
MGLPEQPSGSSGPKAELPVAKEPEASPTGGAAADHADENNESGGGEPREGAVVAAPNRRPRGRPPGSKNKPKPPIFVTRDSPNALRSHVMEVAGGADVADAIAQFSRRRQRGVCVLSGAGTVANVALRQPSAPGAVVALHGRFEILSLTGTFLPGPAPPGSTGLTVYLAGGQGQVVGGSVVGSLIAAGPVMVIASTFANATYERLPLEEEEEGSGPPMPGGAEPLMAGGHGIADPSALPMFNLPPSNGLGGGGDGFPWAAHPRPPY

SEQ ID NO: 1396 - DNA, 1409 bp, Zea mays
  Predicted polypeptide sequence is orthologous to G1069
ctgagcccccctgcttattagagttggagtccgaggtgtgctgtgcatcctctccgtatgcaggtaatcgcccgcccaagaaggtttctgagcggaaaggaataggaaagtcccgacgagaagtgcactctatctctttttatatagggactagggagagaggctggctcggtagctcagagacatcctccagtccagctgattttctcgccgcgccgtgttcaatacggctacgaaaatagtagggctggcaaaccggtggccggccggcagcgcggcggccgaggagatggggagcctcgacggcggccactcgctgcagcagggccgccaccacggctacgcccactcccagtcccacgtcggcgcgggtcccgacagcagcaacaacaacaaccgacgaggacgacgcgtcgcccccgccgccttccggggcgggaggaggtcctcgccggccgcgcgggaggcccccggggtccaagaacaagccgaagccgcccgtggtggtgacgcgggagagccccaacgcgatgcgctcccacgtgctggagatcgccagcggcgccgacatcgtcgacgccatcgcgggcttctcccgccgccgccagcgcggagtctccgtcctcagcggcacgggcgcggtcaccaacgtcacgctgcgggagcccgcgcggcccacggctacgaaaatagtagcgctgcgcggccggttcgagatactgtccatgtccggggctttcctcccggcgccggcgccgccgggggccacggggctcaccgtgtacctggcgggggggcaggggcaggtggtgggcgggagcgtcatgggggagctcatcgcttcgggccccgtcatggtgatcgccgccacgttcggcaacgccacctacgagaggctgccgctggaccaggcagacgccgaggagggcgccgtgctgtccggctcgtccgagggcgccaccgcgcagcagctggagcagcagcagagcagcgggggtcccgtcgtgccgccgtccatgtacgccgtcccgcagacgccgccgcacccgcacgacatgttcgggcagtgggggcacgcggctgtgacgcgcccaccgccgacgtcgttctagctagcgctagatgcacatgcaccagctgcgacctgcaccggccgcccgcccgccgtataccctctccacctttctagttagatttccacttcttcactagctactactatagctactactctagtttgttacgttagctctaccatggcatgcatgtgtgatcgttttcccatttcttctagctctcttccatctggagcgtgtggaatcaatgtacaattcctatttgcgaataccggaatccatcaatgtttacttaaaaaaacccaaaaagcgcggccgctcgcgatctagaac

SEQ ID NO: 1397 - DNA, 628 bp, Lotus japonicus
  Predicted polypeptide sequence is orthologous to G1069
gattctctctagaaaaagaagaggaagaaaaagaagaaacattatctttcagcaaccctggctaatccttggtggactggtcatcaggttgggttgcctggggtagacccttcaggcaactcaccaaaactttccatcaacggaagcggcagccgaagcatcggtggtgatggcgaagggggaaatagcaacatcagggatgatgaagatgaagagagagacgccggcgatgaaccgagagaaggtgcagttgagattggaaaccgtcgtcaaagagggagaccgccaggatcaaagaacaagccaaaaccgcccatctttgtcacccgggacagcccgaattctcttcggagccatgtgatggaggtggccggaggagctgatgttgctgagagcgtggcgcagttcgcgaggcggcgccagcgcggggtttgcgttcttagcgggagtggcgctgtggccaatgttaccctacgtcagcctgcggcgccgggagctgtggtggcgcttcatggaaggtttgagatcttgtccttaactggggcttttcttcctggacctgctcctccaggctccacaggactcacagtgtaccttgctggaggacagggacaggttgtgggaggga

SEQ ID NO: 1398 - DNA, 534 bp, Lycopersicon esculentum
  Predicted polypeptide sequence is orthologous to G1073
ggtgaatctgacagtgatgctggtgcaagttctggaggcggagctcccaatcgccgtcctcgaggccgtccgcctggatctaaaaataagcccaagcctccaatcatcgtgacgagagatacgcctaacgcactccgatctcacgtgcttgaagtttcgaccgatgttgatatcatggaaagtatctccaattacgcaaggcggagagggagaggtgtttgtattcttagtggtagcggcacagttaccaacgtcaaccttcgtcagcctgctgcaagtgtagtcacactccacggacgtttcgaaatacttagcctctcaggtacggtgcttcctccgcctgcaccgcccgcctccagtgggatctctatatttttatcaggtggacaaggacaagtggttggaggatccgttgtagggcctttgatcgcatcaggtccagtcgtcttaatggctgcctcttttgctaatgctgtatttgaacgacttcccttggaggaagatgatgaggctcctgctaatgttcctactaca

SEQ ID NO: 1399 - protein, 336 aa, Oryza sativa
  Orthologous to G1073
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 1400 - protein, 323 aa, Oryza sativa
  Orthologous to G1073
CGGDGEERVVEEEGHRSTGKLAAGKWWERPDDTAMAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPQGSNRRRHSPPA

SEQ ID NO: 1401 - protein, 322 aa, Oryza sativa
  Orthologous to G1073
MAGMDPTGGGGGGGVAAHYLHMLRAQQHQPLSPAGDVKAERSMLSPDESPGADADLGSDHPTSSAMVAAEDSGGGSGSGGPMRRPRGRPLGSKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDGEDPEAEAAAATPPGDAAQPTGPPPPQQQPTASQSSEVTAGDGGGGGGLGMYLGGHVGSYQQQQQQLPGPGDNFGSWSGSIRPPPF

SEQ ID NO: 1402 - protein, 235 aa, Oryza sativa
  Orthologous to G1073
MASKEPSGDHDHEMNGTSAGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEEEEAAAGGMMAPPPLMAGAADPLLFGGGMHDAGLAAWHHARPPPPPPY

SEQ ID NO: 1403 - protein, 328 aa, Oryza sativa
  Orthologous to G1073
MDPVTAAAAHGGGHHHHHHFGAPPVAAFHHHPFHHGGGAHYPAAFQQFQEEQQQLVAAAAAAGGMAKQELVDESNNTINSGGSNGSGGEEQRQQSGEEQHQQGAAAPVVIRRPRGRPAGSKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLEDDEPPQHMAGGGQSSPPPPPLPLPPHQQPILQDHLPHNLMNGIHLPGDAAYGWTSGGGGGGRAAPY

SEQ ID NO: 1404 - protein, 328 aa, Oryza sativa
  Orthologous to G1073
MDPVTAAAAHGGGHHHHHHFGAPPVAAFHHHPFHHGGGAHYPAAFQQFQEEQQQLVAAAAAAGGMAKQELVDESNNTINSGGSNGSGGEEQRQQSGEEQHQQGAAAPVVIRRPRGRPAGSKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLEDDEPPQHMAGGGQSSPPPPPLPLPPHQQPILQDHLPHNLMNGIHLPGDAAYGWTNGGGGGGRAAPY

SEQ ID NO: 1405 - protein, 289 aa, Oryza sativa
  Orthologous to G1073
MAGLDLGTSYLHHHQSLHLRHDDGGAGSDDGGHDDLSPGSGGGGGPSSTAGGAGIGGGEVVARRPRGRPPGSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLEDGDEVVPPAPAGSDQGGGGSGGMPPLGVDPSGGAATGGLPFFNMPFGMPPMPVDGHAGWPGAGVGRPPFS

SEQ ID NO: 1406 - protein, 305 aa, Oryza sativa
  Orthologous to G1073
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 1407 - protein, 334 aa, Oryza sativa
  Orthologous to G1073
MSFCERDMNKESMYQERDDMAGIRFATPPLPQQQQQQQLVECFSDEVDSRGSGGEMKDAVGSGSGQLVVVGGGDGASIEVAKKRRGRPPGSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADDDASVSVSVSLSGSGDADEHRGHQHKPEPQEPRQLRRPPPHLSAAAAVSAAQPVEPCGAPMYACHPQPQEVMWPPPARTPHPPPPPPY

SEQ ID NO: 1408 - protein, 316 aa, Oryza sativa
  Orthologous to G1073
MDPVTASIHGHHLPPPFNTRDFHHHLQQQQHQLHLKTEDDQGGGTPGVFGSRGTKRDHDDDENSGNGHGSGGDGGDLALVPPSGGGPDGAGSESATRRPRGRPAGSKNKPKPPIIITRDSANTLRTHVMEVAGGCDISESITTFARRRQRGVCVLSGAGTVTNVTLRQPASQGAVVALHGRFEILSLSGSFLPPPAPPEATGLTVYLAGGQGQVVGGSVVGALTAAGPVVIMAASFANAVYERLPLEDDELLAAQGQADSAGLLAAGQQAAQLAGGAVDPSLFQGLPPNLLGNVQLPPEAAYGWNPGAGGGRPAPF

SEQ ID NO: 1409 - protein, 258 aa, Oryza sativa
  Orthologous to G1073
MGSIDGHSLQQHQGYSHGGGAGGSNEEEEASPPPGGGSATGSAGRRPRGRPPGSKNKPKPPVVVTRESPNAMRSHVLEIASGADIVEAIAGFSRRRQRGVSVLSGSGAVTNVTLRQPAGTGAAAVALRGRFEILSMSGAFLPAPAPPGATGLAVYLAGGQGQVVGGSVMGELIASGPVMVIAATFGNATYERLPLDQEGEEGAVLSGSEGAAAQMEQQSSGGAVVPPPMYAAVQQTPPHDMFGQWGHAAVARPPPTSF

SEQ ID NO: 1410 - protein, 238 aa, Oryza sativa
  Orthologous to G1073
MASKEPSGDHDHDHELNGTSGGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEDQEEAAAGGMMAPPPLMAGAADPLLFSGGMHDAGLAAWHHARPPPPPPY

SEQ ID NO: 1411 - protein, 265 aa, Glycine max
  Orthologous to G1073
TRSNSNTNANTNTNTTEEEVSRDNGEDQNQNLGSHEGSEPGSSGRRPRGRPAGSKNKPKPPIVIIFLSPNALRSHVLEIASGRDVAESIAAFANRRHRGVSVLSGSGIVANVTLRQPAAPAGVITLHGRFEILSLSGAFLPSPSPSGATGLTVYLAGGQGQVVGGNVAGSLVASGPVMVIAATFANATYERLPLEDDQGEEEMQVQQQQQQQQQQQQQQQQQQSQGLGEQVSMPMYNLPPNLLHNGQNMPHDVFWGAPPRPPPSF

SEQ ID NO: 1412 - protein, 310 aa, Glycine max
  Orthologous to G1073
MDPVAAQGRPLPPPFLTRDLHLHPHHQFQPHHNHQNTEDEAGNGRGQKRDRDENAGGGGGATTPPQGGGEGKESGSGDGGGSDMGRRPRGRPAGSKNKPKPPIIITRDSANALRSHVMEIANGCDIMESITAFARRRQRGVCVLSGSGTVTNVTLRQPASPGAVVTLHGRFEILSLSGSFLPPPAPPAASGLAIYLAGGQGQVVGGSVVGPLVASGPVVIMAASFGNAAYERLPLEEEETPVPYHGTEGLGSPGIPGTQQQSQSQPQQQQQQLVGDPNSSSLFHGVPQNLLNSIQLPAEGYWGGSARPPF

SEQ ID NO: 1413 - protein, 247 aa, Glycine max
  Orthologous to G1073
MANRWWTGSVGLENSGHSMKKPDLGFSMNESTVTGNHIGEEDEDRENSDEPREGAIDVATTRRPRGRPPGSRNKPKPPIFVTRDSPNALRSHVMEIAVGADIADCVAQFARRRQRGVSILSGSGTVVNVNLRQPTAPGAVMALHGRFDILSLTGSFLPGPSPPGATGLTIYLAGGQGQIVGGEVVGPLVAAGPVLVMAATFSNATYERLPLEDDDQEQHGGGGGGGSPQEKNGGPGEASSSISVYTI

SEQ ID NO: 1414 - protein, 186 aa, Glycine max
  Orthologous to G1073
MAGIDLGSASHFVHHRLQRPDLEDDENQQDQDNTVTNVTLRQPAAAGAVVTLHGRFEILSLSGSFLPPPAPPGATSLTVFLGGGQGQVVGGNVVGPLVASGPVIVIASSFTNVAYERLPLDEEESMQMQQGQSSAGGGGSGDHGGGVSNNSFPDPSSGLPFFNLPLNMPQLPVDGWAGNSGGRQSY

SEQ ID NO: 1415 - protein, 270 aa, Glycine max
  Orthologous to G1073
MAGIDLGSASHFVHHRLERPDLEDDENQQDQDNNLNNHEGLDLVTPNSGPGDVVGRRPRGRPPGSKNKPKPPVIITRESANTLRAHILEVSSGCDVFESVATYARKRQRGICVLSGSGTVTNVTLRQPAAAGAVVTLHGRFEILSLSGSFLPPPAPPGATSLTVFLGGGQGQVVGGNVVGPLVASGPVIVIASSFTNVAYERLPLDEDESMQMQQGQSSAGDGSGDHGGGVSNNSFPDPSSGLPFFNLPLNMPQLPVDGWAGNSGGRQSY

SEQ ID NO: 1416 - protein, 295 aa, Glycine max
  Orthologous to G1073
MAGLDLGSASRFVQNLHRPDLHLQQNFQQHQDQQHQRDLEEQKTPPNHRMGAPFDDDSDDRSPGLELTSGPGDIVGRRPRGRPPGSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEEDEQQQQQQQLQIQPPATTSSQGNNNNNNPFPDPSSGLPFFNLPLNMQNVQLPVEGWAVNPASRPQPF

SEQ ID NO: 1417 - protein, 276 aa, Glycine max
  Orthologous to G1073
MAGLDLGSASRFVQNLHLPDLHLQQNYQQPRHKRDSEEQETPPNPGTALAPFDNDDDKSQGLELASGPGDIVGRRPRGRPSGSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEEDEQQHQQLQIQSPAATSSQGNNNNNPFPDPSSGLPFFNLPLNMQNVQLPPF

SEQ ID NO: 1418 - protein, 191 aa, Zea mays
  Orthologous to G1073
MGSLDGGHSLQQGRHHGYAHSQSHVGAGPDSSNNNNDEDDASPPPPSGAGGGPRRPRGRPPGSKNKPKPPVVVTRESPNAMRSHVLEIASGADIVDAIAGFSRRRQRGVSVLSGTGAVTNVTLREPAGAGGAAAVALRGRFEILSMSGAFLPAPAPPGATGLTVYLAGGQGQVVGGSVMGELIASGPVMVI

SEQ ID NO: 1419 - DNA, 939 bp, Glycine max
  Predicted polypeptide sequence is orthologous to G1075
ttcccttctaacctcccattccgttttctctgcagtactcaattgatccctttgtttttctattcgttctgagagctttgtgtgtatggccggcatagacttgggttcagcatcacattttgttcatcatcgccttcaacgccctgaccttgaagacgatgagaaccaacaagaccaagacaacaccgtgaccaacgtgacgttgagacagccagctgcggctggtgccgtcgtcacgctgcacggaaggtttgagatcctctctttgtcaggatcgttcctcccacctcccgctccaccaggtgctacaagtttgaccgtgttccttggtggaggacagggtcaagtggtgggaggaaatgttgttggtcctttggtggcttctgggcctgttattgttattgcttcatcttttactaatgtagcatatgagaggttgcccttggatgaagaggaatctatgcagatgcaacaagggcaatcatctgctggcggtggtggtagcggtgaccatggtggtggagtcagtaataactcttttccggacccgtcttctgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaatcgttttgtttggctaggtttgttgtaaggacgatcagtttctaggaacaactgtaaaacgttttctcttggttgctggagttattagactagactgttgtgcattaaccttgagttgaataaatcataggctcaaatcaataacaaaaatatatattttggatttttaaaaaaa

SEQ ID NO: 1420 - DNA, 659 bp, Glycine max
  Predicted polypeptide sequence is orthologous to G1075
tcgcccacgcgtccgtacggctgcgagaagacgacagaaggggccactttatttgtctctctctttcccttccaacctcatcccattccgttttctctgcagtactcaattgatccctttgtttttctattcgttctgagagctttgtgtgtatggccggcatagacttgggttcagcatcacattttgttcatcatcgccttgaacgccctgaccttgaagacgatgagaaccaacaagaccaagacaacaaccttaacaatcacgaagggcttgacctagttacaccaaattcaggtcctggtgatgttgttggtcgcaggccaagaggaagacctccaggttcaaagaacaagccaaaaccaccagttatcatcacaagagagagtgcaaacacccttagggctcacatccttgaagttagtagtggttgtgacgtctttgaatcggtcgctacctatgcaaggaagcgacaaagagggatctgtgtccttagtgggagtggcaccgtgaccaacgtgacgttgaggcagccggccgcggctggtgccgtcgtcacgctgcacggaaggtttgagatcctctctctgtcaggatcattccttgcacccccagctgcaccaggcgctacaagtttgactgtgttccttggaggagga

SEQ ID NO: 1421 - DNA, 1596 bp, Glycine max
  Predicted polypeptide sequence is orthologous to G1075
ctgtcgcgtgggaaacaaatggctgcattgtgagttctttgtccccttcaacctcatttcaattctctctctcccccattcttacttcacccgcgccccctcccccgcccgctcccgtcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagagttcatgaagatgttgacggaggatttatatcacaaaaggctttatattattttaaggtcagcaaattaatattcatggactacaacatatatataaactatatgttttttcttcttcttcatgttattttgtttttttcttatgttgttaatggatataatatgacatgataattattatgtagtctgattttcatctccttggaattttatatacttatttcccctgttaaaaaaaaa

SEQ ID NO: 1422 - DNA, 1129 bp, Glycine max
  Predicted polypeptide sequence is orthologous to G1075
tttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcttggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggcaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacagcagcatcaacagcttcagattcagtcacccgcagcgacgtcatctcaaggaaacaacaacaataaccctttccctgacccttcttcaggacttcccttcttcaacttaccactcaatatgcagaatgttcagttaccacctttttgagggttcatgaatctgataatatgagactgatgaagatcatgttgatggaggatttatcaccaaagggtttatattattataaggtcagcaaatattcatggactagaacatatatataaactatatgttcttcttcttcttgttagtatgttttttttttcttctgttgttaatgggtatcgttatgataggacatgattattattattatgtagcgagtttcagtctgactctcatgtctttgggattttatttacttatttcccttgtccattattagaatatggaaccctgtattatttaatt

SEQ ID NO: 1423 - DNA, 657 bp, Glycine max
  Predicted polypeptide sequence is orthologous to G1075
  misc_feature (477)..(477): n is a, c, g, or t
cccggagaagacgccaaacaatcagcagaagatgggccacatcaccagggcgatgtggtggggcggcgcccgcgggggcgtccggcggggtccaagaacaagccgaagccgccggtcatcataacgcgggagagcgccaacacgctccgcgcccacatcctcgaagtcgccaacggctgcgacgtcttcgaaagcgtagccagctacgcacgccgccgccagcgcgggatctgtattctcagcggcagcggaacggttacgaatgtgagcctccggcagccggcgtcggcgggggcggtggtcacgcttcacggcaggttcgagatactgtccctgacgggatcgttccttcctccgccggcgccgccgggggcgacgagtctcagcatatacctcgccggaggacaggggcaggtggtgggtgggagttgtggtcggagagtttgatcgctgcgggaccggtgattgtgatggcgngcgtcgttcacgaacgtggcctatgaaaaggttaccgttggaggaagaagagaacaggttgagatatcttggtgttgctggtaataatagtaacccctttcctgatccttcttcgggacttcctttcttcaatttgccaatgaatgttcagttgccctgtggatgcctgggccgggaaac

SEQ ID NO: 1424 - DNA, 233 bp, Oryza sativa
  Predicted polypeptide sequence is orthologous to G1075
  misc_feature (185)..(185): n is a, c, g, or t
  misc_feature (224)..(224): n is a, c, g, or t
gccggactagatatataaaccttgtggcgatccgatcgtgttcgtccatggccgacgaggggtcgtcgcgcgccgagctgatcgaggcttcgccggcgccggcgctggaccttccgtcgccgccgcggaagccgcggggccggccgctggggtccaagaacaagcccaagccgccggtggtcgtnacgcgggagagcgaggcggcgatgcggcccgtcgtgctngagctcggc

SEQ ID NO: 1425 - DNA, 1190 bp, Oryza sativa
  Predicted polypeptide sequence is orthologous to G1075
  misc_feature (1181)..(1181): n is a, c, g, or t
tttttttttgtttttttttttgagcaaccactgccgatcttgatacgcacagtaattttacattcttcaaactctgaagaaaatggaacgataagatcacacgagtacttatgcattacatagcacattaattaacatggtaaatgattaattaacctactcaaacaactagggaaagaagtggaaggctaactagctaggtagagagacattgattaaccggtgccagtgctagaacgatgtcggcggcggccgagccaccgctgcatgcccccactgcccgaacatgtcgtgcggcggcgtctgctggacggcggcgtacatcggcgggggcacgacggcgcctccgctgctctgctgctccatctgcgcggcggcgccctccgacccggacagcacggcgccctcctcgccttcctggtccagcggcagcctctcgtacgtggcgttgccgaacgtggccgcgatcaccatgacggggcccgacgcgatcagctcccccatgacgctcccacccaccacctgcccctgcccgccggcgaggtacacggcgagccccgtggcccctggcggcgccggcgccgggaggaaggcgccagacatggacaatatctcgaacctcccccgcagcgcgacggcggcggccccagtccccgcgggctgccggagcgtgacgttggtgacggcgccgctcccgctgagcacggagacgccgcgctgcctgcggcgggagaagcccgcgatggcctcgacgatgtcggcgccgctggcgatctccagcacgtgggaacgcatcgcgttggggctctcccgcgtcaccacgacgggcggcttcggcttgttcttggagcccggcggcctccccctcggccggcggcccgccgaccccgtagccgagccaccgccgggcggcggcgacgcctcctcctcctcgttgctccctcccgcgccgccgccgtgggagtacccctgatgctgctgcagcgagtggccgtcgatgctccccatcccctcggccggatcgccggccggccaccggtttgccagccctactattttcgcggtcggaaagtcgcaccaacaatctagcttctccacgccaatcgctgaagccagcgtcgctcccgtctccaagcaaaagcaaagcaagcaagcgaacccacccacttaattagccgcanacacgtccg

SEQ ID NO: 1426 - DNA, 246 bp, Oryza sativa
  Predicted polypeptide sequence is orthologous to G1075
ttttccgcccgctctacgtctccacgggctccgccgtgtcgtcgccgcgcggggcgttggagatggcggcggcggcggcggcgatggggatggggctgtcgtcgctccgggtcgtagtggttcacgccgcgattgagctctcccgccggttcactcacctgcgggggcggcggggggggcggctcgtggcctgagccggctagcgtgccgcttgtatggctgcccagtggggccgggaacgtacac

SEQ ID NO: 1427 - DNA, 433 bp, Oryza sativa
  Predicted polypeptide sequence is orthologous to G1089
cagcctacaggaggcctacagcggcagcacccaccagggcaggcggggaggcaggcagtcgttcatccacatccaccgccgccgtctcccccgccgcttctcacccattcctctccaatccggccgcgccggcgccgcatctggtccaccaagaaccccttcaaagaatccccacaaccctctagggaaagatcgcgagaattcctctcaatcgccgcttggatggggtgcgggcagtccaagatcgaccaggaggaggcggtgtgccggtgccgggaccggaggaagctgatggccgacgccgtccaggcgcgcaacgccttcgccgccgcccactccgcctacaccgttctcctcaaaagcaccggcggcgcgctctctgacttcgcccaaggcgagacgcccgacctggtggcctctcacgcccacctcg

SEQ ID NO: 1428 - DNA, 423 bp, Zea mays
  Predicted polypeptide sequence is orthologous to G1089
  misc_feature (8)..(8): n is a, c, g, or t
agcgcctncacgatctcgacgagaggatgcccaatcgcgaaaccgccgccctattgcaatggcgcccaaggccgagaagaagcccgccgtcgagaagcctgcggaggaggagccggcggcggagaaggccacggctgggaagaagcccaaggctgagaagcggctccccgccggcaagtacgcaggcaaggagggtggctagaagaaggggaagaagaaggcaaacaagtcggtggagacgtacaagatctacatcttgcaggtgctgaatcaagtgcacccagacattggcatctcgtccaaggccatgtccatcatgaactccttcatcaacgacatcttcgagaagctggcggcggaggcggccaatctggcacggtacaacaagaagcctaccattacgtccagcgagatccagacctg

SEQ ID NO: 1429 - DNA, 975 bp, Zea mays
  Predicted polypeptide sequence is orthologous to G1089
  misc_feature (4)..(4): n is a, c, g, or t
cggncgcgtgggctcaaaattagtattttagtaatgttcttacggtgggtccctcgcgacccgccggcagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggaggaggagcgccgcgagcaggaggccgagacgaagactcgccgccgccggggacggcccaagcgccgccgcgacccggggagcgaggatgaggagcccgaggagctagagctgcaaacggaggatccccgtgaggaggagatcacggaggcggtgcccgtagctgtaggggacccggtcaagatcactggcaaggggaagaagcagaagaagcactatgcttccttcgagtacgagggcaacagcttcgagctggaggaccccgtgcttctcacgcctgaggacagcaatcagaagccctatgtcgccatcctcaaggatataacagaaactgatgggagcctatatgtaactggccaatggttttatagaccagaagaggctgacaaaaaggagggtggattctgggtagcacgagatacacgagagctattttacagttttcatactgatgatgtgcctgcagaatcagtatgcacaaatgtgtgggtcatttcattcctcagcaaaacagattccagtcgaagcagcatccggggattattgtcagaaggtctatgatgcagttg

SEQ ID NO: 1430 - DNA, 1733 bp, Zea mays
  Predicted polypeptide sequence is orthologous to G1089
  misc_feature (1659)..(1659): n is a, c, g, or t
accggccagtgataccgcactcctccccttaaagccctagccatggggtcctccaggccgggcggggatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtcggacgatgaggtcagggaggagaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcaaagaggaagattgaaaggggtattgctttcccaacctgtgtatccgtcaatgacacagtttgccacttctcaccgcttgcaaccgatgatgccgttctggaagaaaatgacatggttaaaattgatatgggctgtcatattgatggctttattgctgtggtggcacatacacatgtaattacaaatgggcctgtcacaggaagggctggtgatgtgcttgctgctgccaacacagcagcagaagtcgcaatgcggcttgtgagacctgggaagaaaaataaggatgttactgaagcaattcagaaagttgctgctgcttatgattgcaaaattgtggaaggtgttcttagccatcaactgaaacaatttgtgattgatggtaacaaagttgtgctcagtgtctccaatgctgatacaaaggttgatgatgctgaatttgaagaaaatgaagtatatgcaatcgatattgtcaccagcactggggaggggaagcccaagttattggatgagaaacagaccaccatctacaaaagggccgtagacaagaattatcacttgaagatgaaagcgtcaaggtttattttcagtgagatcagccagaagttcccaatcatgccttttactgctagggcattagaagagaagcgtgcgcgtttaggcttggtggaatgcatgaaccatgaactattgcagccgtaccctgtacttcatgagaagccaggcgatcttgttgcacacataaagttcactgtgctgctgatgcccaatggatcagataagataacatcacatcctctacaggagttaaagcccaccaaatccattgaagacaatgcagagataaaggcatggcttgctttggggacgaaatcaaagaagaagggtggtgggaagaagaagaaaggcaagaaaggagatgcagcagaagcagatcccatggaggaggcgacaaacggtgctacaagccaagaataattctgatttttggaattactgccaccagcttttttcttgtttcttcgctgcatctgatggtgttatattacattcagttgtggaaaaattgagtactatttctagcttctaagaaatgaagcatcctattatcgcatcaaaaagaaaaaaaataatcgacaaggcatgcccagtgttcgttctctgcgccccgtgacgacgctcgtcacttggatttttcggagttcctcccagcccggaaatttcttncctggacattgccaactgctgagatgtagcatccggatacaaatgttcgaattacgtatacaatgttactgtgt

SEQ ID NO: 1431 - DNA, 2773 bp, Zea mays
  Predicted polypeptide sequence is orthologous to G1089
agacgccgcccctccgaacagctgaaggcctgaagcaccctcactttccccactccggagctgcacgggcacgcacgcagtttatccaacgccactgggcctcaacaacaacaatctcccaacgccgccgcttccgccgcatcaagcgctagaactaggaacccctcccaaaggatctcaagaagacaaggacaccgtcgagtcgccgccagtcgctcgatggggtgcgggcagtcaaagatcgatcaagaggaggcggtgtttcgatgccgggagcggaagcggctgatggctgacgccgtggcctcgcggaacggttttgccgccgcccacactggctacactgtccgcctgaagagcaccggcggcgcgctatccgatttcgcccaaggcgaggcgccggaccctagcctggtgtcctcccatacccaccacgctccggctgtggcgacgtcatctgtctcgactccgccaggcccctccgcagcttccgtcaacagcccctccccgccgccgccgccattcgccgacttctctcattctagcctccaaagatcctcatccacccccaacattcctatgccggagccgagggccgcagccaaaaaccgccctcctgccgatgcttctatccgagaggaggatgaggatgaggatgaggaggaacaggatggacatatcaagatcgatagcgatgacgacagtgacgacgacagtgacgaagacgacgatcaccatgagcatgacgatgttagtgggggtgacatggggcatggaccacaatcaagccggattttgatgagtagtgtgggatcttctccagtaacaccacctccgcctccaaggttgaaccacaccccaccaacgcttgccacagcaacgccaccgcccccggtgctggagtcacagatggctacctgggactacatctttggcccaactcccaccccaccacccaccctagagcagcctgctgctgatactttgtggatggaaaggcgtgataaggagccagtggctgaggtgaaggcacctgtggcaaaaacagttgttagtaagccagctgctactgaggaaaggccaccagagacggccgtagagaaggataaagcaattgaggagatgatggctaatctaccgccatcaaaacctattgtgaggaagccacccaaagcacctggcccatcacaagaagcagcacactaccagcatgcctcttcgatgggtgcagttgaaattcggaaggggaaggtaatggtggcatcaggaactgccagcttgctacagattgttacacggcttgatgataactttcttagagcttcagagagtgcgcatgatgtgtcaaaaaaactggaggccacccggatgcattatcactccaaccatgctgacagccgaggacatatcgaccactctacaaaaattatgcacgttatcacatggaaccgctccttcaagaacttacctgaccatgaggacctgaacgataattttgagattgatgatagatttgaaactcatgctgcagttctagatagaatgcttgcttgggagaaaaaactgtatgacgaagtgaaggctggggagcttatgaaaaccgattatcagaagaaggtgtctctattgcagaagcaaaagaaacggggtgttaaacttgaaaccttggagaagacaaaagctgctgttagccaattgcacacaaggtacattgtagacatgcaatccatggattcaacagtttcagaaataaatcggcttcgggatagacagttattcccaaagttaatggaccttgttgatggaatggccaagatgtggagttctatgtaccgccatcatagaagtcagttcctgatcatttctggaataagaggtttcgagattcctcctattccaagggagacaactgattctcattacatccagacttgtgagctacgtgacattgttagggagtggcatacgcagtttgagaaattgatggacaatcagaaagcatacatcagagcactcaatgcatggctgaagctcaatctcatcccaattgagagcaacataaaggagaaggtctcctcccctccaaggctggtggatccacccatcaagcacctgctgcatgcctggcatgacgagctcgaaaggcttccgattgagcttgcaaaaactgccatcaaaacctttgctgaagtcataagcactatcgtgcatcttcaggaagaggaagtaaacctaaggaggcggtgtgatgaaactcgtagggatctgaaccgaaagaaggcacagtttgaggactggcatcaaaagtacttggagagacagacagcagaaactcaaaacatagatcctgtcgaggataggaaacgcaccatcgaggaactagagattcggctgagagaggaggaggggcaccatcttaggcatgccaggcaggtgcgggagaaatcacttgcaaacctccggacacacctgccagaacttttcaggaacatgtccgattttgcttacttttgcaaagacatgtacaacaatcttagaaaaactgctgcgctgtccaaagatgaagtctaaggctgatgatatttgtgcgtgtgtatgtatactcgacaagcagtagaatgtttgctggtaacttgtcctgatgccgtctagaatacataatagtcggcattaattatgtttgtaaattggaatggacattccggactccccattgtttatttccatgctatgtactgcattggtgcgtggataaaaatctttgaattgctct

SEQ ID NO: 1432 - DNA, 452 bp, Zea mays
  Predicted polypeptide sequence is orthologous to G1089
tttgtcgccgcttccgccgcatcaagcgctagaactaggaacccctcccaaaggatctcaagaagacaaggacaccgtcgagtcgccgtcagtcgctcgatggggtgcgggcagtcaaagatcgatcaagaggaggcggtgtttcgatgccgggagcggaagcggctgatggctgacgccgtggcctcgcggaacgggtttgccgccgcccacactggctacactgtccgcctgaagagcaccggcggcgcgctatccgattttgtccaaggcgaggcgccggaccctagcctggtgttcttccatacccaccacggttcggatgtggcgaactaatttgttttgaattcccccgggcccttccaagctttcgtttacaagccctttctcgcggccggtgtcatttggcggactttttttattttatgcctccaaagattctctattccccc

SEQ ID NO: 1433 - protein, 2623 aa, Oryza sativa
  Orthologous to G1089
MSNEKVPSNAPIAPQEGNAPQNSGSNKHPGASSEETWRTPSDPFPMEITQVAPRDDDPDYIPIEQAMVVRRRSKRKAGRNRTEQEVEMDTATSAPERTETSTSAGGSGKKRRGERSKNKLPKETYNVIALDQDGKPIEPPIVRSKFSNACGTLVRTRCPINVKLWETVDDNIKTLLWNELQKYFVFPPGSEVRGRDYALKKMGDRWRQWKSDLNRDYVQKNLPPFTDYGHISQADWDTFVADRTTAEALALRKKMSELAKKNKYPHRLGSSGYAGHVDQWREIEQRFAAAGKPLLVDPMVERSKNWVWARSTGQVSDEGDILFETPDIEEVTTNLQQIVEKERSGQFVPRRERDQLTAALGTAEHSGRVRGLSSKTSWKVGFPQDAPSYKKRDKYKEQLSDKIYAQVKEHFYSLAAENPTAFPRLFPDSQQPTQSAQQTTNVPSSVGSVQTSTFPVDSITGPTPCSLVVPIGRAGKTKEVATGLAIPGRQFHNTAIPEDYARVQVAKVHSDHVSLELDIPAPEGIELLGDAVNQFILWHRRDIILSAAVLAAGSSTPSSSQAMTAAAPAPPSPPEPPSPRHPPSPPPLRSPARQPTPPPSPSQQPPLPTPQPVQASPTSPTKQHAPPAPPSVQTSPPTPQSALVEEVHIPDGTTSEPKSNTLEPRRIIPKLISTYDPKEIDKDKEKFMFSAFRNSEKRKELAHVLSDSQKSVLAAQDEVQSWLSADVPETYEYGKPFLPTYLMNKLPWEMRVMHEWYMKASRKGLGFISVAVPEGAFMSGPNGIFFISFQDLYALYKLDKMDVNLVAAFCLMQFHEADRTGAKVGYVDPTRICKTQHTIELRQDCEQLVGKTPEEKEEYVKTLHKRKKLEVATYLAIAMLAHADKDVLMVPYQFTDHYILFLVYPKDQLIISLDPAHYDKETFMEFLTILNLAHKYYRKRGGPVHIPSQKKLSVRTGWPCYKQPPGTNLCGYYVCEMLRVNGRYKTTSNRIPEIPYIAQRFNHTTILNVAADLCRFIRRDVCNARGVTPESASFADTGYDPPPKKWKGICQVGPSFEAISCNRKFIGARWYIDDEILSSISDNEVLSPRDVEGHGTHTASTAGGNIIHNVSFLGLAAGTVRGGAPRARLAIYKACWSGYGCSGATVLKAMDDAVYDGVDVLSLSIGGTKEDVGTLHVVANGISVVYAGGNDGPIAQTVENQSPWLVTVAATTIDRSLPVVITLGNGEKLVAQSFVLLETASQFSEIQKYTDEECNANNIMNSTVKGKIAFCFMGEMLNNKQQTSYPDVTTAVAAKGGRAPDIAAPGVSILAAAQIPYYKGVSYHFDSGTSMACPHVAGIIAVLKSIHPKWSPAALKSAIMTTDYSIPLAGVHQRSGEQVSGTSAFDVLHREKAAIRHCDFTMADFADALRPDKFTGVHFKRWQIRVTLWLTAMKCFWVSTGKPEGVLTAEQQKQFEEATTLFVGCILSVLGDRLVEVYMHMTDAKELWDALNTKFGATDASNDLYIMEQFHDYKMADNRSVVEQAHEIQTMAKSFGTALKHKRQEYSVEGLIASLDVEEKAREKDAASKGDGGQSSANVVHKAQNKSKGKYKAQQTTNFKKQKKNNNNPNQDERTCFVCGQVGHLARKCPQRKGMKAPAGQTSKSANVTIGNTGDGSGYGNLPTVFSVNQSTNWWVDTGANVARGSTVLMGNGSHASVHGVGTVDLKFTSGKIVQLKNVQHVPSIDRNLVSGSRLTRDGFKLVFESNKVVVSKHGYFIGKGYECGGLFRFSLSDFCNKSVNHICGSVDDEANVWHSRLCHINFGLMSRLSSMCLIPKFSIVKGSKCHSCVQSKQPRKPHKAAEERNLAPLELLHSDLCEMNGVLTKGGKRYFMTFIDDATRFCYVYLLKKKDEALDYFKIYKAEVENQLDRKIKRLRSDRGGEFFSNEFDLFCEEHGIIHERTPPYSPESNGIAERKNCTLTDLVNAMLDTAGLPKAWWGEVLLTSNHVLNRVPNRNKDKTPYEIWIGRKPSLSYLRTWGCLAKVNVPITKKRKLGPKTVDCVFLGYAHHSIAYRFLIVKSEVLDMHVGIIMESRDATFFESFFPMKDTHSGSNQPSEIIPSSIIPPEQTEHTHELVSEEDVSEAPRRSKRQRTAKSFGDDFTVYLVDDTPKSISEAYASPDADYWKEAVRSEMDSIIANGTWEVTEQPYGCKPVGCKWVFKKKLRPDGTIEKYKARLVAKGYTQKEGEDFFDTYSPVARLTTIRVLLSLAASHGLLVHQMDVKTAFLNGELDEEIYMDQPDGFVVEGFGVNYAYPCVYYRHGGGQGVILCLYVDDILIFGTNLEVINEVKSFLSQNFDMKDLGVADVILNIKLIRGENGITLLQSHYVEKILNRFGYIDSKPFPTPYDPSLLLRKNKRIARNQLEYSQIIGSLMYLASATRPDISFAVSKLSRFTSNPGDDHWRALERVMRYLKGTVELGLHYTGYPAVLEGYSDSNWISDVDEIKATSGYVFTLGGGAVSWRSCKQTILTRSTMEAELTALDTATVEAEWLRDLLMDLPVVEKPVPAILMNCDNQTTCEKTIEVCQEIKKLRSYNVGLHPNSEKPGRSLHEGTITKCDRQCIEGDGFETHVSYTMVVTQSM

SEQ ID NO: 1434 - DNA, 990 bp, Glycine max
  Predicted polypeptide sequence is orthologous to G1134, G2555
atcaattaaaaaggctcgagacagaggagaggagaggagaaggcgatgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggtaactcactcactcttttctctctacttaactaactcctttactttctgttatcttttctcttttcgccttaggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaaattgctgattgttccatgcagtgcttggctttttacgatttacttatgaattattatcagaatttttttatgttctgatgaagatcaaccataccacactctggatgctaattaaatttaatatctcctgataacttaaaagatgcatatattatacatgttaggggtgacattgccaagttcgagacgaataaattacaaatagaattttaccctagagtgttataattgtgttgtagtgttgtacaactcttaagatacacaaatctgccaagttaatagctacttggacttaagatatatacataaccatatgtgttattttattaaaaaaaaaaaaaaaaaaaaaaaaaaaaaaaaaaaaaaaaaaaaaaaaaaaaaaaaaaaaaaaaaaaaa

SEQ ID NO: 1435 - DNA, 745 bp, Glycine max
  Predicted polypeptide sequence is orthologous to G1134, G2555
atcaattaaaaaagataaacagaggagaggagaggagaaggcgatgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaaattgctgattgttccatgcagtgcttggctttttacgatttacttatgaattattatcagaatttttttatgttctgatgaagatcaaccataccacactctggatgctaattaaatttaatatctcctgataacttaaaagatgcatatattatacatgtaaaaaaaattaaaaaaataaataaaaaaaaaaaaaaaaaaaaaaaaaaaaaaaacccaaataaaaaa

SEQ ID NO: 1436 - DNA, 706 bp, Oryza sativa
  Predicted polypeptide sequence is orthologous to G1134, G2555
  misc_feature (28)..(28): n is a, c, g, or t
  misc_feature (30)..(30): n is a, c, g, or t
  misc_feature (92)..(93): n is a, c, g, or t
  misc_feature (132)..(132): n is a, c, g, or t
  misc_feature (186)..(186): n is a, c, g, or t
  misc_feature (206)..(206): n is a, c, g, or t
tctgaacctcccggtgcagccgccggcnantgagctcgtcgggcttgctgcggtacagatcggcgccgagcacgctgctcgccgagttctgnnacgacttcctctccgggtacccgatgagctccgggtggnaggagtcgtcgctcatgtcggacacgaacatctccggcgtgaagcgcagcgcgnactcgtcggagccgtcccanaacggcggcggcggcggcggcctggcgcaccagtggatcccccggccgaggacactcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaaggtactgatgagtactacacctctctctctctctctctctctctctctcttccccaataggcaatagaacagtgtttggttagcaaatagtagcagtagtagcagcaaatctgcaaatgtgcagtacaaggaccactccaaaattaacctgtccgaaacctgaaacgtatccgttttcctgcagcaaaccaacactgctgacatgctggatttggctgttgactacatcaaggatcttcagaagcaggtcaagggattaaacgacagcc

SEQ ID NO: 1437 - DNA, 548 bp, Glycine max
  Predicted polypeptide sequence is orthologous to G1140
ggttccaatcaagtaatcgagatagtgctccaactagctaataaagtgaaatatatcaacaaattaaaatcgaaccccaccaatccaaagctatcatacccttgcatgttcacgagcttccttttgattggtttgtgcagctgctaattattaaaatgacgagaacgaggataaagataaagaaaatcgacaacataacggcgaggcaggtaacattttctaagaggaggcgagggctattcaagaaagctgaagagctttctgtgctatgcgatgctgaggttggtctcattgttttctcatctaccgggaagctctttgattatagcagctccagtatgaatgacatagttacaaagtacagtacgcattcccatggcatcaacaaattggataagccatcactagaactgcagctagaagctagcaatagcgccaaattgagtaaggaaattgcagatagaacccaagaattaagttggttgaaaggcgacgatcttcaaggactaggtctaaatgagttgcagcaactggagaaaacacttgaa

SEQ ID NO: 1438 - DNA, 1208 bp, Glycine max
  Predicted polypeptide sequence is orthologous to G1140
ttggtcgtttttttttttttttttttttttccgaaggaaaactaaaatcattttcctcacaaatatggagataatatcatacctaaaccatatccattaagaaggttctactaattaacaaacacgaattactagaaaataaatattcagttggggcaatcgtagaatgtcattgttctaaacttagagatgacccaccatatatatacgtgaaccattttatccttggtgattcactcttccttttcacactaactaaaacgcagtatcatggtcccctcattgctcagaaactctgtactttgagccagcaggaaaagatagccccaacgtgagggaggtgtcaaaggaccggccttgttcatgctcgtgtctctggaccgaacatatttcattcctcggttttatcctctgcttcatcagcctgttatcttccatgaggtttgtttcccttttgcttaagaatatcgatctctcttgtaaaattttcaaccttcgctttataaactcggttcaaggatgagtccagtcgttcttctaatttctgaagctcccttagggccaatccttgcagttcttctccattcagttgtctcatttcacgaatcctgtctccaaattccttgtttaaatcagcataattacatctaagctgctccgtaggacatgattggtctaatttttcaaggttcagctctgaccataaaatatgcctttcaattaccttctgcatacttgaactagcatagtcgaagagcttgccaccaggtgaaaagactatgagtgctatctcagaatcacagagaagagagagctcgcgtgccttcttgaaaagaccactcttcctctttgagaatgtcacctgcctcgcagttacgttgtcgatcttcttgatcggtatcttccttctcaccattttcttgttaagatggaagcgcagaagaatccttgattggcggtcgagaatgcagcagaagcaaccctagctagctagccaggtagatcatgggtgatcgataaagaagaaattaagaagcgtaattaagtacaaacctaaccccccagtccttgactccaaagaaagaatggtgaggggaagacatgaatatgccacatttatctttctcccactcccattcccaatcttaatctccccttctgtcgtttctcgcagccgtactcgagccgattcggctcgagctcgagcc

SEQ ID NO: 1439 - DNA, 1015 bp, Glycine max
  Predicted polypeptide sequence is orthologous to G1140
  misc_feature (16)..(18): n is a, c, g, or t
tgcaacaatgatgcannnctagtgcaaatcatgacttcctaaatgtcaatggtgttcaattgggttatcatgtacataattaactcttaaacctataaatgatacaaagcaatcagtctaaacatatgcttttgaaataatatcatagctaaaccatatccattacggtcccactaataacaaacatgaattactagaatctattatacttgaacatacgtgaaccattttatccttggtgattcactcttccttttcagttttcacactaattaaaacgcagcatcatggtcccctcattgctcagaaactctactttgagccagcaggaaaaggtagccccaacgtgagggaggtgtcaaagagctggccttgttcatgctcatgtctctggaccgaacatatttcattcctcggtaattttatcatctgttttatcagcatgttatcttccatgagtttttttcccttttccttaagaataccgatctcttttataaaattttcaaccttcgctttataaacacggttcaaggatgagtcaagtcgttcttctaatttctgaagttcccttagggtcaatccttgcagttcttctccattcagttgtctcatttcacgagtcctgtctgcaaattccttgttcaaatcagcataattacatctcacctgctccgtaggacacgactggtctaatttttcaaggttaagctctgaccgtaaaatatgcctttcaattaccttctgcatacttgaactaccatagtcgaagagcttgccaccaggtgaaaagactatgagtgctatctcagcatcacagagaagagagagctcacgtgccttcttgaaaagaccactcttcctctttgagaatgtcacctgcctcgcagttacgtcgtcgatcttcttgatcggtatcttccttctcaccattttcttgttacgatggaaggcagaagattccttggcgatcgagaatgcagaagcgaaagcaacccccagtcctttgattcca

SEQ ID NO: 1440 - DNA, 1021 bp, Glycine max
  Predicted polypeptide sequence is orthologous to G1140
ccacgcgtccgcggacgcgtgggcccaggcattggtgggttcttaccctttattattattattattggagatgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtggtaccgagccttatccatgtacataggcaatcatcggaatccattcttagcaattcatctaaccttcctgaagatggtggtagcgacacatctctcaagttggggttaccttaagtattcaacaaaatgtagattattagaagtgaccgggttcgcttcctttatatatgttttaagtgtttcactcaaaaccagttgagtccagtgatgtttgctgtttaaaaacaactcctgcaaagtaagtaaatcctagggatgaggttctgcaggcagaattgcatgtacttgaattcgtattctattttcttttcgtagattgattcataggaagtgttatatatgcccgagttaatggtcaatgctttggccgtttcttactttctatactttgtcatcataaaaaaattattcttacctaaaaaaaaaaaaaaaaaaaggctaaaaaag

SEQ ID NO: 1441 - DNA, 905 bp, Glycine max
  Predicted polypeptide sequence is orthologous to G1140
acgaagctcggaattcggctcgagctaactggcaactaattaacgtgtttgggactcgcgagttgtgcattcctaacacccatttcaggaagcccaagcattgggagatgactagaaagaggatacagatcaagaaaatcgacaacatcagttcgaggcaagtgactttctccaagagaaggaaagggcttttcaagaaggctcaggagttgtcaaccctttgtgatgcagacatagctctcatagtcttttctgcaactagcaagctctttgagtatgccagttcaagcatgcatcaagtaattgaaaggcacgatcgctattcagcaatccatagattggatcgcccctctattgagctgcagattgagagtgactccaacaacattctgcgcaagaaagtagaagataagactcgtgaactgaggcagatgaatggggaagatctgcaaggattgacattacaagaactgcagaaactagaggaacatcttaaaagaagtttgaccaatgtttcaaaagtaaaggatgcaaaatttatgcaagagatcagctcctttaagagaaagggagtggaactaatggaggaaaaccaaagactgaaacaggtgccgagccttatccatgcacatagctataggcaatcatcggaatccattcttagcaattcatctaaccttcctgaagatggtggtagcaacacatctctcaagttggggttaccttaaataatgaacacaatgtagattatttagaagtgatcggtttcgcttcctttatatgtcagtcaaaaccaattgaatatcctgtgttgtttgctgtttaaaaacaactcgtgtaaagtaagtaaatccaaaggatgaggtcctgcatgtagaattgtgcttgaaaaaaaaaaaaaaagg

SEQ ID NO: 1442 - DNA, 1237 bp, Glycine max
  Predicted polypeptide sequence is orthologous to G1140
  misc_feature (47)..(47): n is a, c, g, or t
aaatatatcataatcttgtgatttttgcctgggttaattttatcgcnccacacacttttctcatcagccggagtatggtagccccaatttgagcgaagtatctgagctttcatagtcttgggggggtcccagtggaattgcaaaccgtacggtgacagactccgaagactgacccttcatccataacaaagttctcagattcggcaccacccatgcctttggccattaattatccccgccacgtgacgtttgagtcgctcgttctcttccatcaatagcatcccctttctttggagatcagcgatctcactcataatcttctctcccttcttttctattacacggcccaatccagtttcaagtgacctctccaattgttgcaattcttctatgtttaagccttgaagatcctctcctctcagctgccttagttgatggctcttttcggccacttccttgctcaatctggagcagttgctgttttcaactagctgcaactcgagagatggttgttccatccttgctaggttctttgagtgcaaatgatgcctttcaagtatttccttcatgcttgagcttgagtactcaaagagcttcccagtggaagagaagattatgagggcaacatcagcatcacacataaccgaaagctcctcagctttcttgaagagccctctgcgacgcttggagaacgtgacctgcctcgccgtggcgttgtcgatcttcttaatctgaatcttctccctcaccatgtaccttaacctaaaaaaagcaaagaaattaaggctgagccgttgactacttatagaaaagcaaaagcaaagggtggtggtgtttttcttttgtttagtgtgagggacatgtgatgcatgtatagagcagaaaaatttaatatgcaggtgtttatctaaatttagcttttgtgaaatcaaagctttgttcggagatcctgcgatcagggtaaattttctttctttttttagtgattgttgttagtggtgttagttaggggaagacttggagttggagttggagttggtgttagtgtgtggtgggatgttgttgaaagagagagctgagtaaggatgtacttgttgatttttactttccttattgggggaaggcgttgatattaggaatgttggtttttggttcggtttggtttgccatgtttagatgatttcagctttgggttgaaagccaccaatgaaggaaagagagagaggatgagcgccaa

SEQ ID NO: 1443 - DNA, 1307 bp, Oryza sativa
  Predicted polypeptide sequence is orthologous to G1140
cgcggtggcggcgtctaaactagtggatccccggcctgcgggtccccgggctgcagggcctcgcctcgcctcacctcacctcaccctccgcctcgtctccttcccccctttcctcaacccacgcacgccctctctcccatcccagccgtagccgcgccgtgacttgtctcgatcggcggcgaggaggagggcttccgttccctggccggtaggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccagtatgaatgaaatcatcgacaagtacaacacacattctaataatctggggaaagcagaacagccttcgctcgacttgaatttagaacatagcaagtatgcacatttgaatgagcaacttgcggaagctagtctccggcttagacaaatgagaggtgaggagcttgagggattgagcattgatgaactccagcagctagagaagaacctggaagctggtctgcacagggtgatgctgacaaaggatcaacaatttatggagcagatcagtgaactccagcggaagagttcacagctggcagaggagaacatgcaactcagaaaccaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaaaaaaaaaaaaaaaaaaaaaa

SEQ ID NO: 1444 - DNA, 481 bp, Zea mays
  Predicted polypeptide sequence is orthologous to G1140
ccggtccgaaattaccggggccacccacgcgtccggagtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggggaagaatctggaatctggtctgca

SEQ ID NO: 1445 - DNA, 756 bp, Zea mays
  Predicted polypeptide sequence is orthologous to G1140
aattcggcacgagggatccactggccgccggttttctccagctggagagccattcgtgggcgtaggacgagagagaggatcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacagggcgtctaaaagaacaaaaaatatcctcactgaagacgggcagtcgtctgaatctgtaatgactgcattgcattcaggaagctcgctcgactgtgatgatggttccgatatttcctttgaagttgtcgttgccttgaaaggaagaccatcgcatcgcatg

SEQ ID NO: 1446 - DNA, 1186 bp, Zea mays
  Predicted polypeptide sequence is orthologous to G1140
ccttttttttttttttttttttttttggtagcatcatgtgtctatattatgctcttcctctttttttgataacaactaagtgcatatatataatacaccaacaatatagcgccagcaacgaaacaatacagatttttagaacgaagataacgcagcgcatacactattatatatacaaatttcgcgttagccactttgaagtacagacatgcacaaggatagcacatctggttaaaccaatataatgccgcgaatgggactatcccagtctttatcttcttagaagcactgatgtcagccccactcatgcagataacatgcgatgcgatggtccttcctttcaaggcaacgacaacttcaaggatatatctgaaccatcatcacagtcgagcgagcttcctgaatgcaatgcagtcattacagattcagacgactgcccgtcttcagtaaggatattttctgcagcagcagcaaccaccattgtgccagccgttagcacctgaggcatttgttcttttagacgcctgttctcatcttctagctgtgtgcccttttgcagtaattcgccgatttgttgcatgaatagctggtcctttgtactaatcactctatgcagtcctgcttcaagtttcctttccattcggtgcaattcctctacactcaatccctcaaggtcttcacctctcatctgtctaagtccattagtttcttcagcaagttgctcgttcaagccgctgtatttgctctgctctacattcaaatcaatagaaggctgctgatgtgatttccccagattcttagaatgtgtactgtacttgtcaacgatgtcattcacactggagctcgcgaactgcgagagcctgccggtggcggagaacacgacgagcgcgacgtcggcgtcgcacagcacggcgagctcctccgccttcttgaacagcccgcgccggcgcttggagaaggtcacctgccgcgccgccgcgctctctatccgccgtatctcccgcctctcgcgcgccatctcccacacgccgccgccgccgcgtactgctccgatcctctctctctcgtcctacgcccacgaatggctctccagctggagaaaaccggcggccagtggatccaccatcagcggacgcggggatcgggcagagaagttaaggccggcgcgtggaggggcagcatcctt

SEQ ID NO: 1447 - DNA, 1077 bp, Zea mays
  Predicted polypeptide sequence is orthologous to G1140
gggggggttttttttttttttttttttttttttttttttttttttttttttttttttttttaaacaatacagatttttagaacgaagataacgcagcgcatacactattatatatacaaatttcgcgttagccactttgaagtacagacatgcgcgggggcggcacatctggttaaaccaatataatgccgcgaatgggactatcccagtctttgtcttcttagaagcactggtgtcagccccactcatgcagataacatgcgatgcgatggtccttcctttcaaggcaacgacaacttcaaggatatatcggaaccatcatcacagtcgagcgagcttcctgaatgcaatgcagtcattacagattcagacgactgcccgtcttcagggaggatattttctgcagcagcagcaaccaccattgggccagccgttagcacctgaggcatttgttcttttagacgcctggtctcatcttctagctgggggcccttttgcagtaattcgccgatttgttgcatgaatagctggtcctttgtactaatcactctatgcagtcctgcttcaagtttcctttccattcggtgcaattcctctccacccaatccctcaaggtcttcccctctcatctgtctaagtccattagtttcttcagcaagttgctcgttcaagccgctgtatttgctctgctctccattcaaatcaatagaaggctgctgatgtgatttccccagattcttagaatgtgtactgtacttgtcaacgatgtcattcacactggagctcgcgaactgcgagagcctgccggtggcggagaacacgacgagcgcgacgtcggcgtcgcacagcacggcgagctcctccgccttcttgaacagcccgcgccggcgcttggagaaggtcacctgccgcgccgccgcgctctctatccgccgtatctcccgcctctcgcgcgccatctcccacgcgccgccgccgccgcgtactgctccgatcctctctctctcgtcctacgcccacgaatggctctccagccgaagcgacggcaaatgaaagcgaggcgaggcgaggcgaggc

SEQ ID NO: 1448 - DNA, 1335 bp, Zea mays
  Predicted polypeptide sequence is orthologous to G1140
ttgggaccctcccgcccggccggccccctggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatagtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctgccaacttccctactgttttggcgcgccgcaagctgtgctcaagcatgcttcatgtttgt

SEQ ID NO: 1449 - DNA, 1457 bp, Zea mays
  Predicted polypeptide sequence is orthologous to G1140
cccacgcgtccggtctgcctttccctctcccagtttccgtttttttaatgctttgtttactcgcggggatcatggggtaatcgcgtgggccgtgcctggctgggtttatttccttgggtcccccgaggccggccgggcccctttcctgcccctccccctccgcctttcctctctctcgctctcctcctctcctctcctctcctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacctaccacttgcatcggcatggcgcgccggccgtaagctgtgctcaagcatgcatgcttcgtgttatacgtgtgtacttattgggaagttgagtctgcatacaacctgaccgccggtgcggtcttgctgtcttacagagagaccgtttagttttc

SEQ ID NO: 1450 - DNA, 1300 bp, Zea mays
  Predicted polypeptide sequence is orthologous to G1140
gccgggaaaacatagctagggttctccttctcccctccctccgccccctcgagattttcgcgggcccgcttgctcttggacggtgcttcctcttctttaccagctagtcaaagtaaccacgcgtgctgcttcatctctcccttccttcctgccgtgtggttgttggcagccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttctagtacccgtataatcaccctgcaattacctgcagctggtcatcgttaggagaaactccagtccatgcaaatgaactcccaaaaaaaaaaaaaaaaaaaaa

SEQ ID NO: 1451 - DNA, 1426 bp, Zea mays
  Predicted polypeptide sequence is orthologous to G1140
  misc_feature (1118)..(1118): n is a, c, g, or t
  misc_feature (1129)..(1129): n is a, c, g, or t
  misc_feature (1136)..(1136): n is a, c, g, or t
  misc_feature (1171)..(1171): n is a, c, g, or t
  misc_feature (1204)..(1204): n is a, c, g, or t
  misc_feature (1259)..(1259): n is a, c, g, or t
  misc_feature (1272)..(1272): n is a, c, g, or t
  misc_feature (1285)..(1286): n is a, c, g, or t
  misc_feature (1292)..(1292): n is a, c, g, or t
  misc_feature (1331)..(1331): n is a, c, g, or t
  misc_feature (1342)..(1342): n is a, c, g, or t
  misc_feature (1389)..(1389): n is a, c, g, or t
  misc_feature (1392)..(1392): n is a, c, g, or t
cctcgcggccggccgggcctttgcgcaaaagagtactctctccctcctaccacacacagcctccggactgctccggacgcgcgcctcagatctactccaacacctccgcagcggcggcgcccgcgggtggaggagcaggagcaggagcggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtccaacagctacaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgacccagagttcgtgtacgaggaagggcagtcgtctgaatccgtgacgaacacgtcctatccgcgcccgtccaccgacaccgacgactgctccgacacatcgctcaggctcgggctaccattcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtaacggggtaccgctgcctgcagtccgtnacctgtctgtngtctctntttctagtactcgctataatcaccctgcaattacntgtagctggtcatcgttaggagaaattccagtncatgcaaattaactcccagcacttgttctcttcgcggtatcagatatgctacgtngttctttgcagtnggaacttcgatgnnaatttngcaatagcatacggagcaggtgcagagccttcagcaatngagggtaaaantgaagaagcccaaagaaaaaaaaggggttctttggcgtcacaggggntanactttaatgatgaagtaggtcaagcaaaaggtgg

SEQ ID NO: 1452 - DNA, 1120 bp, Zea mays
  Predicted polypeptide sequence is orthologous to G1140
ggccggccgggcctttcgtgcaaaagagactctctccctcctaccactcccagcctccggactgctccggacgcgcgcctcagatctactccaacacctgtatggattcctctggccgtgtggcctttccggcaactatagctagcggcggcgcccgcgggtggaggagcaggagcacgacgcggccgcgccatggtcggcaccgggaagagggagcggatagcgatccggaggatcgacaacctggcgcccaggcaggtgaccttctccaagaggcggcggggcctgctcaagaaggccgaggcgctctccatcctctgcgacgccgaggtcggccttgtcggcttctccgccaccggcaaactctgccacttcgccagctccagcatgaagcaggtaatcgatcgggacgactctcattccaagactctccagaggcccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaaatccttgacgagatcagcggtctggaaagaagagaacgcagctgatcgaggagaactctatggctgaaggagcggggtttcaagcatttctcgtgatggagcggcaccttggagtccacccatagtttgtgtatgaggaaggacaatcgtctgaatcggttcggaacacgtcttatccgcgtccgtccactgacacagagggttgctcctacacatcgctcaggcttgggctcccattcttcagctccaagtggcgcagatttggcatgtccggtaacggagcggtaccgatcgcttgcccttttcccctctagataggtctggattgggggagagcagcagtgttggatcgggaagacccaagtgaccaacgcgtcgcatcagaataaggcattttgagtgctgtatgatgtgtgtattctggctctgaaagtgagacctgcttttgttataatacatacatacaggcagcatggc

SEQ ID NO: 1453 - protein, 229 aa, Oryza sativa
  Orthologous to G1140
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGCTATQQKR

SEQ ID NO: 1454 - protein, 229 aa, Ipomoea batatas
  Orthologous to G1140
MAREKIKIKKIDNITARQVTFSKRRRGLFKKAEELAVLCDADVALIVFSATGKLFEFASSNMKDILGKYELHSSNLDQATQPSRELQLENSLHVRLSKEVADKTRELRQMKGEELQGLSLEELQKLEKRLENGLTRVLETKGERVVTEIATLQRKGAELMKENKQLKEKMARVNGEKFPVIADVEAAGLIPEEGQSSESITTNVCSCNSGPPPEDDCSDTSLKLGLPIN

SEQ ID NO: 1455 - DNA, 430 bp, Zea mays
  Predicted polypeptide sequence is orthologous to G1146
atccaccaccatccatggccatggcgtcctccccggcctgccacttccgccacccgccccgcctccgcctcctcctcccgctgtccacctcggccccccacccgtggctctactcctggtcgcacccgcgccagcgcggccgactccgcgcgccgcccgccgcgctcgacctccgtccggagccgtccccgtcgtccgactccgacgatgaggacgccgtcggtgccagccgctcctccggccgctccaccatgtccctcatcctcagccgcctccgccgcgccggctacttcggcgaggacccgcgtgccgccgccccaccgcacccgccgcgggggtcggtcgaggacgtctttcgcgccgacgatggcgtgcttcccaacgcgcgcggcgggttctacgccgactacgaggagcgggcgctcgggga

SEQ ID NO: 1456 - DNA, 557 bp, Zea mays
  Predicted polypeptide sequence is orthologous to G1146
cccgccgccggctccacgctcacctctcgcgtcccctcgccattctctcgaacgccttctcggcgtccgccgcctcgtctcggccgcgcccgccgccgctcccgccactctctccgctgctcccagcgcgccccgaggacgcgcgcctcgtagcagcgtcctcgtccgccatcgccggcggcttccacgactggttccacgagtcccgcaactccgcttctgcgccgacaccgcccaaggcgctcgacgcgatctacgaggcgctcgcgtgcgatgagacggccccattagaggcgctgccgctctcggagacgcaaagtcatgccgagcgcgggagcggatacgaggggtttcaacaatacattgttgctccttgggggtggtggatataccataagagaagttgcacgctatcggtgttatgagactggagttgctcttgaccaagagcctcaacacaagatgcctggttaatgaggactatgaatacttcggaccagattacactcttcatgttgcaccaattgacatgggagaacaaaaatacacgacaacaa

SEQ ID NO: 1457 - protein, 1504 aa, Oryza sativa
  Orthologous to G1146
MASRPRRAARAPARFGFEDGRVEAEANHESANEQSHRSNRSHRTVSRNAEVEQPRRSSRSHRTVSRDAEMEQSHLSHCTVSHNSGEERLPSPPHVENNMQHIMAVQTQILQGLTTAIASFQHNVHGHPHVGNNRSKLTDFLRSRPPEFSQTVEPVEADDWLKDVDRKLNLVQCTPVEKTLYASHQLRGPAADWWENYCNAHPEPNNIAWDEFATAFRAAHVPESTIDMKKEEFNRLKQGNNSVNEYLSQFNKLARYAPEEVDTDKKKIRKFLKGIAVGMRLQLLAHDFPTFQHMINKALLLEDARKEATEEYKKRKSNHQGNSSRGAPRPRYGQPMQYHQSITQTNRQPGYAPRPQINRPAPPPQQRAPSGNTAPNSVTSFKSPQGPSAVQCFRCNQMGHYARQCPQNPANTNSGHANGSTARTPTPAAAQSRPSSQASGQGSRASNHFGRGRVNHIQAETAQDAPDVVMGMFSVNSVPAIVLFDSGASHSFISQAFVKRNGWKTQNLRVPMIVHSPGRNIRAIQICPEVNLRIEEVDFLAKPIVLDSQSLDIILGMDWLAKHKGQIDCAEKSITLQGPGGKQVRFTPNTPTASRSILTCLQVTSLESVPIVSEYPDVFPEELTTNELAEVKRQIEELESKGYVRPSSSPWGAPVLLVKKKDGSERMVIDYRALNEVTIKNKYPLPRIDDLFDQLKGARVFSKIDLRSGYHQLKIRSEDIPKTAFSTRYGLYEFTVMSFGLTNAPAFFMNLMNKIFMEYLDQFVVKCEFWLDRVAFLGHVISSNGVEVDPSKVEAVLAWNPPKNVSEIRSFLGLAGYYRRFIEGFSKLARPMTELLKKEKKFQWSAACEDSFQEMKKRLTTAPVLTLPDIRKDFEIFCDASRQGLGCVLMQERKVVAYASRQLRPHEVNYPTHDLELAAMVHALKIWRHYLIGNRCEVYTDHKSLKYIFTQTELNMRQRRWLELIKDYDLGIHYHPGKANVVADALSRKAYCNVAQTRPNQDHLCRELEKLRLTVVQSGVPASLTVQPTLESQIREAQKDDEGIKELIKRIREKKDTNFSIDEQGTVWCGPRICVPAKKELRDLILKEAHESAYSIHPGSTKMYQDIKAYFWWAGMKRDVAEYVALCDICQRVKAEHQRPAGLLQPLPIPEWKWEEIGMDFITGLPRTPCGYDSIWVIVDRLTKSAHFVPVKTTYDGKKLAELYMTHVVCRFGCPKKIVSDRGTQFTSRFWKQLHETLGTDLNFSTAYHPQTDGQTERVNQILEDMLRACALDFEGTWDRCLPYAEFSYNNSYQASIQMSPNEAMFGRKCRTPLCWNEVGEALVFGPDILKSAEEQVKLIRERLKTAQNRQKNYADNRRRDLEFKKGDHVYLRVSPLRGMRRFGMSGKLAPRYIGPYLIAARRGEVAYQLELPEGLADVHNVFHVSQLKKCLRVPEEQVPLGSIELEKNLTYKERPIKVLEEAERQTRRKTIKFYKVQWSNHSEDEATREREDLLRAEFPELLP

SEQ ID NO: 1458 - protein, 1562 aa, Oryza sativa
  Orthologous to G1146
MAVNASFSSHGFGEGHHVAQLRDLARFLGFSCPEYTGYSVDRVPPHCELSVYLYPRGDARYPCPYSESQPVLTRMVELSEAQATQHDLLLEAYRSLARRYAALEACLAEEGVTSVDTISWDSGRLCHASHLSSHSSRGSARTPSGPRSPSSRAPYSPVYSPYPHPVSPSYTPGHTPVASSRRGPRFIRTARKRVVGSSTVFRFHYPAPPPLAMASRPRRTARAPARFGFEDGRVEPEANHESANEQSHHSNRSHRTVSRNAEVEQPRRSSRSHRTVSRDAEMEQSHRSHHTASHNSGEERLPSPPHVENNMQHLMAVQTQILQGLTTAIASFQHNAHGNGHPHMGNNRSKLTDFLRSRPPEFSQTVEPVEADDWLKDVDRKLNLVQCTPVEKTLYASHQLRGPAADWWENYCNAHLEPTNIAWDEFATAFRAAHVPESTIDMKKEEFNRLKQGNSSVNEYLSQFNKLARYAPEEVDTDKKKIRKFLKGIAVGMRLQLLAHDFPTFQHMINKALLLEDARKEATEEYKKRKSNHQGNSSRGAPRPRYGQPMQYHQSVTQANRQPGYAPRPQMNRPAPPPQQRAPSGNTAPNSVTSFKSPQGPSAVQCFRCNQMGHYARQCPQNPTNTNSGHANGSTARTPTPAAAQSRPSSQASGQGSRASNNFGRGRVNHIQAETAQDAPDVVMGPGGKQIRFTPNTPTASRSILTCLQVTSLESVPIVCAYPDVFPEELTRMPPDREIEFAIELALGTAPIAKRPYRMAANELAEVKRQIEELESKGYVRPSSSPWGAPVLLVKKKDGSERMVIDYRALNEVTIKNKYPLPRIDDLFDQLKGARVFSKIDLRSGYHQLKIRSEDIPKTAFSTRYGLYEFTFVVVFIDDILIYPKNVSEIRSFLGLAGYYRRFIKGFSKLARPMTELLKKEKKFQWSAACEDSFQEMKKRLTTAPVLTLPDIRKDFEIFCDASRQGLGCVLMQERKVVAYASRQLRPHEVNYPTHDLELAAVVHALKIWRHYLIGNRCEVYTDHKSLKYIFTQTELNMRQRRWLELIKDYDLGIHYHPGKANVVADALSRKAYCNVAQIRPDQDHLCRELEKLRLTMVQSGVPASLTVQPTLESQIREAQKDDEGIKELIKRIQEKKDTNFSIDDQGTVWCGPRIYVPAKKELRDLILKEAHESAYSIHPGSTKMYQDIKAYFWWAGMKRDVAEYVALCDICQRVKAEHQRPAGLLQPLPIPEWKWEEIGMDFITGLPRTPSGYDSIWVIVDRLTKSAHFVLVKTTYDGKKLAELYMTHVVCRFGCPKKIVSDRGTQFTSRFWKQLHEALGTDLNFSTAYHPQTDGQTERVNQILEDMLRACALDFEGTWDRCLPYAEFSYNNSYQASIQMSPNEAMFGRKCRTPLCWNEVGEALVFGPDILKSAEEQVKLIRERLKTAQNRQKNYADNRRRDLEFEKGDHVYLRVSPLHGMRRFGMSGKLAPRYIGPYLITARRGEVAYQLELPEGLADVHNVFHVSQLKKCLRIPEEQVPLVSEPEDPQCEDFEDQAPDLEQGKPPLNILNLYLKFNYVA

SEQ ID NO: 1459 - protein, 1562 aa, Oryza sativa
  Orthologous to G1146
MAVNASFSSHGFGEGHHVAQLRDLARFLGFSCPEYTGYSVDRVPPHCELSVYLYPRGDARYPCPYSESQPVLTRMVELSEAQATQHDLLLEAYRSLARRYAALEACLAEEGVTSVDTISWDSGRLCHASHLSSHSSRGSARTPSGPRSPSSRAPYSPVYSPYPHPVSPSYTPGHTPVASSRRGPRFIRTARKRVVGSSTVFRFHYPAPPPLAMASRPRRTARAPARFGFEDGRVEPEANHESANEQSHHSNRSHRTVSRNAEVEQPRRSSRSHRTVSRDAEMEQSHRSHHTASHNSGEERLPSPPHVENNMQHLMAVQTQILQGLTTAIASFQHNAHGNGHPHMGNNRSKLTDFLRSRPPEFSQTVEPVEADDWLKDVDRKLNLVQCTPVEKTLYASHQLRGPAADWWENYCNAHLEPTNIAWDEFATAFRAAHVPESTIDMKKEEFNRLKQGNSSVNEYLSQFNKLARYAPEEVDTDKKKIRKFLKGIAVGMRLQLLAHDFPTFQHMINKALLLEDARKEATEEYKKRKSNHQGNSSRGAPRPRYGQPMQYHQSVTQANRQPGYAPRPQMNRPAPPPQQRAPSGNTAPNSVTSFKSPQGPSAVQCFRCNQMGHYARQCPQNPTNTNSGHANGSTARTPTPAAAQSRPSSQASGQGSRASNNFGRGRVNHIQAETAQDAPDVVMGPGGKQIRFTPNTPTASRSILTCLQVTSLESVPIVCAYPDVFPEELTRMPPDREIEFAIELALGTAPIAKRPYRMAANELAEVKRQIEELESKGYVRPSSSPWGAPVLLVKKKDGSERMVIDYRALNEVTIKNKYPLPRIDDLFDQLKGARVFSKIDLRSGYHQLKIRSEDIPKTAFSTRYGLYEFTFVVVFIDDILIYPKNVSEIRSFLGLAGYYRRFIKGFSKLARPMTELLKKEKKFQWSAACEDSFQEMKKRLTTAPVLTLPDIRKDFEIFCDASRQGLGCVLMQERKVVAYASRQLRPHEVNYPTHDLELAAVVHALKIWRHYLIGNRCEVYTDHKSLKYIFTQTELNMRQRRWLELIKDYDLGIHYHPGKANVVADALSRKAYCNVAQIRPDQDHLCRELEKLRLTMVQSGVPASLTVQPTLESQIREAQKDDEGIKELIKRIQEKKDTNFSIDDQGTVWCGPRIYVPAKKELRDLILKEAHESAYSIHPGSTKMYQDIKAYFWWAGMKRDVAEYVALCDICQRVKAEHQRPAGLLQPLPIPEWKWEEIGMDFITGLPRTPSGYDSIWVIADRLTKSAHFVLVKTTYDGKKLAELYMTHVVCRFGCPKKIVSDRGTQFTSRFWKQLHEALGTDLNFSTAYHPQTDGQTERVNQILEDMLRACALDFEGTWDRCLPYAEFSYNNSYQASIQMSPNEAMFGRKCRTPLCWNEVGEALVFGPDILKSAEEQVKLIRERLKTAQNRQKNYADNRRRDLEFEKGDHVYLRVSPLHGMRRFGMSGKLAPRYIGPYLITARRGEVAYQLELPEGLADVHNVFHVSQLKKCLRIPEEQVPLVSEPEDPQCEDFEDQAPDLEQGKPPLNILNLYLKFNYVA

SEQ ID NO: 1460 - DNA, 1842 bp, Glycine max
  Predicted polypeptide sequence is orthologous to G1196
ggctcgagacctgattgcgattatagtgatgctgaccttgttgtcgagggaattccggttagtgttcatcgatgtattctggcctctaggagtaagtttttccatgaattattcaagagggagaaggggtcatcagaaaaagaagggaaattgaagtataacatgaatgatttgttgccttatggcaaggttggatatgaagccttcctcatattccttggctatgtatatactggtaaactcaagccctctccaatggaggtgtctacttgtgttgacaatgtttgtgctcatgatgcgtgtagacctgccattaactttgctgttgagttaatgtatgcctcttccatttttcaaataccagagttggtatcacttttccagagacgtctacttaactttataggaaaggcccttgtggaagatgtcatcccaatcctcactgttgctttccattgtcaatcaaatcaacttgtcaatcaatgtattgatagggtggccagatcagaccttgaccagatttcaattgaccaagagcttccgcatgaactctcacaaaaagttaaattgctccgccgcaaacctcagcaagatgttgaaaatgatgcttctgtagtggatgctttgtctctaaaaagaatcactagaatacacaaggcgttggactcagatgatgttgagcttgttaaacttcttttgaatgaatcagacattactttggatgaagccaatgctctccattatgctgcagcctactgtgaccccaaggttgtttctgaggtacttggtttgggactggctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgaggaggaatccaatggctggggatgcctgtatgtcttcccataccatggctgatgatctccacatgaaactactgtaccttgagaacagagtggcatttgcaagacttttcttcccttcagaagccaaactagccatggacattgcgcatgctgagacaacatctgagtttgctggtctttctgcgtcaaactcaaaaggttcaaatggaaacttaagggaggttgatctcaatgagactcctatagtgcaaaataaaagacttctttctagaatggaagcccttacgaaaacagtggagatggggcggcgctacttcccacattgctcggaagtgctggacaagttcatggaggatgacctgcctgacttgttttaccttgaaaagggtactcatgaagagcagagaatcaaaaggacgcgtttcatggagcttaaagatgacgtccacaaggctttcaacaaggacaaggccgagtttagccgctctgggatttcatcttcatcatcctcatcatccctcagagattctgttgtacattacaaggctaggaaagtgtaattttaaaaccatacatagtgtttttgattttgacatacatattatatatagtgcaaattttaaaggtgaagcccaccaactcatctgtaaaattctcgaagcaggaaagttgatgtaaacaacctgcgcatatatttttgaaaatgttttcatatgctttttggtggagaaaaaaaaaaaaaaaaaaaaaaaaaaaaaaaaaaaaaaaaaaaaaaaaaaaaaaaaaaaaaaagg

SEQ ID NO: 1461 - DNA, 2793 bp, Glycine max
  Predicted polypeptide sequence is orthologous to G1196
cacaggtctcggttcccgagcatcatctctctctctctctctgttttcccatatcttctgtttcccgtcgttggtcaacctttgttcattggttctctttctctttccatttcaagtcttcgcttctttggttcaaaggacttgagcattcttgatgttaaactagccatcttcttcttcttctttttctgcagcgttttgaagcctcttccaagagtctcttacttaagatctgctgtcgagttcatcttccctcttaagtcttaacgggtaacaccctgtatgtaatatttattcttcttttgctcttaacgtctttcccatgtcagttaagttctgaaagttcaaattttttgttctcacgcctcaatttatttgatggatcatccccagatgaaaaatcatctcagtttttgcttctgggaatctgagttttgttgcttgacttgcaagtgactttggtcttgtggtaggggaaacagtgacctttctcaattttgcttatttaatttgagcttagtttgtttagttatagattatgttagctagcttttcagtttagatgggtacttaaaggggtttaatttcttcttttgcttctaaatttggtcaaacagtgctttgactcaattggaatctcgtatatttggaatcatggataactcatatgattcatcctcatccttgagtttcgtatcatctcacctgtcacatggttctagtaatcacaacgtgtcttccaccaccagcaatgagcatggggaaaatattgaaattttgagtctgaataagctcagtggaagccttgagaagctattgattgaggctgagtatgattatagtgatgctgagattcttgttgaggacatccctgtgggtattcatcgctgtatattggcgtcgcgtagtctgtttttccatgagctttttaagaaagggactgatggatcaggcaaggaaggaaagccaaggtatctcatgtcagatttgatgccttatggcacagttggatatcaagctttccaagtgttcttgtactatctgtatactggaaggctaaaggcttcaccaacagaagagacaacatgtgttgatgaaacatgtatccatgtagcatgccgccctgctatcaatcatgccctagagctgatgtatgcttctgccacttttcagatgaaagagctagttttactttttcagcggcatctcctaaattttgttgagaaggctcttgtggaagatgtcattcctattcttatggctgctttcaactgccaactagaccagcttctctctcggtgcattcggagagtagcaaggtctgactttgacaacacatctttggaaaaagagctccctcgtgaagttgtgactgaaatcaaattgctccgactcccatttcagccagaatccacacctaatgcaatggaagtggagtccttgaatgaaaagagtataaggagaatccacaaggcattggactctgatgatgttgagctactgaagcttcttctaaatgagtctagtgtcactctagatgatgcacatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcgtgtgcatcagataccactccagatggacaaactgctcttgcaatttgtcagaggttgacgagatacaaggattatcaagagcaaacagtccagtgtaaggaatctaacaaggacaggctctgtgttgatgtcctggagagggagatgagaagaaattctatgactgtgaatatgtctgtttcatcacagctaacagccaatgatttgcacatgagactggattaccttgaagatagagttgcatttgctcggctgttttttcctgctgaggctagggtagccattgagaatgctgaagcagattcatcgtcgatgtacgcaaactcatcggctttgaagggcacaaatggcaacccgaaacaagtagatctaaatgaatctccctcggctcgtaccagaaaactccagttaagattgcatgcccttatgaaaacagttgagaatggtaggcgcttctttccccattgctctgaagtgcttgataagtttctggaagatgacgatatgccagatgttttcttcctagagaagggcagtgaagacgagcagagaatcaagaaagcacgcttcatggagcttaaagatgatgtgcaaaaggcatttcacaaggatatggctgaaaataaccattctggtttttcatctacggtgtcttcctcatcttcctcaactcgtagggaaggtcttaaccatagagtgaggagaaaatgaagcccatgttcttctagagtagagtgttgcaacttgcaagtagaagccgtggcatatttagaaaaaataagatggaatgttaaattagggggttttgctaatgaacttgggagatttttactagcttgatttagtttcttatagttgttggaccaagagaagaagaaaaataaaagaagacgaattggcttatagtaatatctttgttccttttcgaagaccctaaagtgtgtattttttactttgttatctgatcctagattgttatataattgaaaatctcacctcctgtaataattactttaaagatgacatgcaagactatttaaaagtcatttctaaaaaaaaaaaaaaaaaaaaaaaaaa

SEQ ID NO: 1462 - DNA, 832 bp, Glycine max
  Predicted polypeptide sequence is orthologous to G1196
  misc_feature (34)..(34): n is a, c, g, or t
cttgcatgcctgcagtggcatttgcaagactttntcttcccttcagaagccaaactagccatggacattgcgcatgctgagacaacatctgagtttgctggtctttctgcgtcaaactcaaaaggttcaaatggaaacttaagggaggttgatctcaatgagactcctatagtgcaaaataaaagacttctttctagaatggaagcccttacgaaaacaggtaattgcagtctttattttattttcctataaccatttgttgtaatgatgcttttaacatgtttgtttatcattcaaattcgtagccagttgggtagtgaggtcaattttgtttcaggcatgctctatttcttgtttgtggtacaggctttgtaagcttcattcatgtatctcaatactcagattttgttaaaaaagttgttcatatttgataatatatttttatgattaaaaaaaaatctaatggatatgaactagggtacacgttaaaattggttttgggttcaggggatgtaaaattcttatcgaacctgacccactggcatcagtacttgactaatttcaacctatgtggtgatggaccagaaattttttaaattagtaaattagtttggcttcaattttaataacacaaatccatagaatacccctcttttttgtatacaatggcagaaataaagtttgagcttaggatttcatgcatactacccaaatcccctacaactaagccacctctagtggattaatctataaaatatctgttatcatggaaagttgcgtctcactgtcttcgtaacatgcaaacttgtcagacacaaattaatgcgagtag

SEQ ID NO: 1463 - DNA, 900 bp, Oryza sativa
  Predicted polypeptide sequence is orthologous to G1196
gcagatgattaggtgacactatagaagagctatgacgtcgcatgcacgcgtacgtaagcttggatctctagagcggccgcggcggcgatggggctgccggcggcggcggcggcggcggtggtgggggaggggagaggactggggggaggccgcggtacaagagggaggagctcgtgccgggaggccgcgtggggcgcgacgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggcgttcaagatcaccgagctcatctcgctgttccagcgacggcttcttaacttcgtcgataagactctagtagaagatgttcttccaattctgcaagttgcttttcattcagagctgactccagtgcttgaaaaatgtattcggagaattgcaagatcaaatcttgataatgtatcgttggataaggaacttcctccagaagttgctgttcagataaaagagattcgccaaaaatctcagccaaatgagggtgacactgtcatttcagaccctgtacatgagaaaagggtcagaagaatccacagggcactggattctgatgatgttgagcttgtgaagttgcttcttaacgagtctgagatcaccttggatgatgccaatgcattgcactatgctgctgcttactgtgattcgaaagttgtttcggagttgttagacttgagacttgccaacttgaatttgaagaattcgcgtggatacacggcactccatctggctgctatgaggagagagccagctattatcatgtgtctcctaaacaaaggagcagctg

SEQ ID NO: 1464 - DNA, 2165 bp, Zea mays
  Predicted polypeptide sequence is orthologous to G1196
cacgattcgtgcccgccggccatcaggtccgcggtcgagctcatgtacgcggcgtgtaccttcaagatcctcgagctcacctcgctcttccaggcgaacctggtggcttgaagtctatgaattgaaatggaatcattattcattaggctgctcaacatttgaatattacatttatggctgtatagtttatcaatcagtttaacatcaattgagctttgctttgtctttacggaaggcaaatggttaacatggtcttcttctacagcggcggcttcttaattttgtagacaagactctagtggaggatgttattcctattctggaagttgcttcccactcagggctgactcaagtgatcgacaaatgtattcaaaggattgctagatcagatctcgacgatatatctttggataaggagctccctccagaagcagttgatgagataaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagagttgcatttgctagattgttctttcctgctgaagccaaggtcgccatgcaaatcgcacaagcagacaccacagaagaattcggcggtatagttgcagttgcagcaagcacttccggtaaactgagggaggtggaccttaatgagacgccagtgacacaaaacaaaaggctccgttcaagggtagatgcactgatgaaaacagtggagctgggccgtcggtacttcccgaactgctcgcaggtgctggacaagttcctggaggacgatctgccggaaggtctggaccagttctacctccagaggggcacagccgatgagcagaaggtgaagaggatgcgcttctgcgagctgaaagaggacgtgctgaaggcgtttagcaaggacaaggcggaggggcagcgtgttctcgggcctgtcctcgtcgtcgtcgtgctcgccgccccagaagtatgcccagaggtgatcaaggcaccagtttttgccgtatagtttgttatcatggtcttcgagacttggacccggacagcatatagggacatgtacacctgtgtatgtatagtgcttacaattggcgtaagtagaactatatgtatggaacataaggaaacatggcaggaacaccgtgcaaaaagatgaaaagatggccgaagtgctctatgcgagtgcccacctgattcgatggccctattcaacggcgccctgtcagcatgctgcatgcccactgagaccttcggttgcatagggataggaggagatttctgttcaattttggctagcaagtgatataggggtgtttaggactgtttcactttatgaaaatcaacttagctcataaacacttttaacttcaataacttaggtcctgtttggagtggctgtatttttctagtcccaagaaaataatgtggtatctgagaataccatggtctagaaaccaaaatgtgtttggcagactcttttaaaccatggtatttaaaatcttggttttgacaagaccacattatttctgggtatagaatactgtcagccgagttcggctcggctcggtgcggctcgttgactgaacgagctcgactcggctcgtccattccacgagctggtgaaagaggctcggctcggctcgaccttagctcgcgagccatattcttgt

SEQ ID NO: 1465 - DNA, 1635 bp, Zea mays
  Predicted polypeptide sequence is orthologous to G1196
  misc_feature (1631)..(1634): n is a, c, g, or t
acatcggccgcgacgccctcgtgcccgtcctcggctatctctacaccggccgcctcaagcccccggcgcaggacgccaccgtctgcatggacgacgcgtgcggccacgggacttgccgcccggccatagatttcgtcgtcgagtccatgtacgcggcgtctggcttccagatctcggagcttgcctccctcttccagcgtcgcctctctgacttcgtttgcgaagcgctggacgaggacgtggtgccgattattcatgtcgcttccacctgcgatctccaggacctgctcaatctgtgtattcagagggtcgcagtctccgctctcgatagccgctacctggacaaggagcttccggctgacatatacaacaagatcaaggagatccgccgccaaccagagaacgccattattctggaccctgagcatgacaagagggtcaggaacatcctcaaggccttggattccgacgacgtcgatctcgtcggcttgctgttgaaggaatcgacggtgaccttggacgatgcattcgcgatacactatgctgcagcctactgggagcccaaggtgtttgcagagctgctcaaactggactctgcgggcgggaacctgaagaacagcggtgggtatacgccgctgcacatagcttgcatgaggagagagccggacatcattctttcgctggtggagaggggagcctgtgtgctggagaggaccctggatgggcgcgatgctcttactatctgcaagagactgacaagagagaaagactgcaataggaagttggacaaggacgaggagaaaagtaaggcttacttggggatcgacattttggagcaagaactcaagaggaaatccttcggtttggaccccatctctatctctatagaggagtcgactgccacgcctttgctggtcgataattttcacatgaggctcataaacttggaaaacagagttgcgtttgctcggatattcttcccttctgaagccaagcttgtcatgcgcatcgcacaagccgattcaacccaagagtttgccggcatcaccaacttcagcagactcaaggaagttgatctaaacgaaaccccaacgatgcagaataggaggcttcgcgaacgccttgatgccttaacaaagacagttgagctagggagacgatacttcccacactgttcggacgttctggataagttcctcaacgaagaatccactgatccgatcttccttgagactgggaccccggaggatcagcaagtcaagaggatgcgtttctctgagctcagagaggacgtgcgcaaggcgttcacgaaagataaggcagcagtggctgcaatagcttcctcggcgtcctcgtcttcgtctccgaggtgcagacgacccaataggaaatcacggtgatgtcagtctgttcaggacacctgcactgggttgtgtgtgttttgacatgtaacactgtttcagtagataatgctgattgtcagatttgctgccgctctacagaagattaagcgaccgtctgtttcaagaattattcagacagttacttgtgattctttcaagcagcagttacaaaaaaaaaaaaaaaaaaaaaaaaaaaaaaaaaaaaaaaaaaaaaaaaaaaaaaaaagnnnna

SEQ ID NO: 1466 - protein, 624 aa, Oryza sativa
  Orthologous to G1196
MEPSSSITIASSSSYLSNGSSPCSVSLAPPGAGAVAAQAAPVAAGEGGGGGGGGGGGGSSSVEVVSLNRLSANLERLLLDSDLDCSDADVDVADGGPPVPVHRCILAARSTFFYNLFAARGRGGDGAAGGGGGGGGGGGERTGGRPRYKMEELVPGGRVGRDAFLSLLGYLYTGKLRPAPDDVVSCADPMCPHDSCPPAIRFNVEQMYAAWAFKITELISLFQRRLLNFVDKTLVEDVLPILQVAFHSELTPVLEKCIRRIARSNLDNVSLDKELPPEVAVQIKEIRQKSQPNEGDTVISDPVHEKRVRRIHRALDSDDVELVKLLLNESEITLDDANALHYAAAYCDSKVVSELLDLRLANLNLKNSRGYTALHLAAMRREPAIIMCLLNKGAAVSQLTADGQSAMSICRRLTRMKDYNTKMEQGQESNKDRLCIDILDREMIRKPMAVEDSVTSPLLADDLHMKLLYLENRVAFARLFFPAEAKVAMQIAQADTTPEFGIVPAASTSGKLKEVDLNETPVTQNKRLRSRVDALMKTVELGRRYFPNCSQVLDKFLEDDLPDSPDALDLQNGTSDEQNVKRMRFCELKEDVRKAFSKDRADNSMFSILSSSSSSSPPPKVAKK

SEQ ID NO: 1467 - protein, 89 aa, Oryza sativa
  Orthologous to G1196
HCEIVELFLSRGVDVDLDSITGTPLLTAAMNGQYSTMKILLEHHADVGADVNFRDPNGVTCVMVAANHGSPVIMKCLLDAGANSNIPDE

SEQ ID NO: 1468 - DNA, 1090 bp, Glycine max
  Predicted polypeptide sequence is orthologous to G1198
aaactcaaacttttttttttctatttctcttcagctaaagtaggagcttcctcatcatgcacataaaaactagatttacatttacaataaaacataaagacacaagggagcatagaagattgaaaagaaaaaataaataaatatttttcttttaggaagacgctgacattcatttgtaaagcagcccaacgaaatccccttaattatggcgagcaaacttctttcaggctaatgggttttaattacatctctcagaaacttgagaaataattctgagaatgttggactatttgcatttccgtagttgtttggcatgagttatcgtcgttgatcaaggtctctcgtggtcttgatgcccaaagagaactaagggcacgaagacgtccatagtactctccaataacaataaagcatcgtgctgcttgacgaactgtgagtaatcgacatagctgatgaagagtttgctgcctcaaattatcagcctggcgaacaaaaccttcaagattggcaagcttgctcatggcaacgaccatttgttgaacaccatcaaccactgggcctccagctatggtgtccacaagtgactgctgcaactgctcaagtccctgagagagtgcttcttctgcttgctgtgaggaatgcctcaagccatacatccccattatttgttgctcagctagtggctccaactgttgaatcaacatcgtgatgagatcagagggtctaaaaccaccaatccagaggaagcaacgttcagcttgggaagtccacatgccattgataaggtggaacacatctgatttagcagccacaaccttgagcctgaaaatttcatcatagtgagaaagatatccatccaccatcactctcatatcactatctgataacggtgcttgcaacccgttcctcagctcccccattagcctgtgatcttcttctaaccatcttgcatattccatgtcaaacattgcggctccagagcttacagtacttccaacacctccataatccacgaacaagccctgagagcgtgctctttgaagttcttgttctatctgggtaagctttaatctacttgactctagctgct

SEQ ID NO: 1469 - DNA, 1861 bp, Glycine max
  Predicted polypeptide sequence is orthologous to G1198
  misc_feature (5)..(5): n is a, c, g, or t
cggtnccgattcccgggtcgatatgggacatatgcacacacttcaagttttgatattctacaactttgtgatgaattgagtttcttctactttgtgagaaacttttagtttcaacttcagagaaggtgagaatggtctaagaagaagccttgcatggcgagccaaagaataggagaaacgggtttgtctgagtcaggaccttcaagtcaccatatcccttatggagttcttcatgggattaatacttcatcatcagccctaatcaatcaagggtcagcttttgattttggagagctggaagaggctattgttctgcaaggaattaagataagaaatgatgaagccaaagcatctttattcacaggcaggccttcagccacactggaaatgttcccttcatggccaatgagattccagcaaacctcaagaggaggttcaaagtcaggagaggaaagcagtgattcaggatcaggagtgaacactctttcaagcaaaaatgagctccaatttgaaacagaatctccaataagcataaaagcatctccttcagatcatcatcaggcttttgatcagcaccttcaacaacagcagcagcagcagcaacaacaacaacaggagacagcaacagcaggcacatcatcacagaatcaatcagcagccaaatcacctcaagaaaagaggaaaggagctggttccacatcagagaagccacttgatgcaaagacactgagacgtttagctcaaaacagagaagctgccaggaaaagccgtctcaggaaaaaggcttatgtgcagcaactagagtcaagtagattaaagctcacccaccttgaacaagaccttcaaagagctcgctctcagggtgtgtttatgggatgtggtggtgctggtggcagtttaagttctggagctgcaatgtttgacatggagtatgcaaaatggttagaggatgaccagcggcacatagcggagctccggtcggggctgcagacgccgctgtcggacggcgaactaagagtgattgtggatggatttctgtctcattatgatgaagttttcaggctgaaaggggtggctgctaaaacagatgtgtttcatcttattaatggcacatggacttcaccagctgagagatgcttcctctggataggtggttttaaaccatcagagctcatcacaatgttgataccacagttagagcccctggcggagcagcaaattatggtcatatgtgaactcgggcattcgtcactgcaaacagaagaagctctcagtcaaggtcttgaacagcttcagcagtctcttgttgacaccattgccggcgggcccatcgccgacggtgttcaacagatggtggcagccatgaccaagcttggccaccttgaagaatttgttgctcaggctgataatttgaggcaacaaacccttcaccaattatgtcgattgctgacagttcgtcaagcagcaaggtgttttcttgtgattggagagtattatggccgtcttagagcccttagttctctttgggcatcaagaccacgagagtcattgatcagtgatgataactcatgccaaacaaccactgaattgcaaatggttcaatcttctcagaatcatttctcaagtttctgaaatacattgtaattgaaacctggtgcaagtggatttctttgggctgctttagaaagaatggaaaagagtgtcagcatcatcaaagaattaatatcttttttttttcttctttcaatcttcctctcgtgtctcttatgttttgtaataattaaatggaattcgagttttatgtgaatgacgaggaagctcttctactttagctaaaaggagtagaggaatttaatgatat

SEQ ID NO: 1470 - DNA, 2064 bp, Glycine max
  Predicted polypeptide sequence is orthologous to G1198
ccggaattcccgcctcgccccccccgtcgcttgcgatcggtttcttcttctgggtgtgttgcttaaatctgtggaaagttcatttttttttccgattttcatgtgaccagggtcttttggggctaataaggtttgtggagagagaagatgatcgttgtgctgagcatgattattgatgggtagcagaagtagaacggtaaacgttaacactaaggacactaacaaggttctgaacgggatgccaagctacgctcctccattgccttcttctaattccatagccatggaagcaactaatgttcatccttcccgcatttctgaatttggaaccctggagcaatctcttggatttcgcgttgaagataccattaatcttagcagaaatccgatgtttaatcaaatgaaatcaaatagccaagctctaggtgctgatattcaatttggtgctttaaataagtcaattgcaacatcagatataaacctctctgctgctattgctgggtctcaagcattggtattccaaaaagattcgcaaccaactctggcttcaacatctgctggtcgtgagaactggggagagaccaacttggctgatgctagccctaggactgatacttcaacagatgatacagaagacaaaaatcaaaggcctgaaaggggtgaatccagtggatcaaaagataaatcagatcaaaagacattaagacggcttgctcaaaatcgtgaggctgccaggaaaagccgactgaggaaaaaggcatatgtgcaacaattagagagcagtaggttgaaactgacccaacttgagcaggagctccagcgagcacgccagcagggaatatttatttcaagtactggagatcaggcacagtcaatgagtggaaatggcgctatggcatttgatgtagagtacgcacgatggttagaagagcataatagacaaaccaatgagctaagggctgcaataaattctcatgctggagatattgaacttcgaaccattgttgacaatttcatgacacaatttgatgatatcttcaggctgaaaggtattgcagcaaaagctgatgttttccacattctgtcaggaatgtggaagactccagctgagaggtgtttcatgtggattggaggctttcgctcatccgaactactcaagcttcttgaaagtcagttggagcctttaaccgagcaacaattgatgggcatctacaacttgcagcagtcatcccagcaggctgaagatgctctttcccaagggatggatgcattgcagcaatcactgtctgagacattggctaatggttcacccagcacatcaggctcctcgggaaatgtggcaagttacatggggcaaatggctatggccatgggaaagcttggtactcttgatgggtttcttcgccaggctgacaatctgcggcagcagacattacaacaaatgcttcgaatattaacgaccaggcaatcagctcgagctcttctcgccatcagtgattatttctcacggctgcgagctctgagttctttgtggcttgctaggccaagggagtgaagcatttcacagccccattagtggacttctttcatgcctgactcccttaaacaccgatgatcattgaatcttgtgctctgaatgagttcaatggaagctggtgtcttttgacaatgaattcctcttgaagcctagttgtgatgctataaacattaaatgctatgatttttctactctgccaactgctggtgtggtgcaacatttttctttaagcttttgtggttttaaaatagtctcaataatttgattatataggtgtatgatagatagaagctgttgaagggaaaaatgtagaaatagtgtatctgtatttttaggttatagctgttcattgtatttcagaaatcagcttttatttgagggggtatttacctctctttagtttcatttcctgcttaatggtttgtggttggttgcacataaggctccatggtgtatgtatttatacgttctcttttggtatattagaaagacattactaactaaaaaaaaaaaaaaaaggcggccgc

SEQ ID NO: 1471 - DNA, 1824 bp, Glycine max
  Predicted polypeptide sequence is orthologous to G1198
cggacgcgtgggcaaataatgaccaatcataatcttccaggctgagagctatacagaggagagcacaattgattcttttcatgtttctgactttggagcatttgatcagtcatatcgaataggggatgctgttgacctcagtggaaacccagtttacaattcactaaaagtaaacagccaaacaatttctccaggttctgttcacattagtagtcttggtcaggtgagtttttctagttcttttcatccaatgaactccctgctttggtgaataaggcgaagttttagctggttacagtatgtcatattttctagttttctttattttctctttaatatagttgccaacttcacttgaaaaaagcccattgacgaatcaaatagagccgcataggttacgattacagaaggttcaatcatcaaatcctggcacaatattagttggtaatacagataaccaggaggagtctgccatggctgatgccagtcctaggactgatatttctacagatggtgacactgatgacaagaatcagccgtatgatagaaatgaagcccttgctgctgtttccgactctagtgacagatcgaaagacaaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcatgggattttcatatcaagctcgggtgatcaagcacatacattgagtggaaatggggcaatgcaatttgatgcagaatatgcaaggtggctggaagagcagaatcgacaaattaatgagctgaaagctgctgtaaactctcatgcaagtgacactgaacttcgcatgatcgttgatggtatattggcacattatgatgagatttttaggctgaaaggtgttgcagctaaggctgatgttttccatttgttgtctggtatgtggaaaacacctgctgagaggtgttttttgtggcttggtggttttcggtcatctgaactcctcaagatatatcaatatcgatacaagaataagaatctgcttgggtggtggtagcgaagtgccaaaagaacaattaaattgtgctctatctaaagccctgagtctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatgggtcaaatggccatggccatgggtaagctagggacacttgaagggttcattcaacaggctgacaatcttcgccaacaaactcttcaacaaatgcaccgtatactgacaactcgccaatcagctcgtgcactccttgctatacatgactacttttcgcgtctgcgtgctctcagttcactctggcttgctcgccctagagattgatgggcgcggtaaatagtatggcaaattaattttcatggatccatcactagcaatacttggtcatcataactcttgacaagttttcttgttgttttgttgtactctttgtatcactgatgttagtgcttcattgagtcagtctagaaacgaaattggtgacaagaagtatgaatattactaataatattgtccattgtaattgttgaagggctttgttttttccatacaaaaaaaaaaaaaaaaaaaaaaaaaaaaaaa

SEQ ID NO: 1472 - DNA, 1716 bp, Glycine max
  Predicted polypeptide sequence is orthologous to G1198
ccacgcgtccgcggaaattggactgatcctttctctctctctctctctctttctcctcaacgcctcttcctttcaatttaatccaacaataataattattcgcaaaaaaacgttgaacagataccatcatcatcacccacatcatcagaatttcaagctatacagagggaagcgcaattgattctttttgtgtgtttgactttgatcaatcagttggatatcgcatagaggattgtgttgccttgaggggaaactcagtttttgactcactaaaagtaagtagccaaacaatttctcggggtcctgttgaagttgattcctttgataagttagttaccaacttcactcaataaaaacccattaacaagccaaacagagcgacaaagattgcaattacaaaaggttcaattatcaaatctggtcagtggggatacggaacaccaggaagagtctgccatggctgacgccagtcctagaactgatatttctacagatgttgacactgatgataagaatccacggtttgatagaagtcagtcccttgttgctgtggtttctgactccagtgacagatcaaaggataaatcagatcagaagactctccgaaggcttgctcagaatcgtgaggcagcaagaaaaagtcggttgagaaagaaagcttatgttcaacagcttgaaagtagtcgcttaaagttaacccaactggagcaagagcttcagcgagctaggcagcagggaatcattatatcaaactcaggtgatcaagcacattcaatgagtggaaatggggctatggcatttgatgtagagtatgcaagatggctggaagagcagaatcgacaagttaatgagctaagagcagctgtaaattcccatgcaggtgatacagaacttcgcatgattatcgatggtataatggcacattatgatgagatatttaggctgaaggccgatgcagctaaggctgatgtcttccatttgttgtctggaatgtggaagacaccagcagagaggtgttttctatggcttggtggttttcggtcatctgaactcctcaagctcctggtaaatcagttggaacctctgacagagcaacagttagtgggtattaccaacttgcagcaatcttcccaacaggccgaagatgcattgtctcagggcatggaagcattgcaacagtccctttctgagacattatccactggatcacttggctcctctggttcatcaggcaatgtggcaaattacatgggtcaaatggctatggccatgggtaaactagggacacttgaggggttcattaagcaggctgacaatttgcgccagcagactttgcaacaaattcaccgcatattgacaactcggcaatcggctcgtgcactacttgcaatacatgactacttttctaggttgcgtgcccttagctctctttggcttgcccgcccaagagactgatgggtggtaaatagtgtcattaattttcatggatctggcaccagaatcatttgtcgtaggtttttcactcttgcaattttactgtgttgtagttttcatattactgatattagtgtttcagtaagttataattcagaaactgaattggtgacatgacaagggtatgtattttgtttattactactaatgtgataatattgtccattgtaacacagttgaagggatttagattatttttttacaaaatagctgcgatgcgat

SEQ ID NO: 1473 - DNA, 1722 bp, Glycine max
  Predicted polypeptide sequence is orthologous to G1198
gcgcgcgtcgccgcctcgtaagctcggcgtgaggcacgaggcctagaaattggactgatcctttctctctctctttcttcccaactcaactcaagtcctcttcctttcactttaatccaacaataataattattcgcaaaaaaaaaaaaaaaaaacacgttgaacagataccatcatcattcatcttcatcacccacatcatcagaatttcaagactcagtttttgactcactaagtaagtagccaaacaatttctcgggttcctgttcaagttgattcctttgataagttaccaacttcactcgataaaaacccattaacaaaccaaacagagtgacaaagtttgcaattacaaaaggttcaattatcaaatctggtcagtggtgatacggaacaccaggaagagtctgccatggctgacgccagtcctagaactgatatttctacagatgttgacacggatgataagaatccacggtttgatagaagtcagtcccttgttgctgtggcttctgactccagtgacagatcaaaggataaatcagatcagaagagtctccggaggcttgctcagaatcgcgaggctgcaagaaaaagtcggttgagaaagaaagcttatgttcaacagctcgaaagtagtcgcttaaagttgacccaactggagcaagagcttcagagagctaggcagcagggaatctttatatcaaactcaggtgatcaagcacattcaatgagtggaaatggggctatggcatttgatgtagaatatgcaaggtggctggaagagcagaatcgacaaattaatgagctaagagcaggtgtaaattctcatgcaggtgatacagaacttcgcatgattatcgatggtataatggcacattatgatgagatatttaggctgaaggccaatgcagctaaggctgatgtcttccatttgctgtctggaatgtggaagacaccagcagagaggtgttttctatggcttggtggttttcggtcatctgaactcctcaagctcctggtaaatcagttggaacctctgacggagcaacagttagtgggtatcaccaacttgcagcaatcttcccaacaagcagaagatgctttgtctcagggcatggaagcattgcaacagtccctttctgagacattatccactggatcacttggctcctctggttcatcaggcaatgtggcaaattacatgggtcaaatggctatggccatgggtaaactagggacacttgagggattcattaagcaggctgacaacttgcgccagcagacgttgcatcaaattcaccgcatattgacaactcggctgtcggctcgtgcactacttgcaatacatgactacttttctaggttgcgtgcccttagctctctttggcttgcccgcccaagagactgatgggggtaaatagtgtgtcattaattttcatggatctggcaccagaatcctttggcataggttttttactcttgcaattttactgtgttgtagttctcacattactgatattagtttcagtaagttattatctagaaactgaattggtgacatgacaagggtatgtattttgtttattactactaacgtaataatattgtctattgtaacacagttgaaggaatttagatgattttatacaaaaaaatggttgggatgtgaaaaaaaaaaaaaaaaaaaaaaaaaaaaaagcggccgctctacaggatcca

SEQ ID NO: 1474 - DNA, 1893 bp, Glycine max
  Predicted polypeptide sequence is orthologous to G1198
ggtggaagatttgagcagaagaagacatgtagagattggaatcatccgtgtccctctctctcatctctctttctctctcttcccttggtttccttactaattactttaacccaataatccaataactacatacaaagttgaacaataccaccatcatagcgcatcatcatcagaattccaaggggaattgttgatgtggtggtgagaatgatgtatggggagtagaactacctggagggttgttggtgttgaagatgacaagggagctgaaagaggaatgccgagcttcaattctgagttacccaattccaattcatgctatacagaggggaacacaattgattcttttcgtgtttctgactttggagcatttgatcagtcatatcacatagaggatgctgttgacctcagtggaaacccagtttacaattcactaaaggtaaatagccaaacaatttctccgggttctgttcacattagtagccttggtcagttgccaatttcactcgaaaaaagcccattgacaaatcaaacagagccaccgcataggttgcgattacagaaggttcaatcatcaaatcctggcacaatattagttggtaatacagataactgggaggagtctaccatggctgatgccagtcccaggactgatatttctacagatggtgacactgatgacaagaatcatccgtttgatagaaatcaagcccttactgctgtttccgactctagtgacagatcgaaagataaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcaggggattttcatatcaagctcgggtgatcaagcacatacattgagtggaaatggggcaatgcaatttgatgcagaatatgctaggtggctggaagagcagaatcgacaaattaatgagctaagagcagctgtaaactctcatgcaagtgacactgaacttcgcatgattgttgatggtatattggcacattatgatgagatttttaggctgaaaggtgttgcagctaaggctgatgttttccatttgctgtctggcatgtggaaaacacctgctgagaggtgttttttgtggcttggtggttttcggtcatctgaacttctcaagctgctggtaagtcaattggagcctctcacagagcagcagctgatgggtatcaccaacttgcagcaatcctctcaacaagcagaagatgcgttgtctcagggcatggaagcattgcaacagtcccttgcagagactttgtccaccggagcacctgcctcatctggttcatcagggaatgtggcaagttacatgggtcaaatggccatggccatgggcaagctagggacactagaagggttcattcaacaggctgacaatcttcgccagcaaactcttcaacaaatgcaccgtatactgacaactcgccaatcagctcgcgcactccttgctatacatgactacatttcgcgtctgcgtgctctcagttcgctttggcttgctcgccctagagattgatgggtgcagtaaatatgtcaaattagttttcatggatccatcaccaggaatacttggtcatcataggttttactcttgacaagttttcttgtgttgattgttgtagtctctgtatcactgatgttagtgcttcattgagtcacatagtctagaaacgaaattggtgacaagaagtatggatgtgtctactaataatattcaccattgtaattgaagggctttgtttttttccatataaatatagttgggcccatatgatatattttttg

SEQ ID NO: 1475 - DNA, 2172 bp, Glycine max
  Predicted polypeptide sequence is orthologous to G1198
gatttgagcagaacaagacatttagagattggaatcatccgtgttcctctctctcatctctctttctctctgttccctcggtttccttactttgaagtttaatccaatccaataatccaataactacatacaaagttgaacaataccaccatcatagcgtatcatcatcagaattccaaggtggatttgcttcatcttttactccggcttcatgctgcatgagtaaaggccgttatgttatgctcatggtggatttttgtgcaactgggactaggggaattgatgatgtggtggtggtgagaatgatgtatggggagtagaactacccaggagggttgttggtgttgaagatgacaagggagctgaaagaggaatgccgagctccaattctgagttacccatttccaattcatgctatacagaggagagcacaattgattcttttcatgtttctgactttggagcatttggatcagtcatatcgaataggggatgctgttgacctcagtggaaacccagtttacaattcactaaaagtaaacagccaaacaatttctccaggttctgttcacattagtagtcttggtcaggtgagtttttctagttcttttcatccaatgaactccctgctttggtgaataaggcgaagatctagctggtatacaggatgccatatttcctagttttctctatttcctctttaatataggggccaacttcacttgaaaaaagcccattgacgaatcaaatagagccgcataggttacgattacagaaggttcaatcatcaaatcctggcacaatattagttggtaatacagattaccaggaggagtctgccatggctgatgccagccctaggactgatatttctacagatggtgacactgatgacaagaatcagccgtatgatagaaatgaagcccttgctgctgtttccgactctagtgacagatcgaaagacaaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcatgtgaggggattttcatatctagctcgggtgatcaagcacatacattgagtggaaatggggcaatgcaatttgatgcagaatatgcaaggtggctggaagagcagaatcgacaaattaatgagctgaaagctgctgtaaactctcatgcaagtgacactgaacttcgcatgatcgttgatggtatattggcacattatgatgagatttttaggctgaaaggtgttgcagctaaggctgatgttttccatttgttgtctggtatgtggaaaacacctgctgagaggtgttttttgtggcttggtggttttcggtcatctgaactcctcaagctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatgggtcaaatggccatggccatgggtaagctagggacacttgaagggttcattcaacaggctgacaatcttcgccaacaaactcttcaacaaatgcaccgtatactgacaactcgccaatcagctcgtgcaactccttgctatacatgactacttttcgcgtctgcgtgctctcagttcactctggcttgctcgccctagagattgatgggcgcggtaaatagtatggcaaattaattttcatggatccatcactagcaatacttggtcatcataactcttgacaagttttcttgtgttgttttgttgtactctttgtatcactgatgttagtgcttcattgagtcagtctagaaacgaaattggtgacaagaagtatgaatattactaataatattgtccattgtaattgttgaagggctttgttttttccatacaaatatagttgggccatatgatatattttaagggttgtttcagtcgccatagtttacccttggatctgagttcatacaaaattgttgagtttattctttt

SEQ ID NO: 1476 - DNA, 401 bp, Oryza sativa
  Predicted polypeptide sequence is orthologous to G1198
  misc_feature (352)..(352): n is a, c, g, or t
  misc_feature (367)..(367): n is a, c, g, or t
cggacgcgtgggcggacgcgtgggcggacgcgtgggcggacgcgtgggctagagaccagcagggtcaggcttcagcagatcgagcaagaactccaaagagcacggtcacagggcctgtttcttggggggtgcagagcagcaggcgacatgagttctgtaaaatcgtttgcaggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagcttcaaggcggcgctcgcgcgcctncgcgtcttccacctncttaccgggacgtgggctacccccgccgagcgct

SEQ ID NO: 1477 - DNA, 495 bp, Oryza sativa
  Predicted polypeptide sequence is orthologous to G1198
  misc_feature (453)..(454): n is a, c, g, or t
cggacgcgtgggggaaaactgttagatgccaagactgaaaggcgattggctcagaacagagaagctgcaagaaagagcaggctgaggaaaaaggcttatgtgcagcaacttgagactagccgcataaggcttcagcaaatcgagcaagagcttcagagagcacgctcacagggcttgtttcctggaggatgcagtgcacctggagatatgagctcgggtgctgtaatgtttgacatggattacacccgatggatagacgacgacagcaaatgcatggcagagctccagggcgcgctacaggcccagctccccgacggaaaccttggtgccattgtggaagaatgcatgcgccactacgacgagctcttccaccttagggccgtgctcgccagcttccgcgtgttccacctgatgactggcatgtgggcggcgccggcccgacggtgcttcctnncttttggggcgttcggccatcagaaattctcaaaatgctga

SEQ ID NO: 1478 - DNA, 654 bp, Oryza sativa
  Predicted polypeptide sequence is orthologous to G1198
  misc_feature (618)..(618): n is a, c, g, or t
ggaacaagggagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttctcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgctggtagaagctctcgaggctggcgagcttgtccagggcgatggccatgaggctcatgtagttgggcacgccggggccgtcgttgagcgtgccggcggcgacggtgtcggcgagcgactggtgcagctgctgcagcccctgcgcgagcgcctcctccgcctgctccgacgactgctgcaggctgtagatccccagcntctgctgctccgtcagcggggccagctgctgtatca

SEQ ID NO: 1479 - DNA, 1985 bp, Oryza sativa
  Predicted polypeptide sequence is orthologous to G1198
tcgagcggccgcccgggcaggtcgcctcgcctctctctcttccttctgaccaacccgacctcggcgcccccccccatttctctctctctctcttcgcgttgccgtctcgaccccgcctccaccgccgaagccgcccgaggcggcggccgccggcagctgggctcctccgaatccgaacacggcgggggctctcccctcgctccccacggcggttggcacctgctggctctcgatccaacgtgtacagctaatttgatctgttggcgccttagctagaaaggtggcgactctggcatctcagtgatcatagggcatttgaaggtggcctgcatccctgttacaagtaagggacaacaaagcaatttgttgtctctttatttggagctgggaagaacccggcatggcagatgctagttcgaggactgacacatcaacagtcctggataccgacgataagaatcagatggtagacgggcaaagtggagctattgtgccttctaattcatctgatcggtctgacagatctgacaagcccatggaccaaaaggtgttacgccggcttgctcaaaatcgtgaggctgcaagaaaaagtcggctgagaaaaaaggcatatgtacaacaattagagagcagtaagctgaaacttgcaagcttggagcaagagatcaataaagctcgcccacaaggaatttacatttcgagctcaggagaccaaactcatgctatgagtggaaatggagctatgacttttgatttagaatatgcccgttggttggaggaacaaaacaagcagataaatgagctgaggactgcagtaaatgctcatgcaagtgacagcgacctccgtctcattgtagatgggataatggcgcattacgatgagatattcaggctgaagggtgttgccgcaaaggctgatgtgtttcatatactttcaggcatgtggaaaacacctgctgaaaggtgcttcttgtggcttgggggttttcgttcctctgagcttctaaagcttcttgtgaatcagctcgagccattaactgagcagcagttgttgggactatcgaacctccaacagtcctctcagcaggctgaagatgctctatcacagggaatggaagcgttgcaacaatccttggcagatacgttggccgggtcccttggtccatcaggatcttcagggaacgtggcaaactacatgggtcaaatggctatggccatgggcaaacttgggacccttgagaatttcctccgtcaggctgacaatttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgtacaattgtattagcaataaaataaaaggtagataaaggctggaagaatacccagcgatcttacagtggtcggaaacgaaaagcaaaggggacatctcgcacgggatggtcgattgttctaactgaatagataagcacttaagcagggcctttcttttatgacaaccgaaatataggtgaaatggaaactatgggtagaacatgttctgctgattgtttggtcatcctatactcattatcttggtgtctatattatgtacatgcacacaagtgggcgctagtaccactgttttgagctttgtagatttatacctgtcctaatcagagtatactgtatttataaaacaactgccttttttttttca

SEQ ID NO: 1480 - DNA, 1092 bp, Oryza sativa
  Predicted polypeptide sequence is orthologous to G1198
  misc_feature (19)..(19): n is a, c, g, or t
cagcagtttgaaaagcagnaagttgaagtttgttcagatggaacaggattatccacagagttcgttcccagggcttactgcttggagctccaggtggaaacaccagctcaggtgccgcaatgttcgacgtcgactacgcccggtggctggaggaagacagccagcgcatggctgaactgcacggagggctgcacgcacatctgccggacagcgacctcagagccatcgtcgacgacacgctaacccactacgaccacctcttcaacctcaagggcatggcggccaaggccgacgtgttccacctcatcaccgggatgtgggcgaccccagctgagcggtgcttcctctggatgggcggattccggccctccgagctgctcaagacattgacaccccagctggatcccctgactgagcagcaagtggttggtatctgcaatcttcaacagtcatcgcaacaggcagaggaagctctctcccagggcttggatcagctgcatcagtcattagcagaaaccgtggctggagggtccccgttggatgaccccaacgtcgggagtttcatgggtcacatggctattgccctcggccagctatcaaatcggggaggttttggcatacgggctggtaatttgaggcagcagactatccatcagatgcacaggattctgacagtcaggcaggcagctcgatgtttcttggccattggagagtaccataatcgcctccgtgccctgagctcactttgggcttctcgccctcgagagtaaaccccatgcctgatactggtggcagatgaaggcaattgtggggagctaagcattgcagcacatccatctgagagccaatattcagccttctgaaatcctgtttcaaatgtattttgcaactaaccttcaaagtagggagcaaaagcttgttttttaaatgaaatctagcactctagcagatatgtgagaaactcagaagagagttgggaaacaatggaaggctccagctgcactagcaaaattttcagatggaatgaatgggattgcatgattttcagttactgatcataaagcaagtagttcacgtcctttcctggatgat

SEQ ID NO: 1481 - DNA, 1571 bp, Zea mays
  Predicted polypeptide sequence is orthologous to G1198
aattcggcacgaggcacacagccgccgtttcttttacttgcgctcggcacgcaggcgacggctgcggcgctcaggttggggttctcatcgacggcgtcagcggcttcccctcccgcctctcgccagtcgcttcgcgccctcgcctccggtcctccgcacactggccggtgaccctgcatagtattatctgattttcctggaggccacattttaaggactgaggttacaatggcagatgccagccctagaacagaaacatcaacagatgatactgacgacaataacgggcttgaaccaggcagaggtggtcttgttgcttctgactccagtgacagatccaaagacaaacatggagatcaaaagacattgcgtcgccttgctcaaaatcgtgaggctgcaaggaagagccgactaaggaagaaggcatatgttcaacagttggagaatagcaggctaaaacttacccaactagagcaagagctgcaaagagctcgtcagcagggcatttttatatctagttcagttgatcagtcacactccatgagtggaaatggggcattggcctttgatatggagtatgcgaggtggttggaagagcacaatcggcaaattagtgaactaagggctggtgtcagtgctcatgcaagtgatactgatcttcgaagtgttgttgataagatcatgtcacactatgatgagatttttaggctcaaaggcaatgcagccaaggcagatgtttttcacgtcttatctggcatgtggaagacaccggcggagaggtgttttttgtggctaggaggtttccgaccatctgaggttttaaagcttctttcgacacaacttgaacctctcaccgaacagcagctgtcagggataagcaaccttcagcaatcttcacagcaggctgaggatgctctttcacaaggaatggaggcccttcagcaatcattggccgaaaccttggctgggtctctttcgtcttctggatcaacaggaaatgtggcaaactacatgggtcaaatggccatggctatgggaaaacttggaacgcttgagaatttccttcgtcaggctgacaacctgcggctgcagactctacaacagatgcaaaggatcctgaccactagacagtcagctcgggcgctacttgtgataagtgattactcttcacgtctccgtgccctaagctctctctggcttgctcggcccaaggaatagcaagaacatgctatttgactgcaatacttttcacaatttggttttcaatggtcaggagatttgacaaggctgcgacagacttgattcggacatatctgcacatactatgacccaaatggaaggggatgttcatgtagcttaggctgcttagctttgtagttaagtgttgttgatgtatcattaccaactgctgtaaaattctcactctgtatgcccctgatttgcagcgaaccattagaatgcacattgatgttcacctgtcgacttttttgttcactcttaggaacactagcgtaaacataatgttctgcccagtatcatctaaccagggtatatggctgatcccccgcact

SEQ ID NO: 1482 - DNA, 1633 bp, Zea mays
  Predicted polypeptide sequence is orthologous to G1198
atggccagtgaattgaatttaggtgacactatagaagagctatgacctgctacttacctttttttacagcagtgcatgttcgtctcatggtgctgcattcagtttacaatgtgtctgaaggatttgaagaccccacccccagatagtggatgggcttttttttacatattgtatgtgtcaacaggtaatcagaaggctggctcagaatcgtgaggctgcacgcaaaagccggctgcggaagaaggcgtacattcagcagctcgagagctgtaagctgaagctttctcagatggaacaggacatgcagcgagcccgtacccagggcctctttcttggaggagatccgggtgcaagcaccagttcaggtgccgccatgtttgacgtggagtacgcccggtggctggacaaccacagccggcgcctggccgagctgaacggagccctacacgcgcacctggcagacggtgacctcagagccatcgtcgacgacgccctcacccaccacgacgagctgttccagctcaaggccatggcggccaaatccgacgtgttccacctcatcactggggtgtggacgacccccgccgagcgctgcttcctctggatgggtggattcaggccctccgatctgctcaagacactgctgccccagctagatccactgacagagcagcaagtggtcggcatatgcagccttcagcagtcatcacagcaggcagaggaagctctctcgcagggcttggagcagctgcatcagtcgcttgctgacaccatggccggtgggtctctgactgacgacgccaacatgagcttcatgagccaaatggctcttgccctcggcaaactggccaaccttgaaggctttgtgatacaggccgataacttgaggcaacagactcttcatcagatgcaccggattctgacagttcggcaggcagctcgatgtctcttggcaattggcgagtaccacaaccgccttcgtgccttaagttccctctgggcttctagacctcgagagatactggtgaccgatgaaggcaattgtgagataagcatcgcagcacaaccatcccaaaaccaattttcaaccttctgactgacacatgttgtggaactaaccctcagcataggagcaagagaaaaatgactgggaagagaatgactgggaagagagattgtttggatgcacgtagcagatatctgagagctacagaggaaagctgggaaatagaagaagctctaaaacaaggagtgtttctggaaattctttagttttcaaaaaacactttctgaaaatgtgtgtacaagaaaattccaggaaggtgaaattgcttcattgactgcagtgggaaggggaaagagagaagctagaatctcatgtcgagtactccagtacaatgtgttcttttgtctggtctaaattcttgtaacagctcttcctatgatggaagaatccattcaacaattccacctatgattactggattgagtatgttgaataggttggttgaggctatctagtaatttttatgactatgtttatccattatctaggactatttggttactatattatataatctttatcatatatacatccatttagttcaccaaaaaaaaaaaaaaaaaaaaa

SEQ ID NO: 1483 - DNA, 1531 bp, Zea mays
  Predicted polypeptide sequence is orthologous to G1198
ggctcgagggaggccctcatccacggtggtggcgccgccagcgccggcggcggcgtcgatccgggcgtgatcatcaagaacgacgtcgcgcaggcaaagtgggaattcgcagtcagtagggagcaccggcactgactcgagctcagctcagaacacaatgtctcagatggagttggtgtccccagcctcctctgcgccgcggcaggaggtcatgatggtgaccactgatgattacagctacaagccaggcctcgccgctgcgcccgctgctgccgccccgccgagctttcagcagcaccacccgctcccgctgcagctgcacggaggagagggagggggagaccatgacaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgagtaagattcagacttgatcaactgcaaaaactggagtttattgttgatcaactgcactgtagttgttcccaactcccaagcatgccttaatcacatgtattccttcgggtttttttttgaaagatagaaccacttgttttcagatttcattaggccttgttcgtttgtgccggattggtgggtcggaacgattcctagccggattgcttctctaatttatataaactttgattagctggaacaattccgggtgcaatccgatagaaacgaacaagaccttatatgaaaagtcagaaatggacatggctgacactggcaaaaaaaaaaaaaaaaaaaaagg

SEQ ID NO: 1484 - DNA, 1991 bp, Zea mays
  Predicted polypeptide sequence is orthologous to G1198
caattttgctcttttatatagtccatcgccaccgcccacagcgacttcctgctggtctcttgttggtcgtagaactagcagtggccatggtgcaaggcgaggagagttcttggaggatggagagggcagcgctgcctctcaaccagctggcgctcgcgtacggagtccaagcccacgccgccgccgccgccgccgcggctgcaccgccgacctgcttcctggacttccagcctgcggccgcatccgctgcctacttcgggttcggtgagctggaggaggccctcatccacggtggtggcgccgccagcgccggcggcggcgtcgatccgggcgtgatcatcaagaacgacgtcgcgcaggcaaagtcagcggcaggatatctcgcgggcgctggcaccggcaggccccccacgctggagatcttcccttcgtggccaatgaggcaccaacagcagctgcacagtgggaattcgcagtcagtagggagcaccggcactgactcgagctcagctcagaacacaatgtctcagatggagttggtgtccccagcctcctctgcgccgcggcaggagatcatgatggtgaccactgatgattacagctacaagccaggcctcgccgctgcgcccgctgctgccgccccgccgagctttcagcagcaccacccgctcccgctgcagctgcacggaggagagggagggggagaccatgacaagaggaagcatggatccacaagaaaagatggcaagttggtagatgccaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcgccggattttgaggcctcacctggtgagggagggtgtaaaactttggccgcgagggtggtgttacaaagattagaggttttgagagggagatgcattgtaatgttctatcattaaagtactgagaaagcaacatcactaggcgaaaagggcggggagaaggaattgctgtagtgcgatgttgggtggctcacctgttcatatggctcttgaactgattgaagggttagcaccgcagaattttttgcgggtagcagcagaaaacaaagcagtggcagaagattctggctgctcacttgccagagagcact

SEQ ID NO: 1485 - DNA, 965 bp, Zea mays
  Predicted polypeptide sequence is orthologous to G1198
gcagatcgcttgcgcagaaccgagaagctgcgcgcaaaagccggctgcgaaagaaggcttacatccagcagcttgagagcagcaagctgaagcttgcccaaatggaacgggacatgcagagagcacactcccagccccagggcgtctttcttggaggagctccaggtgcaaacgccagctcaggcgcggcaatgatcgacgcggagtacgcccgttggctggatgaccacggccagcgcaaggccgagctacaaggagctctgcaagcgcacttgcccgacggtgatctccaagcgatcgtggatgacaccctgacccaccacgacgagctgttcaggctgaaggcttcagcagccaagtccgacgtgttccacgtcatcaccggggcgtggacgacccctgccgagcggtgcttcctctggatgggtggattcaggccatcggatctggtcaagacgctgctgccccagctagaccccctgaccgagcagcaactggtaggcatatgcaaccttaagcagtcgtcacagcaggcagaggaagctctctcccagggcctggaccagctgcatcagtcactagctgacaccatggccaacggatcgctgatcgacgacaccagcatgagcttcatgggtcaaatggcccttgcccttggcaagctgtccagccttgaagtttttgtgatacaggctgataacttgaggcagcagactcttcatcagatgcgccggattctgacagttcggcaggcagctcgctgtttccttgccatcgccgggtaccagaaccgcctgcgcgccctaagctccctctgggtttctcggcctcgagagatactggttgcagatgaaggcgactgtggggagatgagcgctgcagcatatgcaggcatcccaaagccaatttccgtccttctgattcaggcatgactcggagctctaaccaaccttctgactcaggag

SEQ ID NO: 1486 - DNA, 1359 bp, Zea mays
  Predicted polypeptide sequence is orthologous to G1198
ggctcgaggcttggcccagggagttgcaacctgcagcagctgctccttattactttggtgagttggaggaggcccttatccatggcacccgtacatctgttgatcacggcatgatcggaagtgatgtggacacagagcgtaagacagctggataccttgcagctaggccccccacactggagatcttcccttcatggccaatgagtcatctacagcagccatacagtggtaactcgcactcagtagggagcaccactgagttcgagctcaggtcagaacagtatgccacagaccgagctggtgtccccagggagcatgagggccgactctggacagcgtcaggagcttttgatggtgactgttgatgattacaactacgagcaaggactcggagccgcagcaaccacagctccaatctttcagcagcatgcagcaggccaagacaagggaaagcatggatccacaaggaaagacggcaggctgttagacgccaagaccgagaggcgattggcccagaacagagaagctgcgaggaagagcaggctgagaaaaaaggcctacgtacagcagctagagacgagtcggatcaggcttcagcaaatcgagcaggagctgcatggagcacgctcacagggtctgttcccgggaggaggtggtgcggctggagacttgagttcaggcgctgtgattttcgacatggagtacgcccggtggctagaagacgacgcctcgcgcatgacggagctccaggccgtgctgcagccccagatcatcgacgcgaacctgggggccatcgtcgaggactgcatgcggcactacgacgagctgttccacctgagggccatgctcgcaagatccgacgtgttccacctgatgaccggcctgtgggcgaccacggccgagcgatgcttcctctggatgggagggttccgtccttctgaaatcctcaagatgctgataccgcagctcgaccctctcgcggagccgcagctgctagggatgtacaatctgcaacggtcgtcggagcagaccgaggaggcgctcgtgcaggggcttcagcagctgcaccagtcgctggcggacgccgtgggcgctagtcctctcagcgacggcgcgaatgtcgccaactacaccgctctcatggccctggcacttgacaggctcgacaccctcgagagcttttaccgccaggcggacagcctgaggcagcagaccttgcaccagatgcggcggatcctgacgacccgccagacggctcggtgcttcgtctccatcagcgagtaccaccgccgcctccgcgccctcagctccgtctgggcatcgtcccgccctccaactcctccaagcgagggcgtcgtt

SEQ ID NO: 1487 - DNA, 1786 bp, Zea mays
  Predicted polypeptide sequence is orthologous to G1198
ggctttgcttttaccccccaaccttttcgacaggaccctgcttgctctacagggttctcccggaggcagaaactctttgcttccgcctggctcgcgatgcttgtttgggtgcgcgggcctgcggcgaggtgaggcgacggcggcgccgggcggttgcatggtggccgatggagagtagacggggagggtcgtcggcggcggcggcggaagatgcgggcggggcgatgccgagctttgggccaacgcagcacgccattcgcgcaggcgcagatgtgaacagcatgcaaccttctcgagttactgactttggggcactggcacagtctgctggattccgaatagaagatcttgctaaccttaatgcaaatgctttgttcaatctgaagccaaattctcatacgattgacaacagtcctctccagtttggaaattacggaaagtctatttcttctcatataaatactacagaagcaacaacagctgcaacaagaattgaccctcagctgtcagcacagcaaacaggagcacaaccaattctggtggcgttaccaactggtaacatggagaattggggagagtcagctatggctgatagccctatgactgacacatctacagatccagacactgatgagaggaaccagatgtttgaacaaggacttgttgctgtccccacagcatctgattctagtgacaaatcaagggacaaactagatcagaagacacttcggcgtcttgcccaaaatcgtgaagctgccaggtaaagccgtttacgaaaaaaggcatacatccaaaaccttgagagtagcagactgaaacttactcagttagagcaagagcttcagcgggctcgtcaacagggtatttttatttcgacatcaggcttttatgttcatgttgtctgatctgtaggagctttggcatttgacatggagtatgcacgctggttggaagagcacaacaaacatgtaaatgagttgaggcttgcagtcaatgcacatgccggtgataatgatctccgtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattacaacagtcgcttgcagaaactctagcatctggatccctgggccctgctggaccttctggcaatgttgcaaattacatgggacaaatggcgatggctatgggaaaacttggcacccttgagaactttctacgacaggctgataatctacggctgcaaacacttcaacaaatgcaacgcatcttaaccacccgacaatccgcacgagccctacttgcaataagcgactacttctctcggctgcgtgctttgagttctctttggcttgcccgtccaagggaataaattcaattaactcataactaggataatttttttgtactgtttctagtatggccattagtttcttcagaacgctcatgtgtcagtgagatatttggatcatattgtaggccatcatggtttactggacaactttgtaacaattttggagagaaaaaactgagttgtaaatacatctggaataatctaagatcttatgaaggggaaaa

SEQ ID NO: 1488 - DNA, 2252 bp, Zea mays
  Predicted polypeptide sequence is orthologous to G1198
cattgggaccctcgaggccggccggaccccggggccggccgcgccgggacgtgctgcagagcctgcagaggcttttcttccccccaccccacccatcgcgtgtgagtccacggtgtgatgtcacggagcggtggcggctttcccgattcactgtgcgggagaaatccccgtgcagccttcttccacctcctcctactctccgctattcgtcttcgctgatttctgccgctccaattccatcgcttccctgctttagaaccttctctgctagcttctccccgtcacagcttttggtgcctcgtcatcggcgaccaaaccgccggcgaccggataaactaagccagctccttcgctccgaaagtcgtctctcgtagagagcacttgctcacctgctccccgccccccctctactggcgctggacttgctcggagtggagatccatccggacctggttcgatttcttcatttcgggttcgattcggtttttctatcccagagcgaaagatcaatatcacctgacacaacataacgatttcgtggaagccgaggttgcttctctgctcagtgggtggataactggattgtggattttgctaactacatgctgggttatcagcctatcataaggaaagcaaagaagagacaacaaagcaatttgttgtctctttcttaggagctggcgagtactcggcatggcagatgctagttcgaggactgacacctcgactgttttagacatggatgataagaatcaaaggttagaaaatggacagagtggagctatggccctggcttcgaattcatctgatcggtctgacagatctgacaaacctatggaccaaaaggttttacgacggcttgcccaaaatcgtgaggcagcaaggaaaagtcggctgaggaaaaaggcatatgtgcaacaactagagagcagcaagctaaaacttgcaagcctggagcaagaactccagaaagctcgacaacagggaatcttcatatccagttctggagatcaaactcatgctatgagtggaaatggagctatgaccttcgatttagaatattctcgatggcaagaggaacaaaataagcagataaatgagctgaggactgcagtaaatgctcatgcaagtgatagtgacctccgtcttatcgtcgatgggataatggcacattatgacgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctatccaatctgcagcaatcttctcagcaggctgaggatgcattgtcacaaggcatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaaggactatccagcgtctatattggttggaaacgagcagcagaagcttgtcatgtcgattgttttccttgaatagtcggttgaagtgttcttttgggggtctatagagaacaaagaaagcttcaggagaaatgtataggtattcaccagtctaccatagagtgtgtgcttcggggagctccttgtgatggtaaaatttgataacgaggatgagttctgtgacattaaaaaaaaaaaaaaaaaaaaaaaaaaaaaaaaaaaaaaaaaaaaaaaaaaaaaaaaagggcggccgc

SEQ ID NO: 1489 - DNA, 1821 bp, Zea mays
  Predicted polypeptide sequence is orthologous to G1198
ctcgaggccggccggggtccgtctcataccatcccatcccatcccatcccatccccgtgcgccgagttcacggccgccaccaccaccaccacaaccgattgcacaaggccacgcggcttctggaagcttcccttcccttgccttgccttgcctctcaacccaaatcgccacggctccctccgcccgcagcgccctcggcacgaccgccggattcgcctctgggtggggttggttttgtctcccccaccaccctacccacccctctcctctcctccaaggcttggcttgcctcgtgtcgtgtgtccctccaccgcccgccatgccgacgaggcttgccccccaccgccgatcgcacacggtcatatgattgcaatgaatcctgacatggtactactgtcttggaaacaaatggagaatggaagtggtgcggttgtaccttctaattcttcagataggtccgacaggtctgataaacctttggaccaaaagacaatgcgacggcttgcccaaaatcgtgaggcagcaagaaaaagtcggctgaggaaaaaggcatatgtgcagcagctggagagcagtaagctgaaacttgcacaactggaacaggaactccagaaagctcgccagcagggaatcttcatttctagctctggagaccaaacccatgccatgagtggaaatggagctttgacttttgacatagaatatgctagatggctagaggaccaaaataagcagataaatgagttgaggactgcagtgaatgctcatgcaagtgacagtgatctacgacttattgtagatggcataatggcacactatgatgaaatattcaaggtcaaaggtgttgctgcaaaggctgatgtgtttcatatactttcaggcatgtggaagacacctgctgaaaggtgcttcctatggcttgggggttttcgtccatctgagcttttaaagctcctagcgaatcacctcgagcctctaactgagcagcaaatgctgggtttgaccaacctccagcaatcttcccaacaagcagaggatgcgttgtcacagggcatggaagcactgcagcaatctttggcagagactttggctggatctctcggtccagcaggttcttcaggaaatgtggcaaactacatgggtcagatggccatggccatgggcaaactcgggacgctagagaattttcttcgccaagccgacaacctgcgacagcagacgttgcatcaaatgcaacgtatcctaacgatccgacaggcttctcgtgctcttcttgcaatccacgactatttttcacgattgcgcgctttaagttctctgtggcttgctaggccacgtgaataacgaagggccgtcagtattttgagttccctctgccttacggtgctgctgcgtcgttcgcagcgatgcatcacagatctttggtggtactgtttttgttgtacaattacttttggccgctgcttggtccaaattgtactcaggtgggtgtacaagtaggtcaatataatcctgtaagttatggtgatttatgggtgtgttagcaatgcaataataattagagagggcaggatcagggtttctgttgtttgtactggttagagatttagtcctaatgtaacttcctgggacatggggggcggaatgggaagagagtaacaagaatcttcctttggttactgtagtatatgttggtattgttgcatcccatttgctcattttgctgttaggagaatgattattctgtccctttggggactttttgagcggccttgtttgtaacccccacatgattatggatatgactgctagttccttccc

SEQ ID NO: 1490 - DNA, 2154 bp, Zea mays
  Predicted polypeptide sequence is orthologous to G1198
cattctttttttcgtgtgttttttttgtgtgatgtcactgatcgttgtttttttttttgttttttgtgttttagaaatccccgtgcagccttcttccagctttttctactctttgctactcgtcttcgctgatttctgccttaattccatcccttccctgcctagaacttgctttgcttcaccccatcacagcttttggtgcctcgtcatcggcgacctaaccgccggcgaccagataaactaagccaggcccttcgctccgaaagtcgtctctcgtagagagcacttgctcacctgctcctcgccctcctctgctggcagtggacttgcgcggagtggagatccatccggacctggttcgatttcttcatctcggttgcttctctgtccagtgggtggatcactggattgtgggttgtgctaactgcaggctggcttgtcagcctatcataaggaaagtgaaaaagagacaacaaagcaatttgttgtctcattcttaggagctggcgagcactcggcatggcagatgctagttcgaggactgacacctcgactgttgtagacatggatgataagaatcaaaggattattttacgaaatttcaacttctctctgtgggacatctaatggtacaggtcttggagagatgcatgtaaagtgttagaaaacggacagagtggagccatggtcccggcttctaattcatctgaccggtctgacagatctgacaaacctatggaccagaaggttttacgacggcttgcccaaaatcgtgaggcagcaagaaaaagccggctgaggaaaaaggcatatgtgcaacagctagagagcagtaagctaaaacttgcaagcctggagcaagaactccagaaagctcgacagcagggaatcttcatttctagttctggagatcaaactcatactatgagtggaaatggagctatgaccttcgatttagaatattctcgatggcaagaggaacaaaataagcagataaatgagctgaggactgcagtaaatgctcatgcaagtgatagtgacctccgtcttatagtcgatgggataatggcacattatgacgagatattcaggctgaagggcattgctgcaaaggctgatgtgttccatatactttcaggcatgtggaaaacatctgctgaaaggtgcttcttgtggcttgggggtttccgttcgtctgagcttctaaagctccttgtgaatcagcttgagcctctaactgagcagcaattgatggggctgtccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaagcctggaaggatatccagaatctatattggttggaaacgagcagcagaagattgttatagattgttatgttgctttgaatattcggttgtaagtgccttttttggggtatatagaacaaagaaagattcaggagagatgtagggattcaccagaggctatcggggattgtgcttctaggagctccctggactatctctagcaagtctcatattaagctctactctgtaaacagtgatacattgaattgaacgtgctacggttatgatggtaacatgtaaaaaaaaaaaaaa

SEQ ID NO: 1491 - DNA, 978 bp, nicotiana tabacum
  Predicted polypeptide sequence is orthologous to G1198
atggctgatatcagtcctagtacatcaacagatgccgatacggaagataagaacaggttcctaaattctcaacaactgggtgcggtagcttctgatggaagtgacaggacaagagatcagaagacacttcgtagacttgcccaaaatcgtgaagcagctcgaaaaagtcgtctaaggaaaaaggcatatgttcaacagttagagagcagccggatgaagctgacacaactagagcaggaacttcaacgagctcgacaacagggcatatttatttcaggttcaggagatcaatcacagtcgatgagcggaaatggagctttggcatttgatgtagaatatgcccggtggttggaggagcagaaccgacgaattaatgagctaaggggagctgtaaattctcatgctggtgatggtgaacttcgcataattgtcgacggtatcttagcacactatgatgacatattcaggataaaaggggatgctgcaaagtccgacgtttttcacatattgtcgggcatgtggaaaactccagcagagagatgcttcttgtggcttggtggattccgttcgtctgaactcctcaagctcctcattaaccagttggagcctttaaccgaacaacaattattggcaatcaacaacttgcaacagtcatcccaacaggctgaagatgctttatcccaaggaatggaggcactgcagcagtctttggctgagactctggcggggtcccttggaccttcaagttcctcagggaatgttgccaattatatgggtcaaatggccatggcaatggggaagctcggaactctcgagggcttcatacgacaggctgataaccttcggcaacaaacattgcagcaaatgcatcgtatattgacaactcgccaatcagctcgtgctcttcttgcgatcagtgattatttctctcggcttcgagcactgagctctctctggcttgctcgcccccgggaataa

SEQ ID NO: 1492 - protein, 423 aa, Oryza sativa
  Orthologous to G1198
MPFAAEFDMLAFNNPIELLSNAYVLCMGPTHRSIKLGTTRKQYKQLGFPIKKAGKVCLWHVFLEPGQLALAAASDSDRSKDKHEDQKTLRRLAQNREAARKSRLRKKIHGKWKSFAKILWGITCKNRLGMGIGCWSGHGRELQGYIGMQDLQSRTVPSNSGQLQAYVQQLENSRLKLTQLEQELQRARQQGIFISSSVDQTHSMSGNGALAFDMEYARWLEEHNRQINELRSAVNAHAGDNELRGVVDKIMSHYEEIFKQKGNAAKADVFHVLSGMWKTPAERCFLWLGGFRPSELLKLEPLTEQQLSGIANLQQSSQQAEDALSQGMEALQQSLAETLAGSLGSSGSTGNVANYMGQMAMAMGKLGTLENFLRQADNLRQQTLQQMQRILTTRQSARALLVISDYSSRLRALSSLWLARPKE

SEQ ID NO: 1493 - protein, 357 aa, Oryza sativa
  Orthologous to G1198
MGAYDRPPPVGMWSHEQFKVDNGQATSASTIMEAEMKFENRLEEIPQVVLEEGRNVDQEASKPPDKVLRRLAQNREAARKSRLRKKAYIQQLETSRLKLAQLEQELQRARQQAVYANGSLREPNLGFTGPIDPGALGFEIKYSHWVDEQNRNTGELRNALLQGQTTDQDLELKLLVEAGLDNYNRLFEMKEEAANSDVFYIMSGMWKTPTERFFLWIGGFRPSEVLKNLRPQLEPLTDKQVVEVGGLQQTSMQVEDALSQGMDKLKQTIADSLTAADPFDSPEAYMVHMANAVEQLRSLVQFVTQADHLRQQTLQEMHRILTTRQAARGLLALGDYFQRFRALSSLWAARPRDSGIS

SEQ ID NO: 1494 - protein, 292 aa, Oryza sativa
  Orthologous to G1198
MADASSRTDTSIVVDNDDKNHQLENGHSGAVMASNSSDRSDRSDKLMDQKTIRRLAQNREAARKSRLRKKAYVQQLESSKLKLAQLEQELQKARQQGIFISSSGDQTHAMSGNGALTFDLEYTRWLEEQNKQINELRTAVNAHASDSDLRLIVDGIMAHYDEVFKVKGVAAKADVFHILSGMWKTPAERCFLWLGGFRPSELLKLLANHLEPLTEQQLLGLNNLQESSQQAEDALSQGMEALQQSLADTLAGSLGSSGSSGNVANYMGQMAMAMGKLGTLENFLCQASIFTF

SEQ ID NO: 1495 - protein, 366 aa, Oryza sativa
  Orthologous to G1198
MAPSSLLIIFFLLPTSRSSALQQHGVAVVGMAAHQGMAAATAADRFCLPRMAAAAAAASQVENWGDSGVIVSSPFTDDTSTDLDDSADKHHLHALVGGGDGGDDAGEQRGADSSAVSKERRGDQKMQRRLAQNREAARKSRMRKKAYIQQLESSRSKLMHLEQELQRARQQMSDDELCELVDAVMMHYDQVFRLKSFATKSDVFHVLSGMWMSPAERFFMWLGGFRSSELLKVLASHLEPLTDQQLMGICNLQQSSQQAEDALSQGMEALQQTLGDTLVSAAATVVSGGGGADNVTNYMGQMAIAMAKLTTLENFLRQADLLRHQTLQQMHRILTTRQAARALLVISDYFSRLRALSSLWLARPRD

SEQ ID NO: 1496 - protein, 519 aa, Oryza sativa
  Orthologous to G1198
MEGGRLGGAAASASAAAAADARGGMSGFAAPQHAIVKHGPGSVTHCGGKWTFAELCQSEQIWVLDCYCMQWACKFATNATECHTNLNNVQPTQVTDFGALAQSAGFRIEDLANLSTNGLFNLKSNAHTIINDPLQFENYVKSISPSNITTTATVTVVDPQTLVPQKGAQLNLVTIRTGNVENWGESTIADTSPRTDTSTDPDTDERNQMFEQGQLAAPTASDSSDRSKDKLDHKTLRRLAQNREAARKSRLRKKAYIQNLESSRLKLTQIEQELQRARQQGIFISTSSDQSHSASGNGALAFDMEYARWLEEHNKHINELRAAVNAHAGDNDLKSTVDSIMAHYNEIFKLKGVAAKADVFHVLSGMWKTPAERCFMWLGGFRSSELLKLLAGQLEPLTEQQLAGIANLQQSSQQAEDALSQGMEALQQSLAETLASGSLGPAGSSGNVANYMGQMAMAMGKLGTLENFLRQADNLRLQTLQQMQRILTTRQSARALLAISDYFSRLRALSSLWLARPRE

SEQ ID NO: 1497 - protein, 399 aa, Oryza sativa
  Orthologous to G1198
MGIYDRRHHPLAAGVWGDHPFIRPDTTASTSNAAAAAMVVAPPPLTEPKFESQLALPLQHGDDQDNAAALQESPRHASDSFEQEASKPRDKIQRRLAQNREAARKSRLRKKAYIQNLETSRMKLAHLEQEITRARQQSAYINRSSNPATLPAPIDSGVVTFEVEYAQWVEEQGRQTAELRASLQAAAEGPELRAVVEAALAHYDRLFAAKREAARRDVFFVMSGVWRTGAERFFLWIAGFRPSEVIRVLAPQLEPMTERQAADVQGLQQKARHLEDALSQGMDKLKQTLADSLLAEAVVVSTSCDASPPPPPPEEEEPSSSAAGDGGCYMAQMGSAMGRLSNLVAFVDHADHLRQETLQNMYKILTLPQAARGLLALGDYCQRLRALSSLWAARPREPA

SEQ ID NO: 1498 - protein, 480 aa, Oryza sativa
  Orthologous to G1198
MASMAPPCPTPWLLQTSYHSGQQIYSQQVVDLMLHVLISLLNLHWPDTDSEQGGGGGGGAAYFGELEEALVHQVATLRRRAQQTATTTTSHHGHTTPFSTAAAAATATATARPPATLDIFPSWPMRRSSLPTPKDGCSNVTADTTDSESSSKNNGDQGAAAADMASQFDQIPQQQQKQHKKMAASSTHSDHRMTKTLDPKIMRRLAQNREAARKSRLRKKAYIQQLESSKLRLAQMEQDLERARSQGLLLGGSPGGNTSAGAAMFDAEYGRWLEDGGRRMAELHGGLHAHLPDGDLRAIVDDALAHYDELFRLRAAAAKADVFHLITGTWATPAERCFLWMGGFQPSDLLKTVAPQLDPLTEQQVVGICSLQQSSQQAEEALSQGLEQLHQSLAETVANGGSVVNEASLGSFMGYMALALGKLSNLEGFVIQADNLRQQTLHQMHRILTIRQAARCFLAIGEYHNRLRALSSLWASRPRE

SEQ ID NO: 1499 - DNA, 463 bp, Zea mays
  Predicted polypeptide sequence is orthologous to G1225
tttctcgccgtctgatagtgcagcaggagacaggccgacaaccaccgctgccagaatcactacctagagagagacacgcggggagctgctagtaggcaggaccaactcaagatgccccagacaatgacctgccgcagatggcactctggaaggaggaaccgtcaggacgatgttttttagaggagagggaggaggaagcggagagccagcagatgacccacattgctgtggaccgcaaccgacgcaagcacattaacgagcacctcagcgcgctacgatcactcatgccgtcagaccacacgcatcggggcgatcaggcattcatcgagatgcggctcgatcaactgcggcaaggagctggatcagctgctgcagacgctggaagcccggaggccacacccgcagggcagtgcctacgcacgaaatcccgacgacacggccgccgaagcggactaactcacct

SEQ ID NO: 1500 - protein, 362 aa, Oryza sativa
  Orthologous to G1225
MALDTLCSAGGDVLIYDTFNASAAAAAAVVPPASFLFGNNNAGGAAGTETRVQVAAGAVPEVDQLLKQAQQPGRRKRRRRARSCKSREDAESQRMTHIAVERNRRRQMNEYLAVLRSLMPESYVHRGDQASIVGGAIDFVKELEQLLQSLEAQKRTLLMQPPPPPQQQREPKCDAADSTSAADQETPAAAAAAAAADGPPFARFFTYPQYVWCHNPAQDGGGGGGAAAENRAGVADIEVSLVETHASIRVMAARRPGQLLKMVAGLQALRLTVLHLNVTALGSLALYSISVKRFHGGKAIASLGPLGVFFLCALYLWYSTTVVEEGCGMATVDDIAAAVHHVLCIIDAEAASQMLLAGEASG

SEQ ID NO: 1501 - protein, 218 aa, Oryza sativa
  Orthologous to G1226
AAAPPVTAPATRAERRRKRPRPRPRAAPPPEKRKKPEEAENQRMTHIAVERNRRRLMNDHLASLRSLIPSNYIPRGDQATVVGGAIDYVKQLEQQLVALQAAAAERSGVGVVAAAATAASDGVFVSPQYTSYSEARGGSGVDVEATAAVGGHVRVRVAGRRWTGRLVRAVAAMEDLRLTVLHLAVTSVGHDAVVYCFNLKVKTTTTLHHLLLHVPSFF

SEQ ID NO: 1502 - DNA, 431 bp, Glycine max
  Predicted polypeptide sequence is orthologous to G1229
atcgttcatgtcaacattaactgtgctgcggatgataccatgctaaactcattcactatcaagattggaattgaatgccaactcagtgccgaagaactcgctcaacaaatccagcaaacattctgctaattataaaagatgggttatgtttttccagagtccagaccaaacatcagcttgcatgcatccctctctctctctctctcttctcttattgtgttgtacgtaccttgctgtacaaataacatagaacatgggaagagccatatttaatttttcaaccatttatcatttttctttctttttaattattacagcaattgctagtgtaattcctcatgatgacaagtattagctagtttattagtatagagtgacaccactctcttgtaattgaccaccgtacgtcaagctgtgatttgtgtatgaat

SEQ ID NO: 1503 - protein, 401 aa, Oryza sativa
  Orthologous to G1229
MGDALCDQLLLVDSDGGEFIPHHADADADDLFTILETWEGCANVVAGGAPATTTTLGSPIAAAACISGVVGGQNHQQLPEPAAAKTVPATNNKRREEEVADRDGDGDDDDGSPQKRRKCCSPESSTTDVAAATTPKTAHIAVERNRRKQMNENLAVLRSLMPCFYVKRGDQASIIGGVVDYIKELQQVLHSLEAKKQRKVYTDQVLSPRPPATVAASCCSPRPPQLSPRLPPQLLKSTPPLSPRLAVPISPRTPPTPGSPYRLLRLPPPPPPASGSNYASPAMTPTHHETAAPSLDAIAAELSAYASRQALGGGLLLPDVKVEFAGANLVLKTVSQRSPGQAVKIIAALEGRSLEILHAKISTVDDTAVNSFTVKYIFGQIGIECELSAEELVQVIQQTFT

SEQ ID NO: 1504 - protein, 415 aa, Oryza sativa
  Orthologous to G1229
MADGGGGGLCELFSDDHRDIRHVADADLFRILETWEECINGGAGGGGGGVSLAGVADQGAAAASTGAGGGARTTTTTTAANGRRREGRDEEKGGGGGGGPPAQKKQKGSSSSSSSPPALAAAVGDGDGAAKMSHITVERNRRKQMNEHLAVLRSLMPCFYVKRGDQASIIGGVVDYIKELQQVLRSLEAKKNRKAYADQVLSPRPSPAAAALMVKPTPPISPRFAAAAAAGVPISPRTPTPGSPYNKHAAAAATARPPHPAAATSSCSVAYSMSPAMTPTSSSSTTTTTTHELSPAPAFLPILDSLVTELAARGGASCRPLVIPSSAAAIAGIVGVPDVRVEFAGPNLVLKTVSHRAPGQALKIIAALESLSLEILHVSICTVDDATVLSFTIKIGIECELSAEELVQEIQQTFL

SEQ ID NO: 1505 - DNA, 1834 bp, Glycine max
  Predicted polypeptide sequence is orthologous to G1255
attcggctcgaggcataaccaataattgaatttgaatcatttgggtctctagacacaaacactaccccctctttccccctcctcaacattgttatgatcccttgttggtaaccattccatttgcacttgtctttgcaaccaaaaaacaagctctatgaccaacgaaatgaaagaagcaagtgccttaggagctagaacagcacgagcatgcgagagctgcctaaaagtaagagcacggtggtattgtgcagctgatgatgcattcctttgccatggctgtgacaacatggttcactcagcaaaccaattagcaagtagacacgaaagggttaagcttcaaactgcatcctctaaggtcaactactcagtgacccctaaggtagcatggcacagtggattcacacgcaaggcaagaacgccacgccacaacaacaacagacactcatcattgaaacaacaacaacaaaaaaaaccattacatgaagaacgaggagaggaagaagtgtttttcaataacactattagtcttcttccccttgtgcctgagcttggaagtgaagagccattgcttaatgatgagactgaggagcaactactgtgtcgcgtgccggtgtttgatgctgagctttgtagcatatacaatgaagtgaaggacgaggttgtagctgctggtgaagaagccttggacttggaaaacttttcttccgagtttcttccatcagatacggaccttgctgagtttactgctgatgtgaaaagctttcttggaaacggggctgatgaggattcacctgatgatgatgagcacgtgaaagaatcagaactactgattcttgattgcaaagaagaagaaggagatgaggaaatggatgaatgttttgatggagtactaattggagccaaagatgctatggtgggtgaaggtcaaagatgaagaagaacttgatgctgatgatgacacagcttgccatttggattcgattcttgatatgaacggcgaggcatttaattggaatattgttgaatcagaatcacctgcacaggcacaagaagatgaagtgagtaaagtgggaactaagaaggacatatttttgagattaaactatgaagaagtcattactgcttgggcaagtcaaggttctccatggactaatgggaccccacctaagttcttcaactctgatgattgctggctagacttcttgggttcgaatggtgggaatgttcaatgctgttatggggcagtgggaagcttaagggtgcatgcagatgggggaagggaagcaagagtgtcaaggtaccgagagaagagaagaacgcgtttatttgcaaagaagataaggtatgaagtgaggaagttgaacgcggagaaaagacctagaatgaaaggtcgatttgtgaagaggacaccctttgttggagccactgcgttgccagcttaatcatcaatcaccactgacatgattgatcatcaaagtgatcaaattaatggttaacttctccaagttaatttgattttatggaaaagttaatttttagattaattattagttacttggttttgccatatatgtacaatatcatcactaggtcaggtttctcttgcttgggatatttatttctttctctaacaggtctagctagtactaatggaaatgtggtagcccctctcagcattttgaaggctttggtaatcaatttcgggagccctttttcaatgttgcttaattatgatatatataagaatctgtaattaatctatgctgatgttatgtttacctttaactctgagggtactgattaacagtgtttaacatcaggtacttatatgtcc

SEQ ID NO: 1506 - DNA, 1494 bp, Glycine max
  Predicted polypeptide sequence is orthologous to G1255
tacggctgcgagaagacgacagaagggggttaaggtcaaagatgaagaagaacttgatgctgatgatgacacagcttgccatttggattcgattcttgacatgaatagcgaggcctttaattggaatattgctgagtcagagtcacctgcacaggcacaagaagatgaagtgagtaaagtgagaaccaataagaaggacatatttttgaggctaaactatgaagaagtcattactgcttgggcaagtcaaggttctccatggactacaggaaccccacctaagttcttcaactccgatgattgctggctagacttggtaacttctcttcaaccctctttgcttatgcagcagtatcttcttgtgtgtttggtttgacttatttttatgagaataaatttttcagttttcttatagtatcatagccgatctcatatatatctggctaaaggaggaaggttgtgttgcgtcttcagtaaccgatgtaaaattcgtcgatatacctgaaatcattcgtagggcggagatgtgttatgccttcggtaaccaatgcaaagttcgtcgatatacctaacatgaatcgctcacagtgagataaaattttgttgttgtggatacatgagagctctcaaaagaaaactattatatattttttattttttttaaaaaagaaaaagtctctcaacaagcatgcagctactcaattatgcacaattgtattgtataggtggccgtagctccttatgagttgtttaattacatagctgtgtttttagtttttgaagttgcaaaccaaaatactgagtttttaaaaaaaatttagaaatgaccatttaaattgttttgaagctcaaacttgatcatcactgtttctatagttgaaatgaaactttctaatttttattttattttgttaagggttcgaatggtgggggtgttcaatgctattatggggaagtgagaagcttaagagtgcatgcagatgggggaagagaagcaagagtgtcaaggtaccgagagaagagaagaacgcgtttatttgcaaagaagataaggtatgaagtgaggaagttaaacgcggagaaaagacctagaatgaaaggtcgatttgtgaagagtgttcctttgttggagccactgctttgccagcttaattatcaatcatcaccactgacatgattgatcatcaaagtgatcaaattaatggttaacttctccaagttaatttgattttatggaaaagttaatttttagattaattattagttacttggttttgccatatatgtacaatatcatcactaggtcaggtttctcttgcttgggatatttatttctttctctaacaggtctagctagtactaatggaaatgtggtagcccctctcagcattttgaaggctttggtaatcaatttcagaagccctttttcaatgttgcttgattgtcatcatatgaataaaaatctgtaactaatccaaaaaaaaaaaaaaaaaa

SEQ ID NO: 1507 - DNA, 1540 bp, Glycine max
  Predicted polypeptide sequence is orthologous to G1255
attcggctcgagaaacgaaaagccattgttacaagcatttcacacttaacatatcaaaaaaacaaaggtttctactttctacgatgagagacatgaaagacgcaggtgccttgggaggcaagacagcaagagcctgcgacagctgcgtaagcagaagagcaaggtggttctgtgcagctgatgatgctttcctctgccatggctgcgacactttggttcattccgcgaaccagttagcaagcaggcacgaaagggttcggcttcaaactgcttcctcaaaagtaaccaccacgcacgcatggcacagtggattcacacgcaaggcaagaaccccgcgtcacaacagcaagcactttgcgctgcaacagcgtctcaaagacgaagttctcttcaacaacaccagtgttcttcccctcgtgccggagctcggaggggaagaacaagaaccggtggttgtggataacgatgagacggaggagcagatgctgtgtcgggtgcccgtgttcgacccttttgatgtgagaaccgatgacttggatagtttttctgacatggatttcgctgagtttgctgctgatgttgaaagcctacttgataaagaagacgatgaaataagtgcgtgtgtgggagggggagagggagagggagagggagttcaagcgtgcattggccaaggttaaggatgaagaagaaattgatggtgatgtagcgtgttatctggaatcggtttttgatgatgcctttcattggaataacattgagtctgtgctgtcagatgcacgggaagagaaggagggtgtggtggcgtgtgatgtaggtgtcggtgatgaagaaggaggaacaaagagagacatatttttgagactaaactatgatgaggttattactgcttggtctagccaaggttcttctccatggacaacttcaaacccacctaagttcaactctgattatgacttctccttgggtttgagtggtgtaggtggggaagtaagaagcttaagagggcacctagatggtggaagagaagcaagagtgtcaaggtatagagagaagagaaggactcgtttgtttgcaaagaagataagatatgaagtaaggaagttgaacgcagagaaaaggcctagaatgaaaggtcgttttgtgaagaggacatgctttgttggagccaatgcttttcctgcttaccactgacatcaatcaattaacggatccatctttgctttttctgcaaatttgggttaatacttggtttggctatatatatgtacgtatatatagcctgtattatataaatactagtaaataatattactgggccaggttaattttactagaattgttgcttgggatatttctgtctatatatatctctagacaggtttagtaattagtactaattaatgatcatctttattggcaggtttaagccttttggaatccaattttggaagccttttcattgtttctcattagaaattcaattgttcaatgctgatgctgttatttgctagccagttgctatttcacgctgctgatt

SEQ ID NO: 1508 - DNA, 949 bp, Glycine max
  Predicted polypeptide sequence is orthologous to G1255
  misc_feature (409)..(410): n is a, c, g, or t
ccacgcgtccgacttaacaatggtttgtaagatatgagagacatgaaagacgcaggtgccctgggaggcaagacagcacgagcctgcgatagctgcgtaagcagaagggcaaggtggttctgtgcagcagatgatgctttcctctgccatgcttgcgacactttggttcattccgcgaaccagttagcaagcagacacgaaagggttcggcttcaaactgcatcctctaaggcaaccacaaccactacgcacgcatggcacagtggattcacacgcaaggcaagaaccccgcgtcacaacaacagcaagcactttgcgctgcaacagcgtctcaagaacgaagttctcttcaacaacactagtgttcttcccctcgtgccggagctcggaggggaagaacaagagccgnnggttgtggacaacgatgaaacggaggaacagatgctgtgtcgcgtgcccgtgttcgacccttttgatgtgagaaccgatgacttggatagcttttctgacatggatttttctgaatttgctgctgatgttgaaggccggcttgacaaagaagacgatgaaataagtgcgtatgtgggaggaggagagggagttcaaggtgtattggccaaggttaagggcgaagaagaaattgatggtgatgtagcgtgttatctggagtcagtttttgacatgatcagtgatgatgcctttcattggaataatattgagtctgtggtgtcagatgcccgggaagagaaggggtgtgtggtgccatgtgatggtggggttagtgaacaaggaggaataaagagagacatatttttgagactaaactatgatgaggttattactgcttggtctagccaaggttcttccccatggacaacttcaaacccaccttaagttcaactctgattatgacttctccttggtactactactacttaactttcctttt

SEQ ID NO: 1509 - DNA, 1465 bp, Glycine max
  Predicted polypeptide sequence is orthologous to G1255
cttgtttttttcccatcaaaacaatcattcccctgttaccaaaaccacactgtaacccccctttttttggtattggcttcaaatgagttcggctactaagaacgcggcaaacgcggttggggccaaaacggcaagagcatgtgacagctgcataaccaaacgtgcacgttggtactgtgctgccgatgatgcttttctctgccaggcctgcgactcttctgttcactcggcgaatcctttggctcgaagacacgaacgagtccgcttgaaaacggcgtcctacaagtccactgatgaacaacaacaacaacaacaacaacaacctcccacgtggcacactaagaaacctcgaacgccgaggcacgggaaacattctcgtaacaacaaccctttccatttggtccctgaagagggttcggaggaggcgaattcccatgatgagaacgaggagcagcttctttatagggtccccatattcgacccttttgttgctgagctatgtgggactaatagttctccttctcctgttacttcaactgatcaaggagtagttgctgctgctgaggttgaatacaaagggtttcaaagcaatggtttttgtagcaatagcagtgagatggaaaacttgcatgggatgcttccttctgatgcagaacttgctgagttcgctgctgatgtggagagcttgttgggtagggggcttgaaaacgagtgcgtggggatggaagaattgggactggttgatgcgaaagaggaggagtgttcggtaggtagtgggaaggtgaagatggaagatcaggaagagagccctctggtggagatggagatggatatggtcgtgggcagagatgatcaatcgtttgagttgagctttgattatgaaacgtgtgaagaggtgaaggtttgtgatttgggattggggaatgaattaggagcgaagaaagagaatgatgatgaggtgaaaaagaccaagatttcgttgcagctagactatgaggcggtaatcatcgcctgggctagccaaaaatctccgtggaccaccgctgacaaaccaaacttggaccctgatgagtgctggaaacaatgcatgggaagttgcgaaacggcatatcatcatccttgcggtgaaatgggtggatttgggattcatccagtgataatagacgggggcagagaggcgagggtgtcaagatacagagagaagcgccgaacgaggttgttctcgaagaaaataaggtacgaagttaggaaattgaatgctgagaagagacccagaatgaaggggaggtttgtcaagagggcttcctttgcaccaccaacatttcctttgctaaataaataagagctacatttgtatgttctgccactaaagttttgttagtatttgctaagtatagttttgcgacgtgatatcgcttttcatttcattttcttatttctttgtatataaaaattttgctaagtt

SEQ ID NO: 1510 - DNA, 1462 bp, Glycine max
  Predicted polypeptide sequence is orthologous to G1255
acgagcactccctcttttttccatcaaaaataatcattcccctgttaccaaaaccacactgtagcctaacccctcccttttggtgtcatgagttcggctactaagaacgcagcaaacgcggttgggggaaaaactgcaagagcatgtgacggctgcataacgaaacgtgcacgttggtactgtgctgccgatgatgcttttctctgccaggcttgtgactcttcggttcacttggcgaatcctttggctcgaagacacgaacgagtccgcttgaaaaccgcgtcgtacaagtccaccgatgaacgacgacaacctcccacgtggcacaccaagaaacctcgaacgcccagacatgggaaacattctcgtaacaacaaccctttccacttggtccctgaagagggttccgaagaggcgaattcccatgatgagaatgaggagcagctcgtttatagggtccccatagtcgacccttttgttgctgagctatgtgggactaatagttctccttcttctgttacttcaacgctccagggggtagtagctgctgctgctgctgcttctgctgtggttgaatacaaagggattcaaagcaatgatttttgtagcaatagcaatgagatcgaaaacttgcatgggatgcttccttcggatgcagaacttgctgagtctgctgctgatgttgagagctttttgggtaagggggcttgaaaacaagtgcgtggggatggaagaattgggactcgttgataccaaagaagaggagtgttcggtgggtactgggacggcgaaggtggaagatgaagagagccctctgatggagatggatatgggaagagatgatcaatcatttgagttgagctctgattatgagacgtgcgaagaggtcaaggagatgaaggttagtgatttggaattggggaatgagttaggagagatgaaagagaatgatgatgatgaggtgaaaaggaagaaggtatcgttgcagcttgattatgaggcgataatcatcgcctgggctagccaaaagtctccgtggaccactgctgacaaacaaaacttggaccctgatgagtgctggcaccaatgcatgggaagttgcggaacggcatttcatcacccttacggtgaactgggtggatttgggattcattcagtgatagtagacgggggcagagaggcaagggtgtcaagatacagagagaagcgccgaactaggttgttctcgaagaaaataaggtacgaggttaggaaattgaatgcagagaagagacccagaatgaaggggaggtttgtcaagagggcttcctttgcaccaccaacatttcctttgctaaataaataagaccactaatgttttgttagtatttagtatttgcgacgtcatatggcttttcatttcattttcttatttctttgtatataacaattttttaagctaataaatcgtccaaatttataa

SEQ ID NO: 1511 - DNA, 539 bp, Glycine max
  Predicted polypeptide sequence is orthologous to G1255
aaaaaactaaggtttctacctttctacgatgagagacatgaaagacgcaggtgccttgggaggcaagacagcaagagcctgcgacagctgcgtaagcagaagagcaaggtggttctgtgcagctgatgatgctttcctctgccatggctgcgacactttggttcattccgcgaaccagttagcaagcaggcacgaaagggttcggcttcaaactgcttcctcaaaagtaaccaccacgcacgcatggcacagtggattcacacgcaaggcaagaaccccgcgtcacaacagcaagcactttgcgctgcaacagcgtctcaaagacgaagttctcttcaacaagaaccggtggttgtggataacgatgagacggaggagcagatgctgtgtcgggtgcccgtgttcgacccttttgatgtgagaaccgatgacttggatagtttttctgacatggatttcgctgagtttgctgctgatgttgaaagcctacttgataaagaagacgatgaaataagtgcgtgtgtggagggggagagaga

SEQ ID NO: 1512 - DNA, 1381 bp, Oryza sativa
  Predicted polypeptide sequence is orthologous to G1255
ccctcacttagggaataagcttgggccgccgtgtcctgctgcagggaggccgcccccggcgagaacccgacgaagccgtccatgacgacgacgacggctacaacgccaccgctccagttctgccccgacggccacgccaatttcggcccgaccgacgccgagctgagggagttcgccgccgacatggaggccctcctcgggcgtggcctggacgacggcaacgacgaggactccttctgcatggagacgctggggctcatcgagccggtggacgacgacgccgggcgggtcaaggtggaggccgacggcgacgccgggatgaccctagcgtggtgccacgagctggacacggagacgtcgtccggcgagatgctggacatcgacttcgactacggctcacctcaggcggcgacgacacccgacgagaaggtcgggagcagcgggcccgccgccgccgccgacgacgacgcccagttccagcagagcagcctcgccctcagcctcaactacgaggccatcatcgagagctgggggacctcgccgtggaccgacggcgagcggccgcgcgtcaagctcgacgactcctggccccgcgactactcgggggtgtggatggcggcggcaggggtgttcgggcacggcggcgaggagcaggcgctgacgccgaggctggggatggacggcggcagggaggcgcgggtgtcgcggtacagggagaagcggcggacgcggctcttctccaagaagatccggtacgaggtgcgcaagctcaacgccgagaagcggccgcggatgaagggccgcttcgtcaagcgcgccgccgccgccgccgccgtcgccacggcgtgcgtcgcgtaagcgctgcatggcggaagtttgatctgccggccgcgcgctcgccatgaaatcacacaagaacaaaacaactcgtcgaaactgcattagttttagctggtttctttcacggtcacaaatgcgtcttctttttccatcagttcgccattgatggttgctaaggatccaaggacttttaataataattattactataataataatgataatactaataagtgaattgtactatttgttgagaggtatacagtacccctgcgctcaattgctgaaagttttgaaagtttttttccccccttcagattcagggggttggttgacagtagtagcctgtagctgtgctatatgtatgcatatatgtccattggttgtcatgcacgggtacagttcgaggccaggagatatacatgtaaatcaatcaatcaatatatacaactaattgattcagtgatgaaaaaaaacctgcagcccggggatccaaaaaaaaaaaaaaaaaaaaaaaaaaagggggaggcctgcagcccgg

SEQ ID NO: 1513 - DNA, 641 bp, Oryza sativa
  Predicted polypeptide sequence is orthologous to G1255
cccgggctgcaggaattcggcacgaggcctcgtgccgaattcggcacgagggaggccctcctcgggcgtggcctggacgacggcgacgacgaggactccttctgcatggagacgctggggctcatcgagccggtggacgacgacgccgggcgggtcaaggtggaggccgacggcgacgccgggatgaccctagcgtggtgccacgagctggacacggagacgtcgtccggcgagatgctggacatcgacttcgactacggctcacctcaggcggcgacgacacccgacgagaaggtcgggagcagcgggcccgccgccgccgccgacgacgacgcccagttccagcagagcagcctcgccctcagcctcaactacgaggccatcatcgagagctgggggacctcgccgtggaccgacggcgagcggccgcgcgtcaagctcgacgactcctggccccgcgactactcgggggtgtggatggcggcggcaggggtgttcgggcacggcggcgaggagcaggcgctgacgccgaggctggggatggacggcggcagggaggcgcgggtgtcgcggtacagggagaagcggcggacgcggctcttctcccagaagatccggtacgaggtgcgcaagctcaacgc

SEQ ID NO: 1514 - DNA, 455 bp, Oryza sativa
  Predicted polypeptide sequence is orthologous to G1255
gcacggaggattttttttttgttaaccgcgaaaagtgttgtgttgtttgggtaggcagtgtgtgcgacggaatggcgagcgccgccgcggcgacgggcgcggcgctgggggcgcgcacggcgcgggcgtgcgacgggtgcatgcggcggcgggcgcggtggcactgccccgcggacgacgcgttcctgtgccaggcgtgcgacgcgtccgtggactcggcgaacccgctggcgcggcggcaccaccgcgtgcgcctcccgtcggcgtcctcctcgccggcatcctcccctcgctcggcggtcgctccacgtgccggatcagacgaccccgacgcgccggcgtggctgcatgggctcaagcggcggccgcgcacgccccggaccaagcccgggggaggcggcaagcacgacgcctccgccgcgacggtggccgcggcggcggcgtcggcggtcccg

SEQ ID NO: 1515 - DNA, 543 bp, Oryza sativa
  Predicted polypeptide sequence is orthologous to G1255
gctgcagctcggagaaggcggccggggccgtgggcggcaaggcggcgcgcgcgtgcgacagctgcctgcggcggcgggcgcggtggtactgcgcggcggatgacgccttcctgtgccaggggtgcgacacgtcggtgcactcggccaacccgctcgccaggcggcacgagcgcctgcgcctgcgcgtctcgtcgcccccgccggtgacggcgcgggcgtcggtggaggaggaggcggcggcggcggtggggacgacgacgacgacgacgtcgaagagagagggcggcgtctcgccggcatggtcgaagcgcaaggcgcgcacccggcgcccgcaggtcaagagcgtcgggcagctgctctcgaggcggctcgtcgtgccggagatggcggtggagtcgtcggacgaacggaaggccgacgaagacggagctcacgaggagctcgaggggcagttgctgtaccgcgttccggtctttgacccctccctcaccgagttctgctcgccgcccgcgatcgatgacgcggcggccgcatcctcatcgt

SEQ ID NO: 1516 - DNA, 543 bp, Zea mays
  Predicted polypeptide sequence is orthologous to G1255
  misc_feature (188)..(188): n is a, c, g, or t
cgcttctcggcgttgagcttgcgcacctcgtaccggatcttcttggcgaacagtcgcgtccgccgcttctccctgtatcgcgacacccgcgcctcacgctcgccaccggtcaccggtgtcacggctccgccgaggagttcccggtctcccgtctgcatgcatgcgatccatggcaaaaggaaagccgntcagttatttatcccaagacagtgccagagcatgtgtagatctcatgctcgaaccgtagtgcttaccgtgaagtcgtccgaccatagctcgtgacagtcgaggtgaggacgctcgccgtggaaccacggcgagccgccgtcacggacccatgaggcgatgacgccttcgttgttgagcttgagtatcatctccggccgcttccgtttcttgtcctctggttcaggcgccggcgctactatggcgtccaagtccgcgttcacctgaggtttctcttcgtcccagaaacccaaacagtcaaacccgtcgtcgtcgactcccatgaggaggctctccatgtccgcggtgaagctagcg

SEQ ID NO: 1517 - DNA, 649 bp, Zea mays
  Predicted polypeptide sequence is orthologous to G1255
  misc_feature (640)..(640): n is a, c, g, or t
ctccgcgttgagcttccggacctcgtaccttatcttcttggcgaacagcctcgtccgccgcttctcccggtaccgtgtcacccgcgcctctcgcccgccgcccatccccagccgtggagtcaccgccgcctccccacccaaccgtcctcctcccgccatccagccctgcacgcaaaccttgcatgaacccgattgtactttgcaagtcgaagcataattaagcacgcgtcgacactcgacagcgctcgcgatcgatcgatcgaggacgaggagcagcgtgaatttgaaaataaacgtaccgtgaggtgggcgtggggccagaaatcatcgagctggacgcttggccgttggccatcggtccacggcgagcttccccagctctcgatgatggcctcgtagttgagactgagatccaggctcctcttcaagaattgcgtacccgcggcggcggcggcgttgctcgccgacgccttctgttcggaactgtcctcatcctcgttatccatcatcaccgtgggcgagcagcagttgaagtctgtgtccagcacctcagcagcagctgacgacgcctctggcttcatctccgtagggccaaatccgggagcgccctcgccgcgggagcgggagcgtacgatgccgntgggctcca

SEQ ID NO: 1518 - DNA, 786 bp, Zea mays
  Predicted polypeptide sequence is orthologous to G1255
  misc_feature (699)..(699): n is a, c, g, or t
cattgggtacctcgaggccggccggggtagcaagatcgttgcacaccgctcggaagagaaatgattgccacgaccggcggcagctcggcgaaggcggcggcggtgggcggcaaggcggcgcgcgcctgtgacgggtgcctgcggcggcgggcgaggtggtactgcgcggcggacgacgcgttcctgtgccaagggtgcgacacgtcggtgcactcggcgaacccgctcgcgcggcggcacgagcggctgcgcctgtgcccggcgtctccgctgcagacgccgccagctcgctcggcggcggcagcgacggcgactaataagcgcgagcgccacgacgaggtggcggtgcccgcgtggttcgggcgcaaggcgcgaaccccgcgcggcgggcacgccaaaagcgtcggccaggtggcgttgtcgcggcgcctcgtcgtaccgcatgcggctggcggggactcagactcacccgatgagcgaaacggcggcgaggaggagcagctgctctaccgcgtgcccatccttgaccccgccctagccgagttctgctcgcccccgcctctcgaggaccccgcgaagccggatcctgcggcgccgctggcccagttctgccccgtcggcggccatttcaacttcggcccgaccgacgccgagctcagggagttcgccgcggacatggaagccctcctcgggcacggnctggacgacggaaacgaggaggaatcgtcgttttacatggagacgctgggcctcctcgaccaatggaagtgggcgacgatgccacgc

SEQ ID NO: 1519 - DNA, 810 bp, Zea mays
  Predicted polypeptide sequence is orthologous to G1255
  misc_feature (766)..(766): n is a, c, g, or t
aaagtacacttgggcacttggcatcgcggccgaggtccccgaaaaagagccgtgctgggccctaatccagacgtgatattttctcgcgattttgtcacgttagcggccagctacatcctgacgatcctgtcacccgctcgatcggcgggcgctggagcgcgcgcatctagctttgtgcaagtttcacgggatctctagctttgtcggcggcacatgagcagctccaagcacgccgcgggcgccgtaggcggcaaggccgcgcgcgcctgcgacagctgcctgcggcggcgcgcgcggtggtactgcgctgccgacgacgccttcctgtgccagggctgcgacgcctcggtgcactcggcgaacccgctcgccaggcggcacgagcgcctgcgcctgcgcccgacggacccgcactcgacgacgctcgaggccggcgtggcgacgacgacgtggaagaagcgccagcagcaggtcgcgccggcgtggtccaagcgcaaggcgcgcactcggaggccgcacgtcaagagcgtcggggagctcctgtcgaggaagctcgtcgtcgtgcctgaggtgtcccccatcgaatcgtcggaggagcggaaggccgaggaggagggggaagaggaggaggggcagctgctgtactgcgtgccgacctttgaccgcgccctggccgagctctgctcgccaccgcctccggtcgatgacccgacggcctcatcctgctgcagggatgacgtcgacggcgccgtggagaacaacacanaggcaccaccggtcgtggttgcgggatcgcccgtgcagcagctt

SEQ ID NO: 1520 - DNA, 1494 bp, Zea mays
  Predicted polypeptide sequence is orthologous to G1255
ccggccggccacctgttcccgttttttttgttaagctctcgcttaacctaaacgccgggagcacaagtgctcggcgaaatgacgagcgccggggcggcgacaggcgccgcgctaggcgcgcggacggcgcggtcctgcgacggctgcatgaggcggcgggcgcggtggcactgccccgccgacgacgccttcttgtgccagacctgcgacgtctccgtgcactcggcgaacccgctcgcgcgccgccaccaccgcgtccgcctcccctctgcgtcctgctcctccccaccgcgcgacccggacgcgccaacgtggctccacggcctcaagcgacggccacgcacgccgcggtccaagccaggggggagcaagagcaacaagcatgaggcgactcccagctttatcgccgcggctgcgtcgtcggcagcggtccccgacctcgaggcggaggagtccggctccggtatcctgggcggtaacgacgaccaccacgggttcctgcaggatgacgacgaagaccttctgtaccgcgtgccggtgttcgaccctatgctcgccgagttctacaaccccgtggccgacgagggggagcagaagccggcctgcagcctgctgatgccgtctctcgcggaaacatcgccggagttcgcctccggcggctcggcggaggcggacgggctctccgtgtcgttccacgtcccggacatggagctcgctagcttcgccgcggacatggagagcctcctcatgggagtcgacgacgacgggtttgactgtttgggtttcttggacgaagagaaacctcaggtgaacgcggacttggacgccatagtagcgccggcgcctgaaccagaggacaagaaacggaagcggccggagatgatactcaagctcaactacgaaggcgtcatcgcctcatgggtccgtgacggcggctcgccgtggttccacggcgagcgtcctcacctcgactgtcacgagctatggtcggacgacttcacgacgggtagccgggaactcctcggcggagccgtgacaccggtgaccggtggcgagcgtgaggcgcgggtgtcgcgatacagggagaagcggcggacgcgactgttcgccaagaagatccggtacgaggtgcgcaagctcaacgccgagaaacggccgcggatgaagggccggttcgtgaagcgcaccacgctcccgccgctgccgaggccgcccccgccgtcacagcagcaacagaagaagaagcaactgccacgctcattgccacacgtgggcatggtgctcgcgccacctccaggagcggacgggcgcttccggttttgagtctttgagatcacgcacgcaagcacggaaggctcggtatcaggacatcaggtgcacaacggagggatagtgcacaaatgcacaaacttgatcctgcccttccatctcccaatgaacggtcaccgccaaaattgcaagatggcccctccgcacctcctcctcctttaaaaa

SEQ ID NO: 1521 - DNA, 1140 bp, Zea mays
  Predicted polypeptide sequence is orthologous to G1255
ccacgcgtccgcggacgcgtgggcgacgacgaggaccttctgtactgcgtgccggtgttcgaccctatgctcgccgagttctacaaccccgtggccgacgagggggagcagaagccggcctgcctgatgctgcctctcgtggaaacatcgccggagttcgcctccggcggcttggcagaggcggacgggctctccggcttcgacgtcccggacatggatctcgcgggcgcgtgggcggacatggagagcctcctcatgggagtcgacgacgggtttgacgatctgggtttcttggacgaacagaagcctcaggtgaacgcggacgtggacttggaggccatggcggcgccggagcctgaacgagaggacaagaaaaggaagcgggacggctttgattatctgggtttcttggacgaagagaagccacaggtgaacgcggacgtagacttggaggccatggtggcgccggagcctgaacgagaggacaagaaaaggaagcgaacagatatgatactcaagctgaactacgagggcgtcatcgcctcgtgggttcgtgacggcggatcaccgtggtaccacggcgagcgtcctcacctcgacgatccttacgagctatggttggagttcccggcaacggggagccggggacttttcggcggcaccatgacagcggtgaccggcggcgagcgtgaggcacgggtgtcccggtacagggagaagcggcggaggcggctgttcgccaagaagatccggtacgaggtgcgcaagctcaacgccgagaaacggccgcggatgaagggccggttcgtgaagcgcaccacgctcccgccgctgccgaggccgccgccgccgtcacagcagcaacagaagaagaaacaactgccacgcgcattgccacacgtgggcatggtgctcgcgccacctccaggagcggacgggcgcttccggttttgaatctttgagatcacgcacggaagcatggaaggctcggtatcaggtgcacaacggagggatagtgcacaaatgcacaaacttgatcctggccttccatctcccaatgaacggtcaccgtcaaaattgcaagaaggcccctccgcacctcctcctcctttaaaaaaaaaaaaaaaaaaaaaaaaaaag

SEQ ID NO: 1522 - protein, 421 aa, Oryza sativa
  Orthologous to G1255
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPVFDPMLAELYNPVAADDEEQQIEQKPAARVVPFSEPSPEFASGSVEADGLSGFDVPDMELASFAADMESLLMGVDEGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 1523 - DNA, 527 bp, Glycine max
  Predicted polypeptide sequence is orthologous to G1266
caacttcctcggtgtctcatggttcaggtagtgttgtggaagcagaggtttcggtttcgtacagaggggttcgaaggaggccctgggggaagtttgcggcggagataagggactctacgaggaacggagtgagggtttggttgggaaccttcgacactgccgaggctgctgcgttggcttacgaccaggccgcgctggtcatgagagggtccatggcagtgttgaacttcccagctgagattgttcgccaatcgcttcggaacatggagcagtacggtagtttccaagaaggctcttctccagttctggagttgaagaagaggcactccatgaagagaaaatcagagaccaagaagcaccaactccacgatgtgatggtgttggaggacttaggggcagagtatttggaacaccttcttactctctcccaggatatggatatggatgcttgttagttaagttacatttacctccttcgtcaaaccttgcctttcccatccccaccactttcttttctctctctatca

SEQ ID NO: 1524 - DNA, 593 bp, Glycine max
  Predicted polypeptide sequence is orthologous to G1266
  misc_feature (6)..(7): n is a, c, g, or t
  misc_feature (15)..(16): n is a, c, g, or t
  misc_feature (33)..(34): n is a, c, g, or t
  misc_feature (41)..(43): n is a, c, g, or t
  misc_feature (46)..(49): n is a, c, g, or t
  misc_feature (90)..(92): n is a, c, g, or t
  misc_feature (457)..(458): n is a, c, g, or t
  misc_feature (464)..(465): n is a, c, g, or t
  misc_feature (493)..(493): n is a, c, g, or t
  misc_feature (590)..(591): n is a, c, g, or t
aaccgnngagagganngcatcatacatacgcanngacgatnnncgnnnnaaatgatctttttttttcacagcaatatactaatcaaagcnnntaaccaatattgagtcccctttctttcagcatgcagattggggcatgttgaaggagcctaattcggatattttgtttgaatcattttcaagcaaaggagttgatcatgaccctttccatgattgtctttcctttgatatgattgataactcaagggatccacaggaagaaagtcatcatcaagtgattgaagaagctatgaaaacaaagaagaagtcttatattggggtaagaagaaggccatggggaagatttgcagcggagatcagagacacaacaaggaagggtataagggtttggcttggaacgtttgatagtgctgaggaagctgcattggcttatgaccaggctgcattttccatgagnngctctnntgcagtgctgaattttccggtcaaaagngtcaaagagtctttacaagagatgaactattctggttgcagccgaaggtgctctcctgcattagaactcaaagagaggcacaacataagaagaaaanngt

SEQ ID NO: 1525 - DNA, 514 bp, Glycine max
  Predicted polypeptide sequence is orthologous to G1266
aactctgtttactcatctggtgttagaatggatagttcctctcatcagctcctccccttcaacgaaaacgacccagaagacatgcttctctatggcatcatcacttcatgccaagaaaaaaaagtgaccatcaaccaagagcaagtgaataagaagaggagcagcttccgcggcgtgcggaggcggccgtgggggaagttcgcggcggagataagagactccacgcggcatggcgtgagggtgtggcttgggacattcgacaacgccgaggccgccgcgctggcgtatgaccaagccgcattctccatgaggggctccggcgcggtgctcaacttccccgtggagaaggtgaaggagtctcttagagacatgaagcttgatggatgctctcccgttgtggccttgaagaggagacactccttggctgctaagaggaagaaggaagatgtccttgttttccatgaccttggggctgattatttggaacacttggtgatgtgctctgatctaccta

SEQ ID NO: 1526 - DNA, 989 bp, Glycine max
  Predicted polypeptide sequence is orthologous to G1266
ccagcgtccgcccccacccgtccgtaaaaaacagagcaactactcaattcttcactctgtttccccttaccttacacactctaacacatggattcaccttcctccttcttcaactcaccctcttccggtttctgctccgaatcttcctctccggaagccttctcgtgggaagggtacctacccttcaacgagaacgacccggaggagatgcttctatacggcatgatcgccggcgcgacaaccgaggagcactccggcgagagggcgagctcggaggagagtgctgcagcacggaaggagaagtcgtaccgcggcgtacggcggcggccgtgggggaagttcgcggcggagataagggactccacgcgccacgggatgagggtgtggctggggacattcgacagcgccgaagccgcggctctggcttacgaccaagccgcgttctccatgcgcggctcggcggcgattctcaacttccccgcggagatcgttagagagtcgcttaaagagatgaactacgctcatgatgattccaacaacgaagaagggtgctcccctgttgtcgctctcaagaggaaacactctttgagaaggaaaattaacgtcaggaagaagaagaacaacaataacaatagcaaactacaaagtagtaccgtagacaatgctgtcgtgtttgaagaccttggtcctgattacttggaacagctgttgatgtcctctgatcatcatattcccaccaccttctgattcatttattcctcaattgcaattcagatctcaaaaaccttataaatatccattgcatagtttctacctagggtttttgtgttagtagtgttaattccttcttcttctttgttcttttgtttttgtaaggctaaaatgcttaggtcatgtttggatgacagatttgaacttcttttcagttcttatctttttttctttgtttttgtttttgttttcctactctgggagaattttcttcttta

SEQ ID NO: 1527 - DNA, 430 bp, Oryza sativa
  Predicted polypeptide sequence is orthologous to G1266
aaaagtcaatccacgccaccatcgatctctctatccaatccaagcgcgcaaatcaatggcagagcatttcagccacgccggcatgtacatcggctacacggcagacgccgccgcgtcctcctcctcctcctcctcgtcttcgtcgtcttcctcctcggagatgcttcggttcgacacgggctggcccgacgagacacctgcgccatcctccgtggcggggaggaggaggagcgcgggcggtgatcatcgtcaaggtcggggacagacggaggcggcggcggcgttcatcggggtgcggaggcggccgtggggcaggttcgcggcggagatccgggactcgacgcggaacggcgcgcgggtgtggatcggcacgttcgacagcgccgaggccgccgcgatggcctacgaccaggccgcgctctcgcgcgtg

SEQ ID NO: 1528 - protein, 277 aa, nicotiana tabacum
  Orthologous to G1266
MDSSSCSSHFFYPMNSDLSSDSSWEWSNLNSTSLPFNVNDSEEMLLFGVLTNTAQETTSETVTSYHVKEEEVSSKSKVIKEIEEKPAKEKSFRGVRRRPWGKFAAEIRDSTRNGVRVWLGTFDSPEAAALAYDQAAFLMRGTSAILNFPVETVQESLRDMKCHVDEECSPVVALKKRHSLRKKSLSSKKSNSSSNSKVVREVKMENVNVVVFEDLGPDYLEQLLSSSSSDHSSCNEAFYHVNQRFTQLCIYLFIYLYYFCLFSFRGREIGEFHLFVL

SEQ ID NO: 1529 - DNA, 825 bp, Oryza sativa
  Predicted polypeptide sequence is orthologous to G1275
agtggatcccccgggctggaggaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctatttcggcaggcggcttcgctgctcttctgagggctgatgaagtttgtctaggactagacacgcccgggagctctagctaggatagaaaactagagaaagtttaattatacctgaattttaattaatcacctcacaaaactctgatgtatcatattatatcgtgatagtgactggttgttaatttaattttggcgatcgatgtgatcttcggt

SEQ ID NO: 1530 - DNA, 1696 bp, Zea mays
  Predicted polypeptide sequence is orthologous to G1275
cggacggcacatcaacggacagacacacacaagcaaggcggctagcggtgcaagtagtgcgaagctagctaggtgctggtgcatgcaatggcggcttcgctgggtctgaaccctgaagctgtcttcacttcctacacctcctcgccgccgttcatgtcggactacgtggcggcgagcttcctgccgccggccgtcgtcgactccacggacttctctgcagagctcgatgatcttcaccaccacttggattactcatcgccggcgccgaccttggccggggctcggagcgatcgcagcgagaagcagatgatcaggtggtgtgagggtggtggtggcgagaagagactcggtaggatcgggttcagaacgagatcagaggtggagatcttggacgatggattcaaatggaggaagtatggcaagaaggctgtcaagagtagcccaaatccaaggaactactaccgctgctcgtcggagggctgcggcgtgaagaagcgggtggagagggaccgcgacgacccccgctacgtcatcaccacctacgacggcgtccacaaccacgcaagccccgcagccgccgccatcatccagtacggcggcggcggcggattctatagcccgccgcacagcggctcgccgtcggccgcctcctactcgggctccttcgtcctctgacttctccgggccttgacccagagtgatctgatctacctgctttatcccagtcgtaggatgagaagagtgttcagacttcagagacatcagttcagcggccggctaaattcggacctgattgtagatatttacacctcaattattggttacctcttgtgacgactgacgaggcatcataatcgtcactaggataattgatcacgcatgtttttcgcttaattagtttctgtgtatacatacgaagtttgccgtatagctgataggctgctgatttaacttgacttctctttgttcggtattagaccccaagatcaacatttacgctgaacagatgctttgtaacagtgaaggaatattttatggtttttccagatatatgccattatgaaaataaaaaaaaaaaaaaaaaaagcggccgcttggtttgtctctttgttggcattccttgcaacaaattattaattctccacggtacagaacgggacatcatcacaatgtcagtgcgcaaccataactgaactgcaacaatgaagaacaggtagcaaaccttatttcgagcaaacagtcagctcagcttagaaactaactaaaaagagcacggcactcattggcctcattagccatctcttccatgctcctatctttcctctcaatgtccaggtcaagcttctccttcaattctttctccttcacatcaatcgcatcatatatttcatcatttttctcaaaatcccctttcttccttgggatgaggtggatgtggacatgcgcaactgtttggccagcttgaggaccatcctggatagcaaaggtaagtgacgatgctttgtggtactgctcaagacgtgcaccaacttcctttgcagtaacccataagtcactaatctcatcagaacttagatcggcgaatcttttcacttcacgcttggggcacacaagaacatgtaggtattgtcaaggaaaaaccagtgcatatagaagaacacagtttcctaaaacatgatgtatcaaactttgagtc

SEQ ID NO: 1531 - DNA, 1663 bp, Zea mays
  Predicted polypeptide sequence is orthologous to G1275
cattgggaccctcgaggccggccgggtctaattatatgataggtgtcaagtggaagtgcagtgatgtatgcagctgaggcatcctaacagaccccggccgacgggaaacaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaaataatgcgtggttttcgcgcccaaaattgggaaccccgaggccggccggggttattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctaggcggccgctcaaaaaaaaaaaaaaaaaaaaaaaaaaaaaaaaaaaaag

SEQ ID NO: 1532 - DNA, 999 bp, Zea mays
  Predicted polypeptide sequence is orthologous to G1275
agagaaaggcagggtcggagcgctgcaggtgtttgggcgcccaactctttgggtttagctactgttcattcgtcttcctcctctcaccaatctgtgtcctgtgcttgtgagcgttttagagttccaacacattctagctacgtgacccgtacgtgcgtgtaataactgatggatgacggatcggatcagtacgacgactccgaggaatgagcaaccgccgccgcggcgtgcagctgcgcctcccaccacgcgtcacaggcggcgctccagctgggcgctgcagccagaggcgctggcgccgaggccgagcgtggaggcgagaagggcgttgcggtcgcggttgcgccgcgcggcggcggtggttggcacaggtaggaggcggcgcccgggcccggcgcggcgtggttgtggacgccgtcgtaggtggtgacgacgtagcgcgggtcgtcgctgtcccgctccacgcgcttcttcacgccggagccctccgtcgagcaccggtagtagttcctcgggttggggctgctcttgaccgccttcttgccgtacttgcgccacttgaagccatcgtccagcacgtccacctccgaccgcgtccggaacccgatccgtgacgacgacggcggccggccgccgccgttcccaccggtgccatatggtggtccgctcatcggcctcctcccgtcgccgtcgccgtccacgccgtagctcagcaggctcatgccattgccgacggcggcggtgacggcgtctgaagaactgttggcgaacaccggcgccgagcagtcatcggccaccatctcctggccggtgaacccgaactggaagtagtcatcggccatggtggcggcggcgggcggcgggaggtccgccacgaggtcgggtggtggtgggaagtacgaggaggcgggcgcgggcggcgggtagtaggcggcgtagctcgtctcgtgggcgagtcctagcgaggccgcctgagtaagtagacgcacgcgccggcag

SEQ ID NO: 1533 - protein, 194 aa, Oryza sativa
  Orthologous to G1275
MAASVGLNPEAFFFSNSYSYSSSPFMASYTPEFSAAAIDANLFSGELDFDCSLPAPAQEYPENENTMMRYESEEKMRARVNGRIGFRTRSEVEILDDGFKWRKYGKKAVKNSPNPRNYYRCSTEGCNVKKRVERDREDHRYVITTYDGVHNHASPAAAAAALQYAAAAGDYYSPPLSSAGSPPAAYSAGGSLLF

SEQ ID NO: 1534 - protein, 246 aa, Oryza sativa
  Orthologous to G1275
MSSLYPSLLSLSESPAEYRQVGGGRYAGEDVVDDDDDMAAVADAVSSYLSFDMDDVEYYTPEVGFHSKQHNPPPVAAAPLEAGGGREQSRREAAVNLGKMDRGPAPVSGGAATGGVPRSKNGSKIAFKTRSEVDVLDDGYRWRKYGKKMVKNSPNPRNYYRCSSEGCRVKKRVERARDDARFVVTTYDGVHNHPAPLHLRPQLPPPGGYSIAGAPAVVAPHGRLGLEEAEVIALFRGTTATSLLLP

SEQ ID NO: 1535 - protein, 219 aa, Oryza sativa
  Orthologous to G1275
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 1536 - DNA, 988 bp, Glycine max
  Predicted polypeptide sequence is orthologous to G1322
cggctcgagcggctcgagctcgagccctcggcccggctcgctttatgcttgcacacaaaataatggacaaaaaaccatgcaactcatctcatgatcctgaagtgagaaagggaccatggaccatggaagaagacttgatcttgataaactatattgcaaatcacggtgaaggtgtttggaactctttagccaaagcttctggtcttaaacgaacgggaaagagttgtcgactccgttggctaaactaccttcgtcctgatgttagaagaggaaacattacacccgaggaacagcttttgatcatagaacttcatgcaaagtggggcaataggtggtccaaaattgcaaagcatcttccaggaagaactgacaatgagattaagaacttctggagaacaaggatccaaaagcacattaagcaagctgagacttcacaacaacatggtaattcagagaataatgatcatcaagcaagcactagtactagcaaagtgtccaccatggcacatccaaatgagactttctctccaccctcataccaaggaacttttgagccattccaacctcaattccctacaatcactgatcaatcaagttgttgtaccaccaccaacgacaacaacaactattggagcatcgaggatatctggtcgtctatgcaattactcaatggagattaaacctagctatatgcatgcctatataaatcatatatatgatgatatataaacctaagctcttgtagagtgtgttcaggcttaataacatcattaggtctgtttatatgagtagtctaagtttggtgtttgtaatgcatgatgtgagttaagaattaatttagttatggattgaaatatatagtaacttatatactacatgtgcattctcctattatcgtaaataatatggttgttgtaccatatattatcagtgacgggcatgctcgtattttagtaaatcggtataaataattgctttgtctcaaaaa

SEQ ID NO: 1537 - DNA, 968 bp, Glycine max
  Predicted polypeptide sequence is orthologous to G1322
aattaggctccagtatctctctctctcccctcttccccacccaaccttctctctatcacacacacaagtcaatggataaaaaacaactgtgcaacacgtctcaagatcctgaagtgagaaaagggccttggacaatggaagaagacttgatcttgatcaactatattgcaaatcatggggaaggtgtttggaactctttggccaaagctgctggtctcaaacgtaccggaaagagttgccggctaaggtggctaaactacctccgtcctgatgttagaagagggaatattacacccgaggaacaacttttgatcatggagcttcacgcaaagtggggaaacaggtggtccaaaattgccaagcatctacctggaaggactgataatgagatcaagaactattggaggacaaggatccagaagcacatcaagcaagctgagaactttcagcaacagagtagtaataattctgagataaatgatccccaagcttgcactagccatgtgtccaccatggcgcagcccatggagacctattctccaccctgttatcaaggaatgttagagccattttcaactcagttccctacaattaatcctgatcaatccagttgttgtaccaatgacaacaacaacattaactattggagcatggaggatagctggtcaatgcaattactgaacggtgattaaatattatcaagataaaacctaagttctgaagttccataaggctggaatgtctctggattaaaacatattattgggtttgtttatataagtagttggatgtttggttttgcgtaccattattagctatgtgctgtaatatatacgagatcttatattaaactatatctgcatgctttatatatattttaaatgaggtgctatgtgcattgtagaagatacagttaagaaccacatagttcaaaacacttaatatattcccagtggcatgcttgctta

SEQ ID NO: 1538 - DNA, 969 bp, Glycine max
  Predicted polypeptide sequence is orthologous to G1322
tggcaagagctgggggcttttttatgatcctgccctgttattcgggccaggacaatggaagaagacttaatcttgatcacctatattgccaatcacggggaaggggtttggaactctttggccaaggctgctggacttaaacgtaccggaaagagttgccggcttcggtagctaaactacctacgtcctgatgttagaagagggaatattacacccgaggaacagcttttgatcatggaacttcatgcaaagtggagcaacaggtggtccaaaattgccaagcatctacccggaaggactgataatgagattaagaactactggaggacaaggatccagaagcacctcaagcaagcttccagcagcttccagcaacagagtagtaattctgagataatttatcatccccaagcttgcactagccaagtgtccaccatggcgcagcccatagaaacctattctccacccagttatcaaggaatgttagatccattttcaattcagttcccaacaaatcctcatcattctagttgttgtaccaatgacgacgacaacaacaactattggagcatggaggatatctggtcaatgcaattagccaattactgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcagaagcagacacatgg

SEQ ID NO: 1539 - DNA, 418 bp, Oryza sativa
  Predicted polypeptide sequence is orthologous to G1322
agcaaatccaccgccccctcacccgtctctgctctgctctgctctctgttcctcgcggcacgctagctattcgatggccaccaggatgtgcggccgcgccggcgagccggcggtgcgcaagggcccgtggacgctggaggaggacctcatcctcgtcagctacatctcgcaaaacggcgaaggatcctgggacaacctcgcgcgctctgccgggctgaaccggaacgggaagagctgcaggctgcggtggctcaactacctgaggcccggtgtgcggcggggcagcatcacgccggaggaggacatggtcatccgggagctccactcccggtgggggaacaggtggtccaagatcgccaagcacctccccggccgcaccgacaacgcgatcaagaactactggaagaccaagatacac

SEQ ID NO: 1540 - protein, 249 aa, Oryza sativa
  Orthologous to G1322
MQYTVEGSGGGGVQTVEAAVRKGPWTMEEDLSLVNYIAANGEGAWNTLARAAGLNRTGKSCRLRWLNYLRPDVRRGNITPEEHTLIVELQARWGNRWSKIARYLPGRTDNEVKNFWRTKIQKKHRKSTDGIYATTTSESIMPAATVHQNTVAEDQGSSSVSGRTTTATVAVTQEYATEAPPPSGMSSGSYLDQLQPGYASSIHGGQDGGAAAAAAGDVVVSDEFLAASSDNFWALEDLWPTVQSLHGNC

SEQ ID NO: 1541 - protein, 228 aa, Oryza sativa
  Orthologous to G1322
MATRMCGRAGEPAVRKGPWTLEEDLILVSYISQNGEGSWDNLARSAGLNRNGKSCRLRWLNYLRPGVRRGSITPEEDMVIRELHSRWGNRWSKIAKHLPGRTDNEIKNYWRTKIHRKPRGRSQLLQEPCEDAMGMGMSTTTSEAASTSASSGQSQASPGVWDEYMQASSFPHPELVSFAADHHLEMAGVGEVAAAAAAQFVPTEFGFNDGFWNFVDNFWETMPVSDVV

SEQ ID NO: 1542 - DNA, 777 bp, Zea mays
  Predicted polypeptide sequence is orthologous to G1323
  misc_feature (11)..(11): n is a, c, g, or t
  misc_feature (687)..(687): n is a, c, g, or t
  misc_feature (753)..(753): n is a, c, g, or t
ctcggccgggngcagctccgcacagtgcccctggcacaggcgaggagcaggagcttctgaggtgtcgccgcgtagcagcaactgcagcttggggctcggaacgaacgagaagaaacaggcatggggaagggccgggcaccgtgctgcgccaaggtggggctcaacaagggctcctggacgccggaggaggacatgcgcctcatcgcctacattcagaagtacggccacgccaactggcgcgccctgcccaagcaagcaggtctgctgcggtgcgggaagagctgccggctgcggtggatcaactacctgcgcccggacctcaagcgcggcaacttcaccgccgaggaggaggaggccatcatcaagctccacggcttgctcgggaacaagtggtccaagatcgcgtcgtgcctgccgggccggacggacaacgagatcaagaacgtctggaacacgcacttgaagaagcgggtgtcgccggccggggaggagcgcggcgccgccgggtccaagaagaagaagaaaaagaagacgacgaaggcagccgctggcggtggcgcggaggcgccgctgccgctccggttcgcggtcgccgtcctcgtccacgacgacgaccaacttctccagcggcgactccggcgagcagcagagcaacaacatgagcaaggaagcggacgacgagctggnacctggagacttcgagatgatgccgatgctcgacgtcgacgaccccagcttcggctttggcacgcntggtggacaccgcgccagcgccgt

SEQ ID NO: 1543 - DNA, 1302 bp, Zea mays
  Predicted polypeptide sequence is orthologous to G1323
acccgggagcagacagtgacaggcgaaccaagacacgcagggacagggagacatggggcgagggcgagcgccgtgctgcgccaaggtggggctcaacaggggctcctggacgccgcaggaggacatgcgcctcatcgcctacatccagaagcacggccacaccaactggcgcgcgctgcccaagcaagcaggtttgctgcgctgtgggaagagctgcaggctgcgctggatcaactacctgcggccggacctcaagcgcggcaacttcaccgacgaggaggaggaggccatcataaggctgcacgggttgctcgggaataaatggtctaagatcgctgcctgcctgccggggaggacggacaacgagatcaagaacgtgtggaacacgcacctgaagaagaaggtggcgcagcgggagaagaagaaggccggcgcggggagcggcgacgccggcacgcccgccactgcgcccttgtcctcggcgacctcctcgacgacgacccacaacagctccgggggcagcgactccggcgaccagtgcggcacgagcagggagcctgacgcgaccgacgtgtgccccctccagctagaggacatggacgtctcggacatgctggtggacggcgcgcccccggcggcgcagccaatgccgtcgccgtcctcctcgtcctccctgacgacgtgcgtcggcggcgtggaggagctgatcgagctgccggtgatcgacatcgagccggaaatctggagcatcatcgacggcgagagcgctgtggcgcgccatggtggcgatgcagccgcgccatgtacgggcaccggcaccgccgtcagcaccagcgaagcagaggaagcggcggcgaacgattggtggctggagaatttggagaaggagctgggcctgtggggctacgcggaggaggatactcaggcccaccctgacctactggaccactacacaggtttgagcccactctgcgccctggagggggacccagtctccacctacttccagaccgggcccgccgccgcggaacctgagctcctggtggtcgtcgaaccatctgccgttctgctatgactatgagcaacatgacggacggtcacagcaacgaacatcctggttcttggagatgttcggtggatcaaattcgagtagtttgtttgatgcagtggcagattaatatctctacaggccaattagaatgcacattcagaacagaaccgtccaaagaaagcctgtagagtgaaggctagtactctcttattcttaacagtgtttaacgcagataaaaaaaaaaaaaaaag

SEQ ID NO: 1544 - DNA, 1828 bp, Glycine max
  Predicted polypeptide sequence is orthologous to G1330
tcggccaaaccatatctcaaccaaaactattacctctctctcttttctctctaacaaacactccataaacggaaaagaaaagccacacaacaattaattaagttgttaaatttttgtgagatggagaggagtttatcaggaagtagtgaagaggagatgtcaataacgaaaggtccatggacagaggaagaggattctgttctcttcaattacatcactgtccatggggaaggtcactggaactctgtcgctcgctacacaggtctaaaacgaacaggcaaaagctgcagattaagatggttaaactacttgcgtccaaatgttcgacgtgggaacataaccctcgaagaacagctcttgattcttgacctccattcccgttggggcaacaggtattatcatttatgtttattattcattaaattttttaggttaaaatattccttggttcatgtaatttttcttatttttagtctcttgtacaagaaaattgtaaattttaatcccttcacatgcatccatgtttgctaaagttttggttcgcgtcactactaacatatatggaagactttttaggttttagtagtataaagcagccacaaacactttctccaattaatataagccgctaaaaaaatgttgtacatacattaaaactgaaaaatgtttgagaaacactcaatataccatcatatacttaatgagaaaaatatagataggaggtaaataaaatctgattaataattatttttatcaagaagcaaactcaaatattattcaaatgattcaaccttaatttcaacagcacatgaattacttatgctgaatcccctaattaggtggtgatttcctgcacagaactgaaacttaagatgaagcaagcaaatagcagtttgaccaatttttaatctgttagtgatagaacttggtaattgaagtgatgttgtgttatttgttttataaaatgaaggtggtcgaaaatagctgaacatttaccaggaagaactgacaacgagataaagaactattggagaacgagagtggtaaagcaggctaagcaactaaagtgtgaggtgaacagcaagcaattcagggacacgttgcgttttgtgtggatgccacgtatgttagagcggatccaagctcaggcctcatcatcatcatcatcatcatcaggccaagcccaccaaaccacgttaatctccaacgctcaagcacacagtgacccttgcggagtcatgacgaccaacccaagtttgttgtcggaggtgtcatcatcagcccttgatgcccacgcgccttctctctatgactctagtgcgtcttacaatctaatgggtggtggtagttcctcatcgtatagtgcagaatattgctactactcggacatagcaggaaatggttttggtggttcggacttgtggacggatgaaaatatttgctttctgcaacagctgctcgctgatcatgacttgtcgtgaaacatgcatctttgttttaaacttaggtgaaattaatttgcatctatcaagtatcaacgtaactattattatgtatacttcaattaatttcaagagaactgctatttgttgtaaatttaatttagcctgatttctaagagataatgatgagtattttaatttcccagaagacgattttgttcacaacaaatagaattaataatagagtaataaaatgtgattcgaaaaaatcatacaaatgcatgagtgtaagtttttgacagaaataacatgtgatgagttgtatttggctggaaaaaaaaaaaaaaaaaaaaaaaaaaaaaaaaaaaaaaaaaaaaaaaaaaaaa

SEQ ID NO: 1545 - DNA, 922 bp, Glycine max
  Predicted polypeptide sequence is orthologous to G1330
aattcggctctacctctctctgacacaagaattaagttgtgagatggagagaagtagtgaagaggagatgttaataacgaaaggtccatggacagagcaagaggattctcttctcttcaattacatcactgtccacggcgaaggtcactggaactctgtcgctcgctacacaggtctaaaacgaacgggcaaaagctgcagattaagatggttgaactacttgcgtccaaatgttcgacgtgggaacataaccctccaagaacagctcttgattcttgacctccattcccgttggggcaacaggtggtcgaaaatagctgaacatttaccgggaagaacagacaacgagataaagaattattggagaacgagagtggtaaagcaggctaagcaactaaaatgtgatgtgaacagcaagcaattcagggacacgttgcgttttgtgtggatgccacgtatgctagagcggattcgggctcaggcctcatcatcggcccaagcccaccaaagcagcttaatctccaacagtaacactcaagcacacagtggattgttgtcatcagcgcttcatgcccacgcgccttctctctctgactcgagcgcgtcgtacaatcttatgggtgctgatgctggaagttgctcatctcatagctactactcagacatagcaggcaatggttttggtggtgcggacttgtggacggatcaaaacatttgctttctgcaacaccagcttgctcatcatgacttgttctgatcatgcatacttcaacatcttgctccaaaattcactctaaactgcaacatataaagcaattgtaacactagtcgtgaaacatgcatgtttctttttatgttaatttggtgtgaaatttaataatctatacttcaattaatttcaagagaactgccatttgttgtt

SEQ ID NO: 1546 - DNA, 1316 bp, Glycine max
  Predicted polypeptide sequence is orthologous to G1330
ccacgcgtccgcccacgcgtccggttctgcaagactgtatctattggggaatctttcgcagcctcccactaaatcttttgaaaaaatattgaatcctcaaagtgccgatcctcctaaatccaatgtttgctctttttagcccttctctccctatatattttttcacaagcacctctttcaattctctccgtttcactagctcttattccaaagcaaaggaagaagaaagggcaaattagtataatatggagaccatgaatgttcaggtgatgagaagcttatcagatatggtaattaaaaaaggaccatggactgaggaagaagattctgttctgatcaactatgtcaacgtccacggcgaaggccactggaactccctcgctcgctcttcaggtttaaagcgaacgggcaaaagctgcagactaagatgggtcaactacttgcgcccaaatgttcgacgtgggaacatcacccttcaagaacagctcttgattctcgaactccattcccactggggcaatcggtgggccaaaatagcagaacaactgccagggagaacagacaatgagataaagaactattggaggactcgagtggtgaagcaggctaagcaactcaaatgtcatgtaaacagcaaacagttcagggacgccttgcgtttcgtttggatgccgcgccttatggagcagattcaggcttcttcttcttcctatggccttgatcaaaccacgttgtgcaacactcaaacccacagagacaactcaatggtttcatcgtactcatcagaggttgatcttcagcctccttctctttctgatacaagtataacttcatcatcttacaatttaattggtgatggaggcctgtcaacggaaagtgcagaaaaggggtccatatactctctttggcagcattgggactactctgacatacaagcatttgagccatgcaatggttttggtgatgcagacttgtggaccgatgaaaacatgtggttcttgcagcagcatcttgctgatgaattatgatccagttttgcaatttacactaggctttgcaattaacaagttcaacgatatatcgctaattaaactactgaatgtcattatttgagtgatgattgattgtttgtaattgtcctacatgatacattaattttcttatgaaataagatacttgtagttgaatagtacatttctctaagaacatgtaggaactcaatttaagttgaccctctgtttagtgtccgttattgttatatacaatataagaacattcattaaaaaaaaaaaaaaaaaaaaaaaaaaaaaaaaaag

SEQ ID NO: 1547 - DNA, 1513 bp, Glycine max
  Predicted polypeptide sequence is orthologous to G1330
cccacgcgtccgtccacgcgtccgcccacgcgtccgccctcccgcccgccctctcattctctttccctcttcaactcaaccacacacttcttagatcaaaagctatctttgttgctttgagtttgaaccttgaatctatcaatcaatcaaagtgggtggtgactcatggaagtgaaaggaataagggcaagcaactccaccaccaccaccaccacaatccaaagtgaggatgagatggaccttcgaagaggtccttggaccgtcgatgaggaccttgctctcatcaattacattgccaatcacggtgaaggtcgatggaactctcttgctcgttcagctggactcaaacgaactggcaagagctgcagattgagatggttgaattatttgcgtcctgatgttcgacgtggaaacatcacacttgaagaacagcttcttattcttgaactccacggtcgctggggaaaccgttggtctaaaattgctcaatatttgccgggaagaaccgataatgagattaaaaactattggagaacccgtgtccaaaagcatgccaagcaactcaaatgtgacgtgaatagcaagcaattcaaggatgccatgcgctatctttggatgccgaggctggtggagcgcattcaagccgccgcggctgccaccaccaccgtggcggctgcgggttctccaacggcatctgccagtgctaccacaaccatcaccaccaacaacaacaccaccacatacaactactacgacaacaacaaccttaacaacagttttgaggtgcacagtgggaacatgatggtgagaaatccaacaatcatgaacaacaataacttttgtggttcacatagttacactcccgagaatagtagcacgggtgcatcatcggattcgtttggtacacaggtttcacctgtctcggacttgactcaggattattacaataatgtcacggctgggaataataacaacaataaccctaatcctgatcagtattaccaacaagcacatgatcaactgagtttcttagactgcatcacaagcccatcagggttgttcgatttccaacccatggaaccaaacaccccgtggattaatctgagtaatgttggggacacgtccaacggtttctggaatgttgaaaacatgttgctctttcaacaattctctgacaacaacatgtgaaacattcgtaggagaattcatggtgaaaaccgtgacgaaggggggaaatattgttaaatttacagatgataaagttatataagtagaaaattgagcaaatagaataaattcatatgtaggacacacgtaggatccacgacatggacatagattttaagctaaggatattataagagcaaagagaaggaaactgtgaattactttttttaagtttaatttgtacggacttttttttgttctttgattttccttattttaaagggggtgtgggaaatatttgtaatttgagctttctcagtataagatttcattctttgaaattatt

SEQ ID NO: 1548 - DNA, 1514 bp, Glycine max
  Predicted polypeptide sequence is orthologous to G1330
attcggctcgagatccaacgctctttctccctatcccaacaatctcactcatacctcttcaatctaacaaacttaatttcttttgttttgagtttcttagagaatggatgaaaaaggagcaagaagtagcaacacccttttaagttgtgaggacgagatggaccttcgaagaggcccttggaccgtcgatgaagacctcactcttatcaattacattgccactcatggcgaaggtcgctggaacacgctcgccctctctgctgggctgaaacgaacggggaagagttgcagattgaggtggctgaattatctgcgtcctgatgttcgacgtggaaacatcacgcttgaagaacaacttttgattctggagctccattctcgctggggaaaccgttggtcgaaaattgctcaatatttgcctggtagaaccgacaacgagataaagaactattggagaacccgtgtccaaaagcatgccaagcaactcaaatgcgacgtgaatagcaagcaattcaaggacaccatgcgttacatttggatgccaaggctcgtggaacgcattcaagccaccgctgccgcctccgccaccacaaccgttaccgctaccaccgcgaccaacaatgcatacacctacggaagcaaccttaataacaacaaattcgaggttcacgatcacaagggcaaaatggggttaaccgatccttcagttatgaacaatgacttagtgggttcacatgtcacgcaaagttacacccctgagaatagtagcaccggtgcgtcatcatcagactcgtttgggactcaagtctcagcaatttctgatttgactgaatattacactgtcactgttagtggtaacaataacaatactaattctgcggattattatcaaccctctcaaattagttactcggatagttgcatcacaagcccatctgggttgttccctcaagggctagattttcaatccatggatccaaacaccccgtggaacatgcaaagtggggactcctctgacagtttttggaacgttgaaagcatgttgttcttagagcagcaactcatgaatgacaacatgtgaaaacattgggaataggaaaataagacttagatacggttcttcttagtattgtgttttaattaaagttaaagttaacacaagttattgaagtgaaactttaattttaattgaataataatactgaaaacaagagttgtatttaagttttattcttttatgaattatgaattagattgacagaaggggttgtttgtgaaatatacaggtgaaagtatagaaagtagcaacattaataaatcattcatgtgtagcacacacctagatatttaggatctatgatcaacaaatatctgaaacggtggattattataaggataaagagaaggattttttttttccagcttgtagtttttttaatgattaagtttttattaattttttgtcattacttttaatcgatctctctaaaaaaatttgctcatttttaaaaaaa

SEQ ID NO: 1549 - DNA, 1220 bp, Glycine max
  Predicted polypeptide sequence is orthologous to G1330
ttttcccaccccttaataaatttcccccccggattaataaaccatattatttcaactggtatcaacttttaggcacgtgactagtttagtctctaagatttaatatgtacatgaaagtgaggaaaacaatattcattgaacgcatgctcaactttcagcactgtgcattgcagaatgcgtgacggaagggaattgtattttatttcatttggaggtcataagaaagctgttgcaaaaagcacatattgtcgtcatcccacaaactttccaacaagtcaccgccactcccctgttccaacaacatttggttattgaaacctggccacagatccgaccccctttcaatactatggtcggaattcgaaggaagcagtgatgatgaagcgtgtaacacaagtccactttggtttggctccagtgcttgtgatgtgggctgaagccgctccagcaagcgcggcatccaaacgtaacgcaacgtgtctctgaactgtttgctattcacatcgcactttagctgcttcgcttgttttatcactctggtcctccaatagttctttatttcgttgtctgttcttcctggcagctgttgagcaatctttgaccacctatcgaaaaacattcattcattcatactatgttatatatgtgtacatccacccttataaaacaaattaatatatatatagagagagagagagagtggaatatttttataccatacctgttgccccagcgagagtgaaggtcgagaattaatatttgttcttggagtgtgatatttccacgccgcacgtctgggcgcaagtagtttagccaccttaatctgcaactcttcccactcctccttagacctgtaattgataaatctcataattaacatatataccattattacttggcacatgcagaaattaaattataattaagatgcatgcatgcctgcacatcgtgccacggaattccagtggccttcaccgtgtgtggcgatgtaattgaccagaatggtgtcctcctcaaccgcccatggaccttttctcatgcccatctccttttcgttatgcttctgcaacttcacttgtgcttgtactacagacccacctttcttaacatccatgataagtgttttaatttggaggagaggaagagtggttatatatacaggggattgatggtttcacttccccttctgtcgtcttctcgcagccgtacggacgcgtggg

SEQ ID NO: 1550 - DNA, 1009 bp, Glycine max
  Predicted polypeptide sequence is orthologous to G1330
aatcaatatgtagtggagggagtaattcttatgataactacataaacaaaggcatagactatttttttcaattaagattaataaaccatattatttcaactggtatcaacttttaggcacgtgactagtttagtctctaagatttaatatgtacatgaaagtgaggaaaacaatattcattgaacgcatgctcaactttcagcactgtgcattgcagaatgcgtgacggaagggaattgtattttatttcatttggaggtcataagaaagctgttgcaaaaagcacatattgtcgtcatcccacaaactttccaacaagtcaccgccactcccctgttccaacaacatttggttattgaaacctggccacagatccgaccccctttcaatactatggtcggaattcgaaggaagcagtgatgatgaagcgtgtaacacaagtccactttggtttggctccagtgcttgtgatgtgggctgaagccgctccagcaagcgcggcatccaaacgtaacgcaacgtgtctctgaactgtttgctattcacatcgcactttagctgcttcgcttgttttatcactctggtcctccaatagttctttatttcgttgtctgttcttcctggcagctgttgagcaatctttgaccacctgttgccccagcgagagtgaaggtcgagaattaatatttgttcttggagtgtgatatttccacgccgcacgtctgggcgcaagtagtttagccaccttaatctgcaactcttcccactcctccttagacctgcacatcgtgccacggaattccagtggccttcaccgtgtgtggcgatgtaattgaccagaatggtgtcctcctcaaccgcccatggaccttttctcatgcccatctccttttcgttatgcttctgcaacttcacttgtgcttgtactacagacccacctttcttaacatccatgataagtgttttaatttggaggagaggaagagtggttatatatacaggggatcaa

SEQ ID NO: 1551 - DNA, 718 bp, Oryza sativa
  Predicted polypeptide sequence is orthologous to G1330
ccccgggctgcaggaatcggcacgaggcagcacacatccatccatccatccatctatccagagagcacagcaacggctcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcggacgtcaacagccagcagttcaaggacgtcatgcgctacctctggatgccccgcctcgtcgagcggatccaggccgccgccgcccggcagcagcagcagcaggg

SEQ ID NO: 1552 - DNA, 1479 bp, Oryza sativa
  Predicted polypeptide sequence is orthologous to G1330
taacgcaaaagcctagtcgtctcatactcttcttgttcagttcttctcctcccaaatctttctgctataaaaggcattcgggtctctctttctccgaatcccagctgcacccttgcatcttctctcctctctctctctcttcttcttcttcttcttcttcttcttctccatatctcctactcctcctcgtgaagatcgatcgaccatcggcaatttcattcggtaatagttaagctaagatcaaatcaagatcggcgaaacgatggagatggtgctgcagaggacgagccaccacccggtgcccggggagcagcaggaggcggcggcggagctgtcgtcggctgagctccggcgagggccgtggaccgtcgacgaggacctcaccctcatcaattacatctctgatcacggcgagggccgctggaacgcactcgcacgcgccgccggtctgaagaggactgggaagagctgccggctccggtggctgaactatctccggccggatgtgaagcgcggcaacttcaccgcagaggagcagctgctcatcctcgacctccactcccgatggggcaaccggtggtccaagatagcacagcatctgcctgggaggaccgacaacgagatcaagaactactggaggaccagagtgcaaaagcatgccaagcaactcaattgtgatgtcaacagcaagaggttcaaggatgccatgaagtacctatggatgcctcgccttgccgagcgcatccatgccagggctggcgctgttgatgatagcggagactacagcaacaacgacttatcatgtgtatctggtgtaacaatggccactgttgctaattgttttgatggctctccgagcatggtgactagctcatcttccgattcgttcacgtcggagtcacaagatttgaagaagattaacttacatgtgcatggtgatgatgagaagatgaactctgaagactggatgcaggaggtggaccatgagttttggtctacagagattcagcctaataatgaacagtttcaggaccaacagcttaacggttgggtgcaaggtttttctgagggtttgtccgaaactctatggagtctagaggacatatggaagatgcaataaattttacatttacaaaggacatatttgtaaaatagaatagagagacatcaaggaaggcaaagagaaaaagttctttagtcatatactgtacgttgagacacttaagttctttgccaacttcaatgttttttttcttttatttttgctgcctctttcgatccctgaaggggtttttgccttctagatgtctaggggttcaaagaggaccagcggagatatatatgtgtttggatatgttgatatatgagctgatatatgccttactatatatatactccagaattgcactgaggattacatatccaattcagacatgcaaaccttaccagttgcaatattgtaaaaaaaaaaaaaaaaaa

SEQ ID NO: 1553 - DNA, 1310 bp, Oryza sativa
  Predicted polypeptide sequence is orthologous to G1330
  misc_feature (640)..(640): n is a, c, g, or t
cttctctctctctctctctctctacaacttctccgcttagcacagccaagctagagccatctagctacttttgctgctttctctctcctcctgcaacacacgacctagctgagagctgagctgagttgcgccggccatggcagcatcgcagaggagcaggagcacggcggcgcagctcgacgtcgacgaccaggcggcggccgatcagctgatgacgatgatgcggcggccagcggcggtactacaggatgaggccgccgccgaggaggaggcctccgcggcggcagcggacctgcagctggagctccggcgagggccgtggaccgtcgacgaggacctcaccctcgtcaactacatcgccgaccacggcgagggacgctggaactccctcgcccgcgccgccgggttgaagaggacggggaagagctgcaggctgcggtggctgaactacctccggcccgacgtgaagcgcggcaacttcaccgccgacgagcagctgctcatcctcgacctccactcccgatggggcaacccggtggtcaaagatagcgcagcatttgccagggaggaccgacaacgagatcaagaactactggaggacccgagtgcaaaagcatgccaagcagctgaactgcgatgnccaacagtgctaggttcaaggatgctatgagatatctatggatgcctcgcctcgccgatgcaagccagcttcgggtgatcaccatgggtataatagtaccactgccatgggcgatgctcatgggatgccagtgatgacatcgtcgtcgtcggactcgttcgcgacatcagagtcatacgatgggggcctttatgcaaatgggcaggccaatgagatggtgaagggtggggactactggatgcagggagcaaataaagggttttgtagtaattatgagtcagagcaacttcatcctcatgagcatagccagtttcaggatccagatcttgttggttgggttcagggcttttctgagggcatttccgagaatttttggagcttggaggacatttggaagatgtagtgaattttgcattaatttgtattgtggctatatatacacatacgtacaggagtatacattttataatattgattgataactcgtggaacaaagattagagtcagcttattctaacttcaaaagttactacgagagaaaaaaagtaaatttcttctttgattttcctttttttttgtatggatgtcgattgacacatatgtatatgttgtcccacccatgtaaaacatataagaagacgtgattgtttctacaacttttgggcaaaaa

SEQ ID NO: 1554 - DNA, 325 bp, Oryza sativa
  Predicted polypeptide sequence is orthologous to G1330
ctacatgtgaatattttgatgtgacgtgaagagaaaaattaatcttggtttttggttgttgtcatgcacggctgaaacgcacaggcaagagctgccggctccagcggctgaactacctccgccccgacctacggcgaggcaacatcacgccgcaggagcagctgctcatcctggagctgcactcgcggtggggaaaccgatggtccaagaacgcgcagcacctcccggaacgcaccgacaaccagatcaagaactactggcgcacgcgggtgcagaagcacgccaagctgctcaagtgcgactccaacagccagcagttcaagga

SEQ ID NO: 1555 - DNA, 1507 bp, Zea mays
  Predicted polypeptide sequence is orthologous to G1330
gatcatcggctatacctaccagctcgctgttcttgctgaagccctggagctatatagcttcgatctgcgcagcacaggttgtctgtcgactagtgattagtgaagaagatggcggcgcgtgaccaccgagagctgagcggcgacgaggactccgtggtggcggccggagacctccgccgcgggccgtggacggtggaggaggacatgctcctcgtcaactacgtcgccgcgcacggcgagggccgctggaacgcgctggcacgatgcgcagggctccggcggacggggaagagctgccgcctgcggtggctcaactacctgcggccggacctgcggcggggcaacatcacggcgcaggagcagctgctcatcctggagctgcactcccgctggggcaaccgctggtccaagatcgcgcagcacctcccagggcgcaccgacaacgagatcaagaactactggcgcacgcgggtgcagaagcacgccaggcagctcaactgcgacgtcaacagccagcgcttcaaggacctcatgcgctacatctggatgccgcgcctcctcgagcgcatcggctccgacgactccggggacggcgccttcgttatcgacgccgccacgccgacgccaacgccgacgctcctcacggccgccacgtggtgcgtggacgacgtcgagctgtcctgcaccaccgccgtgtcgtcgtcgtcgtccgtgtccacggacagcatgcaccagcagcagcagcagctcgtcgccgtgtccccgccgccacagcccgccgccttcggcgagagcaacaacgacgcctcccactacggtgtccacaacagcaacgctgccatgtccatgtggggggacacgctgtgccaaccaccgcactcggcgacgccgcacctggcgggcgccgggacctgtagctggtccgacgagtctctgctggtacctgatgccggcctctccggcggtggcggcgtgtacgccgacatggggcttccggacctctgcgacaccgacaccatgtgggccgccggcgccagcgccgacgacgacctgtggtacacgcagataatggggctgtgaaattaaagcaagtccgccggcggccggttggatttggcctcatggatttctagctagcccggtggaggcggcgggcagcgagttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagtaaaagaaaaaggggggggcccttttaaaggaaccaaatttacttccccggggggggagaagaaaagtttttttatgagggaacctaaattaaattcaatggccggggttttaaaaacatttgaattggaaaaaccctggggttaccaaattaaatcggtttggaaaaaaatcccttttttcaagttggggtaaaaagaaaaaggcccccccccatcgccttttcaaaaagaggggg

SEQ ID NO: 1556 - DNA, 691 bp, Zea mays
  Predicted polypeptide sequence is orthologous to G1330
aagtgtcttcccagttaactccgttgtacgtctctctccctttactagctccgatcttctgctagctcctccgaaccacttgtcgacacgatcgatcgtcgtcgtacgcctgcttggcgtacatactgctactaatggagacggcgctgcagcagagtgctgctactactgctggcggcggcatgaggcccggcgcggcgacgacggtgaagaaggcgaggcaagagctggagcaggagttgcggtttccgcaggcggcgcccgcggatcagggcggccttgacgaggagctccggcgcgggccgtggacggtggacgaggacctcacgctcatcaactacatcgccgactacggcgagggccgctggaacgcgctcgctcgcgccgccgggctgaagcggacggggaagagctgccgcctgcggtggctcaactacctgcggccggacgtgaagcgcggcgacttcaccgccgacgagcagctcctcatcctcgacctccactcccgctggggcaaccggtggtccaagatcgcggcgcacctgccaggccggacggacaacgagatcaagaactactggcggacgcgggtgcagaagcacgccaagcagctcaactgcgacgtgaacagcaagcgcttcaaggacgccatgcgcttcctctggatgccgcgcctggccgagcgcgccgc

SEQ ID NO: 1557 - DNA, 1530 bp, Zea mays
  Predicted polypeptide sequence is orthologous to G1330
cccacgcgtccgcttctctagatctcctcctcctcttcctctctatctctctctctccccaaccaacaacctgtcgattaagctagctctcagctcatcccggcctcagaaccaaccaattcctgttttagacggttaacaacctacaacaacagttagcatggccacaacacagagcaggggcggcggcggtgttgttcccgttgaggtggacgaggagcacggccgccgccggcagggaggagcagcgccgcaggaggaggaggaggaggaggcggccgagaagccggagctccggcgtggcccgtggaccgtggacgaggaccacaccctcgtcaactacatcgccgacaacggcgagggccgctggaactccctcgcccgcgccgccggtctgaagcgcacgggcaagagctgccggttgcggtggctcaactacctccggcccgacgtgaagcgcggcaacttcaccgccgacgagcagctgctcatcctcgacctccacacccgctggggcaaccggtggtcgaagatagcgcagcacctgccggggaggacggacaacgagatcaagaactactggaggacgcgggtgcagaagcacgccaagcagctcaactgcgacgccagcagcaagcgcttcaaggacgccatgcgctacctctggatgccgcacctcgtcgacgccaccgctaccaccgccgacgacgaataccaccaccaccaacaccaacaccaagccgccgcagcaggcaacatcgacggcctgctcgccggcggcgacgtcgaccacgtccagcacgctctggcggcgggcgtggccgctgctatggcgtcgtcgtcgtccgactcgctcgcgtcggagccgtactcgtacgaggacggtggcctcctcgcgagcctgcgcgccggcgacgacatgcagctggtgatgagcggcggcggctgggcggcggcgcaggcgcaggaggccaacgaccaagggctgtggccgtcgtcgtctggtcatggtctgtcgtcgtcggtgcaggccgctgccggtggtgccggccagtttgaggacccggagctcagtggatgggtgcaaggtttctccgacagcattattactggtaacctttgggccttggaggaaatttggaagatgcaatgagcaattttgcgttttccacacgcatccaacgaagagctagcggaaatgtatacgactagtgatgttgacagtagatagaacatgaggttgtcatatataattctcgatctctccctctctctatcgatctatatatactctctctctctctctctctctctatatatatatatatatatatatatatatatatatatatatatatatatatatatatatatatatatatatatactctaactccaaatatactatacggtatactaaagttgtatagcattttcatttttttcctcgtttttttatttcgcctcttaaggttcattcttatagaggttggaaaaggagggtattgtttatgcaagtcgaaacaaaaa

SEQ ID NO: 1558 - DNA, 1447 bp, Zea mays
  Predicted polypeptide sequence is orthologous to G1330
agactaataaattccctcacatgctttactctctcctcgcatcttagcctataaaaggactggggaattccaggccggctgccgataactgatcatcttctctagatcttctcatcataccgataccggcctcaacgccctctttttcccagcctcacaaccaattcctgtttcagtcgatcgcagttagcatggccacgacacagagctgtcagagcaggagcagcgcctgcagcaaggctgctgcttgcttcccggccgccgtagcggtcgacgaggagcacggccaccacagccaccagctgaagggaggagcgcaggaggaggctgagaacgacaataataagccggagctccggcgtggcccctggacggtagacgaggacctcaccctcgtcaactacatcgccgacaacggcgagggtcgctggaacaacctcgcccgcgccgccgggctgaagcggacgggcaagagctgccggctgcggtggctcaactacctccggcccgacgtgaagcgtggcaacttcagcgccgacgagcagctgctcatcctcgacctccacacccgctggggcaaccgatggtcgaagatagcgcagcacctgcctggaaggacggacaacgagatcaagaactactggaggacccgggtgcagaagcacgccaagcagatcaactgcgacgccaacagcaagcgcttcaaggacgccatgcgctacctctggatgccgcacctcgccgacgacgtcgataccatcgctgcggccaacgacgacgacgaagaccaccaccaccacctacgcctcctcgtcctgcaccaccaccaggcccagcacctgcagcaagctgctgccgcggccggcggcgctgccaacgaccttgctgcgggcgcctacgacgtccgccagctgcacgcgctgccctcgtcaggcatggcggcggtgccgacgacggcgacgacgtcgtcgtccgactcgctcgcgtcggagtcgtacgatgacgggggcctgcttttcgcgaacttgcgcgccggcgagatgctgatggacggcggagattgggcggcgcagcaggaggccgaccaagggctgtggccgccgccgccgccgacgtctgatcttgatcagtcggtggtgcaggctgctggtgccggcgctggccagtttcaggacatggagctcagtggttgggtgcaaggcttctccgagagcattacagataacttttgggccttggaggaaatttggaagatgcaatgagcgagcaattttacatcttacacatccatccaaattaaagacaacatagatacacatatacataccatatattctaacaacaggtgccatatacgatatacatacacaagttgttgtatagttgtattccgcttatatatatataatttttgcctctcgatgaagttcattcttatagcggccgg

SEQ ID NO: 1559 - DNA, 752 bp, Zea mays
  Predicted polypeptide sequence is orthologous to G1330
  misc_feature (429)..(429): n is a, c, g, or t
  misc_feature (436)..(436): n is a, c, g, or t
  misc_feature (440)..(440): n is a, c, g, or t
  misc_feature (484)..(484): n is a, c, g, or t
  misc_feature (498)..(498): n is a, c, g, or t
  misc_feature (572)..(572): n is a, c, g, or t
  misc_feature (606)..(606): n is a, c, g, or t
  misc_feature (654)..(654): n is a, c, g, or t
  misc_feature (692)..(692): n is a, c, g, or t
  misc_feature (710)..(710): n is a, c, g, or t
  misc_feature (747)..(747): n is a, c, g, or t
ggcatccgagtcccactagctccggccccgtgtcttcattccccagttaactccgttgtacgtctctctccctttcactagctccgatctccttggatcgatctcctgctatctcctccgatccgatccacttgtcgacacgatcgatcgtcgtcgtacgcctgcttggcctacatacgactgctactaatggagacggcgctgcagcagagtgctgctgctactgctggcggcggcatgaggccggccggcgcggcgacgacggggaagaaggcgaggcaggagctggagctggagcaggagcgggagttgcggtttccgcaggcggcggcggccgcggatcagggcggccttgacgaggagctccggcgcgggccgtggacggtggacgaggacctcacgctcatcaactacatcgccgaccacggnaggggcngctnggaacgcgctcgctcgcgccgccgggctgatgcggacggggaanaactgccgtctgcngtggctgaactacttgcggccggacgtgaagcgcggcgacttcaccgccgacgagcagctcctcatcctcgacntccactcccgctggggcaaccgatggtccaagancgcggcgcactttccaggcaggacggacaacgagatcaagaactactngcggacgcgggttcagaacacgccaagcagctcaactnccacgtgaacagcaagcncttcaaggacgcatgcgcttcctctggatgccacgcntagcg

SEQ ID NO: 1560 - DNA, 1667 bp, Zea mays
  Predicted polypeptide sequence is orthologous to G1330
  misc_feature (14)..(14): n is a, c, g, or t
gagctcggccgggnacctcatctcacccttcttcctctgccttcctggcttgccttctcttctcccgccttctcctcctcccagcacagcagcagctgtgaccacatcaccacacacacacacatatatacttggtcatcatccagcttccagcagccagctgcccgccgatcaacgtgtaggcggttcaaagggaaatctgctgatggacatggcgcacgagagatcagacgccagcagcgaggaggaggtgatggccggcgagctgcggcgcgggccttggacggtggaggaggacctccagctggtcaactacgtcgacgcgcacggcgagggccgctggaactcgctcgcccgatcagcaggtctgaagcgcactggcaagagctgccgcctccggtggctgaactacctccgccccgacctccggcgcggcaacatcacgccgcaggagcagctgctgatcctggagctgcactcgcgctggggcaaccgctggtccaagatcgcgcagcacctccccgggcgcaccgacaacgagatcaagaactactggcgcacgcgcgtgcagaagcacgccaagcagctcaagtgcgacgtcaacagccagcagttcaaggacgtcatgcgctacctctggatgccccgcctcgtcgagcgcatccaggccgccgccgccgccggcgccccccagcagcacaaggccggcgccgcggacacgccgctctcgtcgccgtcgtcgtggcagcccggcggtggcggcggcctctacgcgtcgccggacctccccgccacggacgcctgctgctggcctcccgcagactgctacccagccgccgccgccgccgtcggtgacggtgaccatcatcatcagctactgatgaacaaccccgccgccgtgccggagctgtcggcgagcactaccacggccgggtcggcctccccgtcatcggattccggcgcgggcgcacagccctgctggcttgcgccggtgggtggcgcggagtggttcaccaccacctgcgacgccaccagcagcaccgccgccgtcctcctggccgggcaccagcaccagcagcagcaacaatggtcgtgcctgctcggggaggcgacgtgggcgtcgtcatccgagctccctgatctgggctgcgtcgcggacttcgagatcggcagcttcgacgtggagagcatctggagcacggacgacagcttgtggttcacgcaggcgcagggcgtgtgaattgaacccacacgcgcggcgacatggaaatccacgaccacggcgtcaaattaaaccggtggtggatcggacaccccgcacgtcggggacgcctagcgaaggtgccgagagagctagctgagacacgggttagaagaaggagagagattatttggaggaaccgaagacgacgcgggacggctactctttgctcggttcaagatgcttgctgttcttgcctccaggacttttcttccgctccagttctactccgtttcctagtcttgattccctagcggcttgtgtagggtatatacgccaagaaaattccagaaaaaagggggaaaacgtagctgttgtagtagtacatatatactagtagcgtcaagtgtttgtacgtagctgttgagtaattaagcgcaatacatatgaacaagtgaagttactg

SEQ ID NO: 1561 - DNA, 851 bp, Zea mays
  Predicted polypeptide sequence is orthologous to G1330
  misc_feature (802)..(802): n is a, c, g, or t
acctcatctcactcttcttcctcttccttcctggcctgccttctcttctcccgccttctcctcctcccagcacagcagcagctgtgaccacatcaccacacacacacacatatatacttggtcatcatccagcttccagcagccagctgcccgccgatcaacgtgtaggcggttcaaagggaaatctgctgatggacatggcgcacgagagatcagacgccagcagcgaggaggaggtgatggccggcgagctgcggcgcgggccttggacggtggaggaggacctccagctggtcaactacgtcgacgcgcacggcgagggccgctggaactcgctcgcccgatcagcaggtctgaagcgcactggcaagagctgccgcctccggtggctgaactacctccggcccgacctccggcgcggcaacatcacgccgcaggagcagctgctgatcctggagctgcactcgcgctggggcaaccgctggtccaagatcgcgcagcacctccccgggcgcaccgacaacgagatcaagaactactggcgcacgcgcgtgcagaagcacgccaagcagctcaagtgcgacgtcaacagccagcagttcaaggacgtgatgcgctacctctggatgccccgcctcgtcgagcgcatccaggccgccgcagccaacaataacgccagcgggcgccggggttccgccagctggcgccgccgcggacgacacgccgctctcgtcgtcgtggcagcacggcggcggcgccgacgacgacggcgccctctacgcgtcgccggagctgcccacgnacgcctgctgggctcccgcagactgctactactacccagccgccgctga

SEQ ID NO: 1562 - DNA, 635 bp, Lycopersicon esculentum
  Predicted polypeptide sequence is orthologous to G1330
gaaaattgaagttgtatcgggacgaggacgagaaggaggacgaggagatagtgaggaagaaattaaggaggaagaaattgttatggatcttcgaaggggtccatggaccgttgaagaagactttacacttatcaattttattgcacatcatggtgaaggtcgttggaattctcttgcacgttgtgctggtttgaagagaacagggaaaagttgtagattacgatggcttaattatcttcgaccagatgttcgacgtggtaatattactgttgaagaacaactcttgattcttgaattgcattctcgatggggcaatcgttggtctaaaatcgctcaacatctccctggaagaacagacaatgagataaaaaattactggcgaactcgggtacaaaagcatgcaaaacaactcaaatgtgacgtgaatagtaagcaattcaaagataccatgaagtatctttggatgcctaggttagccgaaagaatacaagccgccgcggctacttccaacccaacggcggcttcttcctccggccccaccaccacatacattcaaagtcaagagattcaacatccactaccaaacatgaaccatcatgtacccgaatacttacctatccaactgatgaatatcg

SEQ ID NO: 1563 - protein, 298 aa, Oryza sativa
  Orthologous to G1330
MAREVSSEEEAGGGDELRRGPWTVEEDLLLVNYIAAHGEGRWNALARCAGLKRTGKSCRLRWLNYLRPDVRRGNMTAEEQLLILELHGRWGNRWSKIAQHLPGRTDNEIKNYWRTRVQKHAKHLNCDVNSQQFKDLMRYLWMPRLLERIHRSSQSQSHDADDADLSVSAATSCITSDLVVDAHHPPLAMADSNDSAAMWQQHQAPQMSVAGAPPPTTTMAQHVVLPTAAASCHQMQDQFVCARAAETTTCCWSESESLPGLAGLYYDDAAAALPEFDVETMAMWGPEDDPWYTQMLGL

SEQ ID NO: 1564 - protein, 180 aa, Oryza sativa
  Orthologous to G1330
MEMMRMAMSPAMSSATAAAASEDEGDLRRGPWTVEEDMLLVDYIANHGEGRWNSLARCAGLRRTGKSCRLRWLNYLRPDVRRGNITADEQLLILDLHSRWGNRWSKIAQYLPGRTDNEIKNYWRTRVQKHAKQLRCDVNSKEFRDVVRHVWMPRLIERIQADAAAAGEVSAPAPVSAAAT

SEQ ID NO: 1565 - protein, 293 aa, Oryza sativa
  Orthologous to G1330
MDAPCGWTTSAAAAVAEEEDVRRGPWTVEEDAVLAGYVAANGEGRWNELARAAGLRRTGKSCRLRWLNYLRPDVRRGDFTPQEQLLILELHFRWGNRWSRIAQHMPGRTDNEIKNYWRTRVQKHAKQLGCDVNSRQFKDVMRHLWMPRLVERIHAAAASSERAAPPPCAAAPASHSGMCHSPDPSTTTSSMAGSSVTHGEQFPSSTNHHLMTMASVTTAAADWSSEQCGSGSATSTSVGISYDMFEGSWSELLARAYDDDGADSSLLPDFQMADTGDNCWWSNLEDIWSQQPY

SEQ ID NO: 1566 - protein, 329 aa, Oryza sativa
  Orthologous to G1330
MDMAHERDASSEEEVMGGDLRRGPWTVEEDLLLVNYIAAHGEGRWNSLARSAGLKRTGKSCRLRWLNYLRPDLRRGNITPQEQLLILELHSRWGNRWSKIAQHLPGRTDNEIKNYWRTRVQKHAKQLKCDVNSQQFKDVMRYLWMPRLVERIQAAAAGQQQQQEGGTDTPPLSWQHGGSDGLYESPELPAPDASCWPAEYCAAAGGAQSGGTPAPELSSTTAGSSSLSTDSGAGAQPSWPTQADGAEWFTTACDASSATGGVAMRDTELELAQPPCQGGQTWTTSESSLPGLTFPDLAVADFEIGGFDVDSFWTSMEDDQLWCPTQAAV

SEQ ID NO: 1567 - DNA, 1045 bp, Glycine max
  Predicted polypeptide sequence is orthologous to G1331
  misc_feature (1042)..(1042): n is a, c, g, or t
  misc_feature (1044)..(1044): n is a, c, g, or t
cggcattcggctcgagggaagacaaagtttacctaagagccaactttatcactatattgtatgtattacgaagatatggcgggaaacgtggggtggggtgtgatagaagaggagggatggaggaagggaccttggacttctgaggaggacagattgctcattctgtatgtcaagttcccatggtgagggcagatggaactctgctgctaggcttgcaggactgaaaagaaatggcaagagctgcaaattgagatgggtgaattacctgaggccacacctcaagaagggtcaaattacacattcggctcgaggcataattcaagagctgcatgctaggtggggaaacaggtggtcaacaattgcaagaagcttgccaggaagaactgacaatgagataaagaattattggaggactcacttcaagaaaaagatgaaaactccatctgatgctgctgagaaggcgagaatccactcctcgaggagacagcattttcagcagcaacaacagcagttgaagcagcagcagcaacaattccaattcaacttggacatgaaagggatcataaacttgcttgaggaaaatgaccatagagtgccttctatatctcaagaggcacaagaaatggccagcatgtacccaaacacttcagaacaccagggctacttctactcaatattcaatgtcaatgacaatgacaataatgtctctgcacctgagtcctcaaatgaagaaattctatgggatggactgtggaacttggacgatgttctttgcaatttcaatgcagctagtgccacaagcaaagccagtttacacaatttagtttctcctttctgttaaaaggttttatttagccttgaaaacagttaggaagaatagtagtgtactaatgtcagtcacggcttgataaggctccaaaatcctgcagcttagagttaggattaattgtttcttaaaagtgtggagtctgggtagtaagtaatttctgaaggcgagttattgtgtaaccctttaataaagtatctcaattttgcttataanana

SEQ ID NO: 1568 - DNA, 1109 bp, Glycine max
  Predicted polypeptide sequence is orthologous to G1331
ggaagacaaagtttacctaattaagagccaaacttaaaaactttttgtatgtattgggaagttatggcaggaaacatggggtggagtgtgataatagaagaggagggatggaggaagggaccttggacttctgaggaggacagattgctcattcagtatgtcaagttccatggtgaaggcagatggaactctgttgctaggcttgcaggactgaaaagaaatgggaaaagctgcagattgagatgggtgaattacctgaggccagacctcaagaagggtcacataacaccacaagaagaaagcataattcaagagctgcatgctaggtggggaaacaggtggtcaacaattgcaagaagcttgccaggaagaactgataatgagataaagaactattggaggactcacttcaagaaaaagactaaaaccccctctgatgctgctgagaaggcgagaatccgttcctcgaggaggcaacaatttcaacagcaccagcagcagttgaagcagcagcaggttcagcagcagcaacaacaacaccaacaattccaattcaacttggacatgaaaggggatcataaaccttgcttgaggaaaaataaccatagaagtgcccttctatatctcaagaggcacaaagaaatggccagcatgtaccctaacacttcagaacatcaggactacttctactctatgttcaatgtcaatgacaataatgtctctgcacctgagtgcttaaacgaagaaattttgtgggatggactgtggaacttggacgatgttctttgcaatttcaatgcagctagtgccacaagcaaagctagtttacataatttagttgctcctttctgttaaaggttttatttagccttcaaaattgttaggaagaatattagtactaatgtgagtcacggcttgataaagctccaaaatcttggagcttagagaaaaaaaatatcattaaatgttccttgttagtttttgttagtgagaaatttaaactcacaacctctccgctcctccttgaagcttagagttagggtagtgaatgatattctgaaggcgtgttattgtgtaacccattaataaagtgtctcgattttgcttat

SEQ ID NO: 1569 - DNA, 758 bp, Oryza sativa
  Predicted polypeptide sequence is orthologous to G1331
ggaaagaaaggtttgtttgcttcgcggccatagatagctatagctgctatcttaatctagctcgcctttaatttggcccccggcctctctctctctgcctgtgtcctaccagctgcacaaaaatctcccagaaaacaggcagaggggagagagacagatacgcatcaattaagctcattttcttcgatctgctggtgaaagaagaactgaagaagagaggtagctggactgaagaggccggcaatggcggcggcggaagtgcagtcggctgccgggtgggggaggcagctgcagcaggacggcggcgggtggaggaaagggccgtggacgagccaggaggacgcgctgctcgtcgagcatgtcaggcagcacggcgaaggccggtggaattctgtctccaagcttacaggtctgaagagaagcggcaagagctgcaggctacgatgggttaactacctgaggcctgatctgaagagaggcaagatcactccccaggaggagagcatcatcgtccagctccatgccttgtggggcaacaggtggtcgacgatcgcgcgtagcctcccgggcaggacggacaacgagatcaagaactactggaggacgcacttcaagaagggcaagccgtccaagaacatcgagcgcgccagggccaggttcctgaagcagcgccgcgagatgcagcagagccagcagctgcagcagccgacgctaatgccgacgccgacgccgcagagcaggacatcatcgttgccgag

SEQ ID NO: 1570 - DNA, 634 bp, Zea mays
  Predicted polypeptide sequence is orthologous to G1331
  misc_feature (574)..(574): n is a, c, g, or t
  misc_feature (587)..(587): n is a, c, g, or t
  misc_feature (590)..(590): n is a, c, g, or t
ggacggcgcaggaagacaagctgctggtcgagtatgtcaggcatcatggagaagggaggtggaattctgtcgccaagttaactggtctgaagcgaagcggcaagagctgccggctccggtgggtgaactacctgaggcccgacctgaagcgaggcaagatcacgccgcaggaggagagcgtcatactccagctccacgccctgtgggggaacagatggtcgacgatcgcgcgcagcctgccggggcggacggacaacgagatcaagaactactggcggacgcacttcaagaaggccaagccgtccaagaacgtcgagcgcgccagggcgcggttcctcaagcagcgacgcgagatgcagagccagctgctgctgctgcaggggcaagatcagcatcggcaggaggaggaacagcccgatcatgacgacgacggcgccagtgaggcaacgccgggtgttccactggaggaggaggaggagcagcagcagcagcagcatgaggacctgcggatgatgctgcagcaggacatggacgacctgctgttccagttctgcccgatggcctcctgcacttnctcctcctgcctnctncccggcggcggcagctgcgccttcgtcgtcagcgcgtcggcgag

SEQ ID NO: 1571 - DNA, 789 bp, Zea mays
  Predicted polypeptide sequence is orthologous to G1331
gcccagcgttccatactcctggagatagaaaatatatagacagagctcgttactagtcgtagctagccagggctagctgtagctgaagtcatcatcagataaatatattcatcagcctgtaattaatagctagttttcagtggattagctagcttggcaatatatatttaactaataaggcggcggtggcatggacgcgatcagcagcctgctgctgcaggagggctggaggaagggcccgtggacggcgctggaggacaggctgctcaccgagtacgtgcagcagcacggcgagggcagctggaactccgtcgccaagctcacagggctgcgccggagcgggaagagctgccggctgcggtgggtgaactacctccggccggacctcaagcggggcaagatcacccccgacgaggagaccgtcatcctccacctgcacgccatgctcggcaacaggtggtcggcgatcgcgcggtgccttgccggggaggacggacaacgagatcaagaactactggcggacgcacttcaagaaggcccggccgacgcggcgcgcccgggcgcagctgctgcaccagtaccagctgcagcagcaggagcagcgccgccagtacctgcagctcctgcagccgcagcagctgcagcagcagcagctgggggtggtgaaacaacagcagctggagcagcagagcccgccggagcctcatcaccaggccatgatggacagcctgcaaagcacggcggcgtgctactgcagcccggtgccggaggaatgctgcccgctcccgg

SEQ ID NO: 1572 - protein, 289 aa, Oryza sativa
  Orthologous to G1331
MEGQQFAWGREEGGWRKGPWTAQEDKLLVEYVRQHGEGRWNSVAKITGLKRSGKSCRLRWVNYLRPDLKRGKITPQEESVILELHALWGNRWSTIARSLPGRTDNEIKNYWRTHFKKGKPSKNIERARARFLKQRREMQQQSQLMQTGQQQQLGQDDDATSAVVDDNLAEVAPPAATSLTHDGELQIMQEMAPDMDDLLYYHPGDMSPYSYDDLLGSGGGECGAVAASAGAAASTSEGSSEELDGGAATWGSLWNLDDVVHDMMIDCAAGAGCCWGSFPPLQDKGLAFY

SEQ ID NO: 1573 - DNA, 782 bp, Glycine max
  Predicted polypeptide sequence is orthologous to G1363
  misc_feature (28)..(29): n is a, c, g, or t
  misc_feature (38)..(39): n is a, c, g, or t
  misc_feature (56)..(57): n is a, c, g, or t
  misc_feature (771)..(772): n is a, c, g, or t
gtacgacctcgcaggtatccggtccggnnaattcccgnnggtcgacccccacgcgnntccggaaaaattagagagtgagaagaggaagaagaacattctagagggagaaacattacacaactgaacccacaattctattactgtttgcttcaaaggatataattgaaggttttgagaactaaggctgcaatactgtatacattctactcaaggaatggtcaatatctggaaatttgctatgtggaaaggttaaatgaagccattcttgtcgaatcatactgattctatgtacaattgttcccaagttggttgtagtcatccaatgaatcaacaaatggtgccccagatgctgggattagcatccaccagaattgcattaccagttgatcttgcagaagatgggcccatttatgtcaatgccaaacaataccatggtatactgagaaggcgacagtcacgagcaaagcttgaagctcaaaacaaactcatcaaaagtcgtaagccatatcttcacgagtctcggcaccgccacgcattgaacaggggtaggggatctgggggacgctttcttagcgccaaacagctgccacagtctaatgcagaactagtcactgatgcctatcaaaagaaagatgcatcagaggcagaaaatcatccctcaagcaccggtgaaaatgcatctatcacattcacagccatctctgccttaactagtatgtccagtaacagtgtcaatttccccaacatggctggatcatcgcaatgcagtgnnggactcacct

SEQ ID NO: 1574 - DNA, 378 bp, Oryza sativa
  Predicted polypeptide sequence is orthologous to G1363
ggctttgcacttgcagaggagagaagcaaggtgagaagtgaggaggcagcaagggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtaatcttgatggttacacgaagagtgatgaagggcatatcatatccatatgcttgattcgttctatggtggtgctgtagcgacttatggcacacatgctattatgcatccccagattgtgggcgtgatgtcatcctccc

SEQ ID NO: 1575 - DNA, 1209 bp, Oryza sativa
  Predicted polypeptide sequence is orthologous to G1363
  misc_feature (1082)..(1082): n is a, c, g, or t
gaactaggcaccccccgggcgcggctttgcactcgcggaggagagaagcaaggtgagaagtgaggaggcagcaagggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtaatcttgatggttacacgaagagtgatgaaggtaagatgatgtcagctttatctctgggcaaatcagaaactgtgtatgcacattcggaacctgaccgtagccaaccctttggcatatcatatccatatgctgattcgttctatggtggtgctgtagcgacttatggcacacatgctattatgcatccccagattgtgggcgtgatgtcatcctcccgagtcccgctaccaatagaaccagccaccgaagagcctatttatgtaaatgcaaagcaataccatgcgattctccgaaggagacagctccgtgcaaagttagaggctgaaaacaagctggtgaaaaaccgcaagccgtacctccatgaatcccggcatcaacacgcgatgaaaagagctcggggaacaggggggagattcctcaacacaaagcagcagcctgaagcttcagatggtggcaccccaaggctcgtctctgcaaacggcgttgtgttctcaaagcacgagcacagcttgtcgtccagtgatctccatcatcgtcgtgcgaaagagggcgcttgagatcctcgccgtttctgtcatggcaaatcatccttggcttatgtgtggtgcccagcaaaaaaaaatctgactgaacctgtgtgtaaactgatgggtatgggtgggttttgtgcaactgttacttgggtgcttgacatctgtgtctgtggttcctctgcctccttagtttggagacggtgcagctgcagctggtaccagtaatctgatcatgctagacttgtgacaaggacaaaactagcaccccgttatgtttcctggcttntgaatttggtggtcattcagtaagcaagcactcgacgtcagcgggagggggttgcttcgattgatctagttctttcgcgataaacttatttaattttgaacaaaaaaaaaaaaaaaaaaaaaaaaaa

SEQ ID NO: 1576 - DNA, 503 bp, Oryza sativa
  Predicted polypeptide sequence is orthologous to G1363
  misc_feature (68)..(68): n is a, c, g, or t
gcacaggcttgcatttcatacccatacaacgattctggttcaggagtttgggcatcctacaggtggangctcggtgttccatcctcaaattgtgggaggaggcacatcgccaagagttcccttgccctccctggagatagcagatgatgggcccatatatgtcaatcccaaacaatatcatggaattcttcgcagaaggcaactgcgtgctagggtagaggcccagaataagctcgtcaaaacccgaaagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctg

SEQ ID NO: 1577 - DNA, 682 bp, Oryza sativa
  Predicted polypeptide sequence is orthologous to G1363
ctgcaggaattcggcacgaggcgaagagccgaagaggggaggcgaggatcagaggaggcagcctcatcgtcatgcttcagcactagtagtagtagtgccaccatttctttgccctcgatctttccccagagagagagagagagagtcttgattgggggaggagagagggagagagagaaagagagaggaggacagaaaatgtttgtggatcttgagtaatgccttctaataatgataatgctgttgcaagaaatggagaatcatcctgtccaatgcatggccaagaccaactatgattttctggccaggaataactatccaatgaaacagttagttcagaggaactctggtggtgactcgtcaccaacaaagtctgggcagtctcaccaagaagcatctgcagtaagtgacagcagtctcaacggacaacacacctcaccacaatcagtgtttgtcccctcagatattaacaacaatgatagttgtggggagcgggaccatggcactaagtcggtattgtctttggggaacacagaagctgcctttcctccttcaaagttcgattacaaccagccttttgttcatcctcaaattactggtgctgcaaactctaggatgccattgcctgttgatccttctgtagaagagcccatatttgtcaatgcaaagcaatacaatgcga

SEQ ID NO: 1578 - DNA, 1232 bp, Zea mays
  Predicted polypeptide sequence is orthologous to G1363
  misc_feature (1211)..(1211): n is a, c, g, or t
aaagtttccatctctctctcccgccatatgactagtgttcctgttggctgttgctgtgtcggtccgccatgtacgcgtccctggattgctccggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcaccctccagcccggccgagtgactacggtcaactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtacaaaaaaaaaaaaaaaaaaaaaaaaaaaaaaaaaaaaaaaaaaaaaaaaaaaaaaaaaaaaaaaaaaaaaaaaaaaaaaaaaaggactttgngttgttaccactgtttaaggg

SEQ ID NO: 1579 - DNA, 780 bp, Zea mays
  Predicted polypeptide sequence is orthologous to G1363
  misc_feature (738)..(738): n is a, c, g, or t
attgggtacctcgaggccggccgggacaagatgagggataaaagaacagcgcaagtggagtgatgcagccgagggggccagaccagaggaagggacggcggggaggtggcaaggcgcagagtgcaggttcgcttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacactgccctcaccaggtccaccaccacaagtggcacaagctcctcaggctcaactcatctgcggcttgntggtggcgcagccgcagctggagatcgatctgtgctggcacc

SEQ ID NO: 1580 - DNA, 1399 bp, Zea mays
  Predicted polypeptide sequence is orthologous to G1363
ccacgcgtccggtgcatgcccaagttacacatctcgcctcgcgtgatcaattgagggcctactagcttactactgctgccttagtttcctttttcatgaatacagttacggtgggaaggtcaaattctgttgtgtattcatgcatcagctgtgctccttaaggcttgcagaccttaatacccagtacgtgtttcgaatctcgtatgtttatttctgggaactgacctgtgtttatatatgtttggacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactactagtaccttagctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaataaccaaaaaaaaaaaaaaaaaaaaagaaaaaaaaaaaaaaaaactcgaaaaaaaaacccgggggatcca

SEQ ID NO: 1581 - DNA, 1264 bp, Zea mays
  Predicted polypeptide sequence is orthologous to G1363
gaaagggcccaacagctcaacagaaaagccaagcaaaggctgctgctgcatactggaaggccctctgtccctcgccgcccgcaagagaaagggagtcagagagagagagagagagggaggagaccttgcagaggagcgaagcaagcaaggtgggaaagaggcagcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactagtacctgagtacctgctacgcgtcgttgctggttctttgatgaacttggctggacttgaggtgttgactagcgcgaagctgagttccatgtaaacttttgcttcaagaccgatgactggcggcataataa

SEQ ID NO: 1582 - DNA, 772 bp, Zea mays
  Predicted polypeptide sequence is orthologous to G1363
aggccctcctctggctccccccggccgtttgagttcggcacgcggagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctc

SEQ ID NO: 1583 - protein, 685 aa, Oryza sativa
  Orthologous to G1363
MDLDKSTSTGASLKKLQEEGALPGRGTMEREPGGLNSAIVEHRVSQVMISGPTTASNAPTPLCEKEAAEREAAINALSLTDIIGPLADHQAAASLKEGVAQEASDAAIAAAAATTSGSKVPRKGRKFSSVLGNRRKTPTPSALDASPPPPRRHRLVTLGEKAARARAAQDGSGGNSSASPAVASTDVVVAPRSREVTPSGPASDLVPGRGPPAAVLTWEELQVEMGCILEAGARGISREIVEARAAAASSANERADKLARDLAEVTYTGLHQLTGECGVMILIYIENMEIMKSRQSRNRSDRAVDGLTGHYTAVRPARLPGSTKMYQDLKEGYWWPNMKRDVAEYVALCDVCQKVKAEHQRPAGLLQPLRIPEWKWDEISMDFIVGLPKTATGYDSIWVIVDRLTKTARFIPVKTNYSSAKLAELYMTRITDGQTERTNQVLEDMLRACALDFSKDWERCLPYAEFSYNNSFQASLKMSPNEALFGRRCRTPLMWSKTGERAVFGPDIINEAEEKVRLIRDRLKVAQSRQKSYADTRRRNLEFKEGDYVYLKVSPMRGTKRFKIKGKLAPRYVGPFQITARRGEVAYQLQLPENIADVHPVFHVSQLKKCLRVPEEQAPLEEIHISNDLTYPEHPIRILGKAEKRTRSKVWRMYKVQWSNHTEDEATWESEEFLRTEYPHLFENW

SEQ ID NO: 1584 - protein, 130 aa, Oryza sativa
  Orthologous to G1363
MRGTKRFKVKGKLAPRYVGPFQIIARRGEVAYQLQLAENIADVHPVFHVSQLKKCLQVPEEQAPLEEIHICNDLTYPEHPIRILDEAEKRTRTKVWRMYKVQWSNHTEDEATWESEEFLRTEYPHLFENW

SEQ ID NO: 1585 - protein, 346 aa, Oryza sativa
  Orthologous to G1363
MYQDLKEGYWWPNMKRDVAEYVALCDVGQKVKAEHQRPASLLQPLRIPEWKWDEIGMDFIVGLPKTATGYDSIWVIVDRLTKTARFIPVKTNYNSAKLAELYMTRITDGQTERTNQVLEDMLRACALDFSKDWERCLPYAEFSHNNSFQASLKMSPNEALFGRRCRTPLMWSKTGERAVFGPDIINEAEEKKCYADTRRRNLEFKEGDYVYLKIYPMRGPKRFKVKGKLAPRYVGPFQITARRGEVAYQLQLPENIADVHPVFHVSQLKKCLRVPEEQALLEEIHLSNDLTYPEHPVRILDRAEKRTRSKVWHMYKVQWSNHTEDEATWESEEFLKTEYPHLFENW

SEQ ID NO: 1586 - protein, 302 aa, Oryza sativa
  Orthologous to G1363
MTRIVCLHGVPKRIISDRGTQFTSYFWEKVHEALGSYLAFSTAYHPQTDGQTERTNQVLEDMLRVCAMDFSKDWERCLPYAEFSYNNSFQASLKMSPNEALFGRRCRTPLMWTETGERAIFGLDIIKEAEEKVRLIRDHLKVAQSRQKSYADTRRRNLELKEGDYVYLKVSPMRGTKRFKVKGKLAPRYVRPFQITARRGEVAYQLQLPENIADVHPVFHVSQLKKCLRVPEEQATLEEIHISNDLTYPEHLVRILDEAKKKTRTKVWRMYKVQWSNHTEDEATWESEEFLKTEYPHLFENL

SEQ ID NO: 1587 - DNA, 482 bp, Glycine max
  Predicted polypeptide sequence is orthologous to G1411, G2509
aaacgaggcatggcatcattattagttgcagtgccaccaaacacttgagaatgttgatcactgagtggcgtcgccgaggcgtggaacaatgatggacgattagtgaggtaaccaaattccttagagaaatgaaccctttctggaaaattaagcttagctttggttcctttgaatctgagagctgcttcatcgtaagcgagtgcagctgcctcagcagtttcaaaggttcccagccaaactctcgctgctttctttgggtctcgaatctccgatgcccacttcccccacggtcgttgtctcactcctctatagtgccttcttacgtttccttcacatacacacacacatgtccatacatttcaacaaaacaatttgctcccatctttgttacactattttttatttttttttaacaagttatgatatttagacatccatttttctcaaacatctatctgatactaatcatttctctttaaaaa

SEQ ID NO: 1588 - DNA, 1022 bp, Glycine max
  Predicted polypeptide sequence is orthologous to G1411, G2509
ttttcctccactatgtttttttttttttttttgcaattatctttcttatttaaaagatgaagcaagcaaacagaatcccctcttttgatcttggtttcaatattcatcatcaaatcactggtcctccttttatagaaatcttagatctgcttttaacacaaggttttggtggagaagaagaagacgacaaaaacaacaccttcttccccaccccacatggccaaataagcacttctgaatttgttaatagccaaaatccgccccaggctacaaatcaaggcattgatgatattaggaaaaagcactatagaggagttaggcagagaccatggggcaaatgggcagcagaaataagagaccctaagaaagcagctagagtgtggcttggcacctttgacacggcagaggctgcagctatggcttatgatgctgctgcattgaggttcaaaggaaacaaagccaaactcaattttcctgaacgtgttgttatgccaataccaccacaaacaaataacaataattccacttcttcatcagctcctactacacaatcatcttcttctcttccaccaccacaatctctacataataatagttctctttcagcagaagggtttccaaatcttgaggagtatgcaaggttgctgagttgtagcgatgatgatgattttcaacgtgttgcattggggctctaccagcatcacaataatgaggattttatttgtggttcatcacaaccaccaccagtgccgttttttgtgtcctcttcttcttcttcttctgcaatgacatcgtcatattctgattttttgggccaaggagggagtactggttttgatgaagggaacaagagggggtcgtagttttatgtctctgaattttgagcactgcatgcaggttgcttccacaacaattaaggaagttcaaatctctcatctcttatatgttcttttgtttttattattccaattacaaaataacacctgaggtataaaatctataatactcatctttcgtcttta

SEQ ID NO: 1589 - DNA, 689 bp, Glycine max
  Predicted polypeptide sequence is orthologous to G1411, G2509
gttcttttcctccactatgttttttttttttgcaattatctttcttatttaaaagatgaagcaagcaaacagaatcccctcttttgatcttggtttcaatattcatcatcaaatcactggtcctccttttatagaaatcttagatctgcttttaacacaaggttttggtggagaagaagaagcaaagacgacggtgtataaatacaagagtagaagaagaagaagaagcaattagagggagagttagtgagcaaggtggatcgaaggcaagggaagaggtctctccctcctcatgaggagaaaaaagaagctttcaactttcctattattcatccaacaccatctcaaaatcgaaaggaacaagcttcaccatcacccttttcactcctcatgagtaacaaccaaaacaccaccttcttccccctcccacatggccaaataactacttctgaatttgttaatagccagaacaatccatcccaggctacaaatcaaggcattgatgatattaggaaaaagcactatagaggagttaggcagagaccatggggcaaatgggcagcagaaataagagaccctaagaaagcagctagagtgtggcttggcacctttgacacggcagaggctgcagctatggcttatgatgctgctgcattgaggttcaaaggaaacaaagcaaagctcaattt

SEQ ID NO: 1590 - DNA, 1331 bp, Glycine max
  Predicted polypeptide sequence is orthologous to G1411, G2509
ctcggtagctgctccgacctcgagccgattcggctcgagttcataacataaagagtatagagcagcaaacgtaaaagtggatccaagaaggctacatggcaagcttccactatcttcacaagcatcagaggagaaagaggacacagtagaagagtttgatgcttataataattatgcatcttggtcttcagaaactgacatgtctgaaatggtttctgctcttgctcaagttatgggaactaccaatcggaacccatacatgccacaatcaacctcctttcctttctcaacttccgtggtcaaagatcaacctcaaccgtacccatctcaacctcctccagatcaagaggtggcaaagaagccacactacagaggagtgaggcagagaccatgggggaaatgggcagcagaaatccgtgacccaaaaaaagcagccagagtgtggctaggaacctttgaaacagcagaggatgcagcacttgcatatgacaaagcagcactcaagttcaaaggcacaaaagctaagctcaatttccctgaaagagttcatcaagatgttccctttatgcaacaacaccaacaacgttcatcaaacagaaacgtttttcccatccatgcaacttccaccactagtagtgctactgggtctggttcttctgttgatgctgttgctcctccttcgttgtccactcatgatcaacatggccaccaagttttcccaaatctgtatcaatatgcacagattctttcaagtgatgatgcacagttaccttatttcacatcccatcttttcaatcaacaacaacaacagcaacagcaacaacctttcaattctcaattctctagcactttttcttcaacctcatcctacttctacaaccagcaacaacaatatgatcaacaaggacatgatcactcaaaccactagcatgatactattaatctctgtgatttccaaccgtaacattaaagtttttcaagtcttaattaatttgtaatcacagtgttgtaactgcaatattgacaacatgcatgggcattaattagtcgtccccaattttccttttctcaaaagagtaagattttttaggtatgtaacggtggcggcaatttaggggcaaagcaattttaaagcttgaatagctagttagtatatgcatctgtcaattttgttgtagaatattgagtcagggatcaatgtatgtttctttaagcgtgcccaagacatggatcctacatttaatttcccatttaattatggatgtggataaactttttgttggaaaaaaaaaaaaaaaaaaaaaaggggcggccgatttagaggatccaag

SEQ ID NO: 1591 - DNA, 353 bp, Zea mays
  Predicted polypeptide sequence is orthologous to G1411, G2509
agatttggaaacccttctgctgaaagagaactattattatgtatttattgtggtggtggaagagaagaagagcatgtgtagtaagagctgatgaagaagtggaattattgttatttgtttgtggttgtattggcataacaacacgttcaggaaaattgagtttggctttgtttcctttgaacctcaatgcagcagcatcataagccatagctgcagcctctgccgtgtcaaaggtgccaagccacactctagctgctttcttagggtctcttatttctgctgcccatttgccccatggtctctgcctaactcctctatagtgctttttcctaatatcatcactcgagccgaat

SEQ ID NO: 1592 - DNA, 946 bp, Glycine max
  Predicted polypeptide sequence is orthologous to G1417
  misc_feature (6)..(6): n is a, c, g, or t
gaagcncggaattcggctcgagctcgagccgctcgagccgcaggttcaaagatgtgcagatgacaaagcagtgttgataacaacctacgaaggcaatcacaaccaccctttgccgccggccgccaccgccatggcaaatactacgtcagcagccgcagccatgctgctatcaggttcggcagccccaagcaaggaagcgctaacaaactctgcaggatattactcttcttcttcaattccctatgcttcaatggcaaccctatcagcttcagctccattcccaaccatcactctcgacttgacccaaaaccccaacaacgccatgcagctgcaccgagtaccagcaggccatggcgccacgttccctctgccactgcatgcggcagctgctggtccccacctactaggtcaccccttgttcttccaacagaagcttccaccggcagcattaatgccccttcttcaacgacaaccttcgtcgtcgatggtcgaaacggttagtgcagccattgcttcggatccgaacttcactgcagctttgatggcagcaatctcatcaatcattggagtaccaagaggaggcaatgacggtaacaacaacaacagtggaagtggtgctattccaggttcaccgcagcttcctcagtcatgcactactttctccaccaactagcggaattttgagaaactatatacttaatttctctatgtatatacacaacttaaaagagaagattaggcatgctcgcgcttaatttactgtgtttttattttcttatatgtaaaacagattaagagtcacctctgattctgaatgcatgactctataaacaaatcgtttgaaccttaccttcgacccgcaggagcgtgcatgtaagtaagttgatccttttggtacatgagtctggatataacttatgttatatacgtcacagatttgcaattt

SEQ ID NO: 1593 - protein, 310 aa, Oryza sativa
  Orthologous to G1417
MNTFTLFRDEVQKASEKVHRHHANDDEAGLFLSLGLSLGSSPDACQCHASKKDEADAGNGGGDGYLALALRCAPAAGEPMVHPKRQRATTNSSSSSSICGEYGGGAAAAAVPAGHDDDDRSCMITAASTANRPGRVVLRTRCSAPTVKDGCQWRKYGQKTAKGNPWPRGYYRCTGAPGCPVKKQVQRCNHDTSVLVTTYDGVHNHPITPYAAALPPSSSSSSSAAVAMLASSSSSSTWSELQRAMPAAQSSWSQRNYPIQADVVAKAIWDPKFQATVAAAVASYVRDREQSARVAGGKGAGELFNLAPPC

SEQ ID NO: 1594 - protein, 244 aa, Oryza sativa
  Orthologous to G1417
MNTFTLFRDEVQKASEKVHRHHANDDEAGLFLSLGLSLGSSPDACQCHASKKDEADAGNGGGDGYLALALRCAPAAGEPMVKDGCQWRKYGQKTAKGNPWPRGYYRCTGAPGCPVKKQVQRCNHDTSVLVTTYDGVHNHPITPYAAALPPSSSSSSSAAVAMLASSSSSSTWSELQRAMPAAQSSWSQRNYPIQADVVAKAIWDPKFQATVAAAVASYVRDREQSARVAGGKGAGELFNLAPPC

SEQ ID NO: 1595 - DNA, 1435 bp, Glycine max
  Predicted polypeptide sequence is orthologous to G1419
agcggctcgagcggctcgagctcccaaattctcaactttcctaactttagcaaccatctaagaagttcagtcccttaattatctctcaccttgaattagaaaagcattcaaagctttgaacccaatttcactgtttgcacctcaaacatcttagaagtcccaattgagtctcaattccacaaccaaaaatgcaaagttcaatttcacaatctgatatttttatcactgattaccttgtaccccaagaagttccatttcaatttcaatttcaagatatgagcaagaatgacaacaacatgccaatgaaccataccaataataaccttcaaatgcctcaaatcacatctttctccaagcctccaaggtcctcatcaaatctaagcaaccgcaaaccctccttgaaaaacatcacaatcccttccataacctctggtcttgcaacagctatgtcacaaacaacagcaacaacaacaacaatagctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggctcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaagagagaaagagaggaagagagtgaaaggaagaacaactatgagaaaagtgagtttaacaacaatagtaatagtaataagcatgtgaagaaagaagagtgccctttgactccatcatgttggaaaggcttttgggacactgatgttatgggaacaatctttagtgtgcctcctttgtcaccactatctccactaatggttgtttgagattttgtggaacttttgctctttcaatgatgttttgaggtaaccaaactaaggggagagagagagatgatgctggtgattgtcctctctgatttaggttgctaatttgcctaaatcaaaatggtagtactaattaatctactaatagattaatttgcaagtgaatatatatatggatttgtataatgtaaatataggatagtactatgaagcaagatctttttgtttgttgaaaaaaaaaacaaaaaacccatgcttatcttcttcctttaggtaaaaaaatgtactgtacttgaagcaatattgaaatttgtttattcgtttattggagaaaaaaaaaaaaaaaaaaaaaaaaaggaaaaaaaaaaaaaaaaaaaaaaaaaaaaaaaaaaaaaaaaaaa

SEQ ID NO: 1596 - DNA, 1025 bp, Glycine max
  Predicted polypeptide sequence is orthologous to G1449
ctgcgagaagacgacagaaggggagtctcgatcagtttcattcattggaagatatgggaacattagaacaaattgatgcccctcaaacccggtcatcatcatcttcttcttcttccatcgatagcaacaaccacccttctaggactaggactccaccaccctcttccccttcatcaagtccctgcagaaacagaactgatttgagcactgacctcagacttggtcttagcatctctccttcttctcaatctgaatcacccttcaattcaacaccaagggaggaaagttttgactggccaccaattaagtctatattgaggagcacccttgtggggaaacaaagccatctgaaccaaagaccctctttgtttgtcaaagtctatatggaaggaatccccatcggaagaaaattgaatctgatggcacattatggctatgatggactagtgaaaactcttggccatatgtttaggacgaacattctctgtcctaactctcaaccacttaattctgggaattttcacgtgctaacttatgaggatcaagaaggggactggatgatggttggagatgtgccgtgggagatgttcttgaacagtgtgaggaggctgaagatcacaagagctgaccgatgctagttaatttaatgatgtatacaatctctctcacaacacaagctcctcctgatcaattttcattgttcataaatttttgctgtagatctagttattaattagtgggtgggtgaaaccccttgaagtatttcaccaaaaagaatggatcccgtgattatcatatatctaatagctttatacaccgaaaaacaatatagatgtgtaacttcttacctaattctcaattcagtacatagctgcagtattcctagtctctctgtttgatgatggagtcgtctaattttcctctttgttttggaactagctccattattttgtagtcatttggaacaatgcatgtcccttttgtcttcatacctttaatgcatgatgtttcttggtgtctctttt

SEQ ID NO: 1597 - DNA, 822 bp, Glycine max
  Predicted polypeptide sequence is orthologous to G1449
ccacgcgtccgggcaacaatcacaccacccttttgtgaacatttattcacaagttcctgctgaagtgaatgattgcagcaacgatcatagcagcttctttgtgaaggtgtacatggaagggattccaatcggaaggaagctcaatatactagctcatggaggctactatgagttagtcaggactcttgaacacatgtttgacactaccattctttgtaagtctattgttttatatcctctcattttgttgaatattaacaacacattttttaacatgagcttcctaactcgcaagattttgtaatttataagccagagagtgttgaatcagcaaaataacaatggaatgttgtggtgtgttaacagggggaacagaaatgaatggagtgcaaccagagagatgccatgtgctaacttatgaagatgaagaaggggatttggtcatggttggagatgtcccttgggagtaagttaattgactcttttttgtttttttttcttatctgagaaacaaaagcattatatgttccattttgtgaattgatgtggtatttgttttgatggtgtaggatgttcttatcgccggtgaagaggttgaagatcacaagggtagacacattcgggtgttaagtgaagaacatgacactgcctcttcctccaccggtgattttagattttgtcctctagagtgagactctaatgaggtcgctgatcagaaaatttagaaaaatcttagtgaagtatatgcacagataggtgatgtatatgcatagctcactctgctctttctttcaagataaaaaaccacccggccaacccaag

SEQ ID NO: 1598 - DNA, 597 bp, Oryza sativa
  Predicted polypeptide sequence is orthologous to G1449
atcgaggccgcgtgcggcgccatgacggcgacgttccactgtttcgtgaaggtgtacatggagggcgtccccatcggcaggaactggacctgctgccgctggacggctacaaggtctcgtcgcacggcttgcctccatgttcagagcatccatcacctatcatcattgccatcgacagttcgccgtcgtcgggatgaagacgaacaaggttcatcatgttctgacatacgaagaccaggagggagactggatgatggctggagacgtgccactgggactgttcctgacaagcgtgaagagattgaggattgcaagagcggatgacaagtactgctatagctgttgaataattggttaaccaggatggtcaattaattcttccagagttcttggatttcattcattcttactttgctcattttggtggagcacatttagatttgagatgattgttttcgggagcgaaaatttactagtaaaagcatagtgatattgagcagaggatattgtacaaaatatattgtacacactagtaaaagaaaagaaacatatatatagaaatacccttttacttctcaaaaaaaaaaaaaaaaaaaa

SEQ ID NO: 1599 - DNA, 937 bp, Oryza sativa
  Predicted polypeptide sequence is orthologous to G1449
  misc_feature (118)..(118): n is a, c, g, or t
  misc_feature (133)..(133): n is a, c, g, or t
  misc_feature (693)..(693): n is a, c, g, or t
tgatgctgagtgatcccgtccactagctggtgaattggagagacggatggagctcgagctcggcctcaggctcgcgctgccgtcgccgtcgccgtcgccggcgagcggtcgtcggcgngatgggtgtgagctntgacctttctcaacagcgcgccggggtcctgccgcaagaggggcttcgaggaggcgctcggtgggttcaaaaccgacgacgacaacgacgacggcgatggccgcggcggtgacggcgattccgacggcgaactgggcaacaagaggaggaagctggtggggtggccaccggggaagtgcttgcaccggcggcgcgacggtggctgcggtggcggatatgtgaaggtgaagatggaggggttggccatcgggaggaagctggacttgtccatcctcggctcatacgctgagctgctcgacacgctccaccttatgttcccctccactaaccaagaggatgggcacgatcgtcgtcgacgtcacccatacgctgtcacctacgaggatggggaaggagactggatgcaggtcggagacgtgccatgggaggcctttgccaagtcggtgaaacggctcaagatactggtgtaactgactgcaaattaagctactagtactagtctttactacttcgaataaaattgtacgtgaacgggattattttgttcacgtttctctcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgttttaaaggacccaattttacttccccgggtttgcaaggtaaaaatttttttatggggcccccaaaattaatttccggggccgcggtttaacaccggggggaggggaaaa

SEQ ID NO: 1600 - DNA, 769 bp, Zea mays
  Predicted polypeptide sequence is orthologous to G1449
  misc_feature (654)..(655): n is a, c, g, or t
  misc_feature (667)..(667): n is a, c, g, or t
  misc_feature (681)..(681): n is a, c, g, or t
  misc_feature (697)..(697): n is a, c, g, or t
  misc_feature (747)..(747): n is a, c, g, or t
  misc_feature (756)..(756): n is a, c, g, or t
ggcgattgggttcctcgaggccggccgggcccttccccccttccgttccgttccgatttgacgagttggtggctgctatagattcactccacccctctccatttctgataagtatccagctagctaccagtgtatgcaccaggcagcagcagcatggcggagtgcaaggacgacgacagcggccggcggtctccgtcgtcgtccatggacagcagcacccaccccccggcgctctccaccgcgtcctcggcctcccgccgcccgccggagaggagggaccagctcagccccgacctgcagctagggctcagcctgtcgccggcgtcctccgccctcctggtagcggagacaaacaacagcatcgtcccttctacgccaaggaaccaagcactcccggattggcccccgatcaaaccgttccttagaagcgccctgactgcctcggcacgccgacggcgaacgctgttcgtcaaggtgtacatggaaggcgtcccgatcggccggaagctggacatgctcttgctggacgggtacagcagcctcctagcgaaactttgccacatgttcaaggcatctatcacttcgggttcctcacgagaaggccgcgcatgttctcacctatgaagaccatgatggagactggatgatggttgnngatgtaccgtgngagctctttctcgnaagcgtaaagagctgnagatgcgagaaccgacaggtgctagatagcaaacttttcatgcgggggancgactctgntcccctctctttt

SEQ ID NO: 1601 - DNA, 1097 bp, Zea mays
  Predicted polypeptide sequence is orthologous to G1449
ggccctaggggccttttttttttttttttttcttcacgcaaatcgcctcttcccttgcatccagccttggtacttgctaggcactcagagaaaacagaaaagggaaacatataaaaataccaaaatttaattttctagggatggtatcaagattgacttttcttccgtatactgtacacggtcagtatatatagcctcggtatcacatgcatgtccactctgtggccagcaaaatctttctgtatgaaccgatataaataaaaagaggaaagaaatagagtccatgcagcgcacgaataataagctttgctaactagcatttatctgttcttgcaaatcctaagtttcttcacacttccaaggaagagctcccacggtacatccccaaccatcatccagtctccatcccggtcttcataggtgagaacatgtgcaggcttctcgtgaggaactcgttggtggtactccatagcatcagcaaaggtgatggaggccttgaacatgtggcggagcttcgctaggaggctgtcgtacccatccagcaagagcaagtccagcttccggccgatcgcaacgccttccatgtacaccttcacgaacagtgtccgccgtcgtcggcgtgccgaggctgtcaaggcgcttctgaggaatggtttgatcgggggccagtcttgggtggtcctgctgccccttggcgtggaaaggacgctcttgctctccgctaccaccaggagggcggaggacgccgccggcgacaggctgcagagccctagctgaaggtcggtgctaaggtcgtccctcctctccgtcgtcgtcggccggaagcccgacgacgacgcggcggatagcgccggcgggtgggtgctgctgctgctgtccatggacgacgacgaaggagaacggccgccggcgtcgtcgtcctgcttgcacccggccatatgctgcctgcaggtgtgcatacactgtgtgatatatgttacgccgcagctggtgcttgttagaaatgggtcggcggagagcggcggagcgaatgatcttgctagcgccgacgactcgtcaaactggagcggaaagggagaagcccggccggcctcgag

SEQ ID NO: 1602 - DNA, 1017 bp, Zea mays
  Predicted polypeptide sequence is orthologous to G1449
  misc_feature (117)..(117): n is a, c, g, or t
aaacaagaaaaaggtctgcgtatactcctgacttgataaccaaataaccatggtatttacaaggcagtcaaagaaccaggggaaaggaaacataaaataccaaaatttaattttgcnaggggtggtagcaaaggctggcgtttcttcagtacactgtacacggttagtatagcctcagcatcacgactccactctttagttcagcaaaatctttcctaatgaacctaatatatattaaaagaagaagaaacagagtcgatccaccgcatgaaaaagtttgctatctagcatctgtctgttttcgcaatcctcagcttctttacgcttccgagaaagagctcccacggtacatccccaaccatcatccagtctccatcatggtcttcataggtgagaacatgcgcggccttctcgtgaggaacccgctgatggtactccacagcgtcagcataagtgatagatgccttgaacatgtggcaaagtttcgctaggaggctgctgtacccgtccagcaagagcatgtccagcttccggccgatcgggacgccttccatgtacaccttgacgaacagcgttcgccgtcggcgtgccgaggcagtcagggcgcttctaaggaacggtttgatcgggggccaatccgggagtgcttggttccttggcgtagaagggacgatgctgttgttggtctccgctaccaggagggcggaggacgccggcgacaggctgagccctagctgcaggtcggcgctgagctggtccctcctctccgccgggcggcgggagcccgaggacgcggtggagagcgccggggggtgggtgctgctgtccatggacgacgacggagaccgccggccgctgtcgtcgtccttgcactccgccatgctgctgctgcctcccgcccgccctcgtggtacccctggatacttatcagaaatggaaaggggtggacacggtggagtgaacctatagcaccaaaacaacagctcgtcaaatcgatacggaacggaaggggggaag

SEQ ID NO: 1603 - DNA, 810 bp, Zea mays
  Predicted polypeptide sequence is orthologous to G1449
aaaaagaagaaccagtcgcgcgatccaccgcatgaaaaaagtttgctatctagcatctgtctgttctcgcaatcctcagcttctttacgcttccgagaaagagcctcccacggtacatcccccacccatcatccagtctccatcatggtcttcataggtgagaacatgcgcggccttctcgtgaggaacccgctgatggtactccacagcgtcagcataagtgatggaggccttgaacatgtggcggagtttcgctaggaggctgctgtacccgtccagcaagagcatgtccagcttccggccgatcgggacgccttccatgtacaccttgacgaacagcgttcgccgtcggcgtgccgaggctgtcagggcgcttctaaggaacggtttgatcgggggccaatccgggagtgcttggttccttggcgtagaagggacgatgctgttgtttgtctccgctaccaggagggcggaggacgccggcgacaggctgagccctagctgcaggtcggggctgagctggtccctcctctccggcgggcggcgggaggccgaggacgcggtggagagcgccggggggtgggtgctgctgtccatggacgacgacggagaccgccggccgctgtcgtcgtccttgcactccgccatgctgctgctgcctggtgcatacactggtagctagctggatacttatcagaaatggagaggggtggagtgaatctatagcagccaccaactcgtcaaatcggaacggaacggaaggggggaagggcccggccgccctcgtggtccccaatcgcccttaggagt

SEQ ID NO: 1604 - DNA, 2414 bp, Glycine max
  Predicted polypeptide sequence is orthologous to G1451
  misc_feature (8)..(8): n is a, c, g, or t
gaccacanactgtcatgccatcctcagttctatctagtgatagtatgcacattgggcttcttgcagctgctgctcatgctgcagcaactaatagctgctttacagtgttctataacccaagggctagtccatctgaatttgtcataccgctttcaaaatatatcaaagctgtgtaccatacgcgtgtttctgttggtatgcggctcgggatgctttttgagactgaagaatcaagtgtccgcaggtatatgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttgcagaacttagggagtggagatttaatgagacaacaaatgatgaattttcagcagcctttccactatcttcaacaatctggaaaccccaatcctcctttgcagcttcagcagccgcaaccagttcaacaatctgtgtcttctaacatgctgcagccacaagctcacgtgttgacagagaacttctctcagcacctccttcagaaaccacataacaatcaagaagtccaagcacaacagcagcagcatacttatcaagactcgctcttaattccgagtgatcagctccatcagagacaacactctggcattccttcaccatcatattcaaaaccggatttcttggattcgagcatgaagttccctgcttcagtttcccctgggcaaaacatgcttagttcactttgtcccgaaggaagtggcagtctcttgaatttatccaggagtggtcagtccttgctgaccgaacagttaccccaacagcaatggactcaaaaatatgcacctgtgcaggtcaatgcctatggaagcactgtgtcacatccacaatattccggaaaagattctgtaatggtgctaccacattgtaactcagatgcccaaaattctactctttttggtgtcaatatcgattcatctggccttctcctccccaccaccgtccctggttacaccacctcgtccgctgacactaattcatcaacaatgccattagcggagtctggtttccagggttctctatatggttgcatgcaagattcatcggagttgttgcaaagtgcagggcatgttgacccagaaaaccagactcaaacctttgtcaaggtttacaaatcagggtcagttgggcgctcacttgacatatcccggttcagcagctatcatgaactgcgcgaggagttggctcagatgtttggaattgaggggaagttagaagaccctcttagatcaggctggcagcttgtgttcgtcgacagggagaatgatgttcttctccttggagatgatccgtgggaatcattcgtcaataatgtttggtatatcaaaatactttcacctgaagacattcagaaaatgggggatcaagcggtagaatcccttgctctaggttcaggacaaaggctaaacggcactggtgctgagtctcaggacattgtttctggaccaccatcaatcggctcacttgagtactgagaaaactgaaacatgtattccttcagaccaccatggtcaagagaatttctctacatgttttattacttaagttggaatatgttgtgtatgatctgttccccctttcagccctccttattattactatcagcattgaagaaaagtatacatttatgattaaaaaaaacccttaggacatgcttctgtgccaatttgaacttggagcactgcaagctagagttagtgttaatgctattttagcataatatttgatcaaacttttgcatgaactaatgtactctagataggaaactagagaaggctgtttatgcttgagctgtctttgtattctacaatgccattagttcccagttaaggggtcgaacttttaactcaaaatgtatgagtagtattttactatattgccattgaaaccatcaacccaccatacgacatgtctcttaaatgctactattttgtagctctataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 1605 - DNA, 2021 bp, Glycine max
  Predicted polypeptide sequence is orthologous to G1451
attcggctcgagtattattctgagtgtggtgcaagccacctatgtactatttttcctttacttatgcaaaagctacctttgtactatttttcctttacttctgcacaagccaccttcgttttgcaggtacatgggtacaataactggcataagtgacctggatcctgttcgttggccgaattctcattggcgatctgttaaggttggttgggacgaatcaaccgctggagagagacagccccgggtatcattatgggaaattgagcctttaacaacgtttccaatgtatccatctctatttcccctcagattgaaacgaccctggcatccgggcacctcttcttttcatgatggcagagatgaagcaactaatgggcttatgtggctgaggggtggacctggagaccaagctctcaattccctgaattttcaaggttctggtttgttgccatggatgcagcagagaatggatccaactttacttgcaaatgatcataatcagcactaccaagccatgtttgcatctggtttgcagaacttagggagtggagatttaatgagacaacaaataatgaattttcaacagcctttcaattatcttcaacaatcaggaaaccccaatcctcctttgcagcttcagcaaccgcaagcaattcagcaatccgtatcttctaataatattctacagccacaagcccaagtaatggcagagaacctgtctcagcacctccttcagaaatcacacaacaatcgagaagaccaaacacagcagcagcagcagcagcggcacacttatcaagatacagttttacttcaaagtgatcagctccatcagaggcaacactctggtctaccttcaccgtcatattcaaaaccggatttcttagattcaagcatgaagttccctgcttcagtttcgccaggacaaaacatgcttggttcactttgtcccgaagggagtggcaatctcttgaatttatccagaagtagtcagtccatgttgactgaacagttacctcaacaatcatgggccccaaagttcacaccattgcagattaatgcttttggcaactcaatgcaacatgtgcagtattctggaaaagatactgcaatggtgccaccacattgtaacccagactcccaaaatcctattctatttggggtcaacattgattcatctggccttctgcttcctacgactgttcctcgttatactactgcatcagctgaaattgatgcatcagcaatgccaataggagagtctggattccagtctcctctatatccttgcgggcaagattcatcagagttggtgcaaagtgcagggcaagtcgaccctcaaaaccagacacgaacattcgtcaaggtttacaaatcagggtcagtagggcgctcacttgacatctcccggttcagcagttatcatgagctgcgggaggagttggcacagatgtttggtattgaggggaaattagaagaccctcttagatcaggctggcagcttgtattcgtcgacagggagaacgatgttcttctccttggagacgatccgtgggaatcatttgtcaataatgtatggtatatcaaaatactttcacctgaagatatccataaaatgggagaacaagccctggaatcccttggtccaagtccaggacagaggctgaatagcactggtgcagattctcatgaaattgtttcaggactaccatcaattggctcccttgaatactgagagaattttaacatgtatttttctctcaggtcctacggttaagaagactattacatatccacatgtttagtacttctgtttgaacactacttttcgaccttgcatatctgaatcaatatatactgtattgtctgtttcactttcaaaaacatcgttattatttcgtagaggattgttgagattttcaggacaaaaaatctatattatatatatgatgagaaagaaacctaggacaaacttttgtgcctgtaaccttgtgttgacatagagttaaaactattgtagc

SEQ ID NO: 1606 - DNA, 3152 bp, Oryza sativa
  Predicted polypeptide sequence is orthologous to G1451
  misc_feature (3084)..(3084): n is a, c, g, or t
  misc_feature (3138)..(3139): n is a, c, g, or t
cccgggctgcaggaattcggcacgaggtctctctcgccccccggccccaccctttctccccaccatggtggcgatctccgagctcgggtgagcggaagagaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacgggggggtttctccgtgccccgccgtgctgctgagcgcgtcttccctcctctggatttcacacagcagcctccagcccaggagctaattgcacgggatattcatgacatcgggtggaagttcaggcccctctttcggaggccaacccaaacgacacctgctaaccactggctggagcgtttttgtcagtgctaagagacttgttgctggagattctgtgcttttcagctggaacgcggcacgccggcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaaggccaccaagagtttctttatgggaaattgaaccattgacaacctttccaatgtatccatctctgttcccactgagagttaagcatccttggtattcaggagttgcttccctgcatgatgacagcaatgctttaatctggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaacccaaaaaaaactgcaataatcgaagcgcacgaggattgtttccaaaaaaaaaaaaaaaaaaaaattttnaccgattgtccggttatgtcagtttcgagaggagctgtcaaaaaaaaaaaaaannaaaaaaaaaaaaa

SEQ ID NO: 1607 - DNA, 2536 bp, Oryza sativa
  Predicted polypeptide sequence is orthologous to G1451
ataagctcaatagttcttgaactgaattttcacagttgcatggaaaaccttacttgctgtcattaacagtacattgcaggaggaaaacatcatcaatatacagaatatggccgaagctagcgcctgcggcactacagcactactcaacatgaacctaataattagatgccctaagttaacatgatcagtattccaggaaacaaagtgtcggcatgtataccaaaatgtaataggtaccactaaaagtcaatgtaatatgacataattaccagacagcgcataacttagagctacacttgacctatgtgcttgggttccaggtcacagaactaagagctacagagacgtacagaactggacgcctaacgccgggtgctatgagctccctatttctcagaactcaactgagcccaccgacgcgattccagtgcttaggcttcttgattcctgcctgctcatgtagttgtcacagctgttgccaagtctccttgcagaagtcgagaagagttcaatgcccggcttgcccatctgctgaacctcctgcggcgaaagtatctttatgcaagacacactgttcacaaattcctgccacggatcatcgccaactagaagaaccgtcgtcctctcggtcaacaaatacaagctgccagccctgatctcaaaggggtcttccaactggcccctcaaggcccaaaaggcgccctacctcactacgaagttcatgataactgctaaatctagtgatgtcgagcaaccttccaacggttccagatttgtaaaccttcacaaaggttgcatgcggtcgcttcacttgatcagcattatctgaacatggaacatatcctgattcatctaagcagcccggagtagttagtgtttgactcaatgcctcgtccccttgcctgcggctaaggaagttggatgtggaatatggaattgtgcttgaactgttttcattgtgaaggcttggaatgccatcttgcatcaaaagtgactgtgagtctatatttacaccaaacaagaagtgattttgaggatcagagctcccatcttgatccaccaggcattcccttccaggcagtggtgctaacgtggagttttgaggaatactagaaggtgtcaagtcgaagttctctatctgtgatgaaatgtcatgtgggcgagaagtgatcgtagattccactgcaactcgcttagatgaccatgggtcagagacaggtacaggggtgattcttgccacacctgggaggtctgaagcagcttctgaagggaatgatctcagtgtatcgtgcatggatgagacattggatggagagagacaactgatatttgtgtcagggaaattatgttgctgtgagaatggtgaaactgtctgcaatgtggagggtgtagactgaggggtggaggaaagctgtgaaaaaaccgacaatgcatttggtacagtctgaaagttggacaagtgtttctgttgtcccatttgttgatgctgaggttgctgctggtgtgattcttgctgctgttgctgcggctgcaactgaggcttctgttcgttaaatgatgggcaatgttgaagcggttgctggaggtactcaggctgactatgcccttggattgagttgccattgatgttttggtggtacatctgctgaaattgaggctgtgcttgctgcagaatctgactggatagaagagaagatctaccgacaatgttttgcggctgctggaactgcagcatggcaggtgatacttgcttagtggtgttctgtaaagccgccgccgccgctatcgtttggtacatgtcaggttgcagaccaagtagggaactatccagccttggctgcatccacggactcataccaagtcctccaaaattcagagattggaaacctgtgttttgactatctcgaagccacataagagaagaagccaagtcatcctcctttccgccatataaagaaggtaagcctgttggccatggacgctttagtctgagaggaaaaggagatggatacatcgggaaagttgtcagaggctcgatctcccaaagagacacccttggctgtctctctccagcagtcgactcatcccatccaaccttgacagagcgccagtgtgagttcatccaacgaacaggatcaagatcacttattcctgttattgtccccatgtatctcctaacactggattcttctgtttcaaaaagcatccggaaacgcatgcccaccgatatgcgggtatggtagacagcctttacatatttagccagtggtataacaaactccgaagggcttgctcttggattatagaaaatagtaaaccggctatttgttgatgcggcgtgagcagctgcagcaagcagaccaatatgcatgctgtcactagacaatactgatgatggcatgaccgtttgtggcctatttgcccgacgaattcccagaagcagctgattactgtcattccagataaaaaggacagagtctccagcaacccctcgcgccgcactcccgcagccccgccaacccgtagtcagaagatg

SEQ ID NO: 1608 - DNA, 650 bp, Oryza sativa
  Predicted polypeptide sequence is orthologous to G1451
ctgcaggaatcggcacgaggattgctgcgacggtccaggtttggttagttgttgagggagaaaaaaatggaagatatttctgggcgcaagagaggaaggcaggtgtttgctgctgctgctgggagcatgatgggaagctgaccagcagcttctccggtatcctggtgcggcggagtttcgtgctctttggcgacgggtgcactggtgattggagatgaagctctctccgccggcgtcagcggatatgccgcaggccttgccggagaacgacggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtttatgctcagatgacattgcaaccattgagcccggaagagcaaaaggagcctttccttccaatggagttgggtgctgctagcaagcaacccactaattacttctgcaagacattgactgcaagtgacacgagcactcatggtg

SEQ ID NO: 1609 - DNA, 3210 bp, Zea mays
  Predicted polypeptide sequence is orthologous to G1451
aattcggcacgaggcttccttctcctaccccccacaccctcgcccccccccgctcccgcccgccgcgccctcctcctcccagtccgccccacccttccggccctccccctcttttatatccagtaccatggtgatctccgagctcgggtgagctgatgagaatgcggccgatttgaggaaggctgtgggcgcgatggatgcggtttcgggcggattcgcgaggaggctgtagaggttaggttccggtgtcccccggcccggccggtcgtgggagatgagctcctcgtccgcggccagcatcgggcagccgccgccgcccgcgccgccgccggaagaagagaagaagtgcctcaactcggagctgtggcacgcctgcgccggcccgctcgtctgcctccccaccgtcggtacgcgcgtcgtctacttcccgcagggccacagcgagcaggtggcagcgtcgacgaacaaggaggtggacgggcacatccccaactaccccaacctgccgccgcagctgatctgccagctccatgatgtcacaatgcatgcggatgtggagacagacgaagtgtacgcgcagatgacgctgcagccgctcaatccacaagagcagaacgacgcgtacctgcctgccgagatgggaatcatgagcaagcagccgacgaattacttctgcaagacgctgactgcgagcgacaccagcacgcacggcgggttctctgtgccccgtcgtgcggccgagcgcgtcttccccccgctggatttcacacagcagcctccagcacaggagcttattgcacgggatattcatgatgttgagtggaagttcaggcatatcttccgaggccagcccaaaagacacctgctgacgactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtaaaaaaaaaacaaaaaaaaaaaaaaaaaaaaaaaaaaaaaaaaactcgagagggg

SEQ ID NO: 1610 - DNA, 3988 bp, Zea mays
  Predicted polypeptide sequence is orthologous to G1451
aattcggcgcggggcgaaagcaagcaaggagcaccgcaccacgccactccagtactccactccactctcgtcccctcctcgatccagccatggcggcctagcccccccccccccctcccctagggttctctgccagcccccacccacccaggcgcctcctgccgctcccacccggtggtcgcgctgcccgcgtcgaatgggaggccacccggcgctcggagtcgggcgtgaccgcgcgctgccggaggttccctgagctcggcggcggcgggagcgtggctggtccggagcgcgccgcgcgtgcaatgggaggttcgagtggggttcctgcgagccgccgcggcggtctcggttctgcgagcgcgtggcccatgcttcgcgaagggtagggttgtctgtctgtctagctagctgctagctgcttggtctgatgagctcagctccggcgccccgcctcggcttccccgcgcgcttgctccgtcggctgcccagaacccagcttgcccgctccggcgcttctcttcgcttcttcggggaaaggttggagctttgaggtggtgcgggtgctcagccgaggactccgggcgatgacgcccgcagtggcgcgcgtttgccgcgacagtcctgggttcgggtagcgagttcctcgagcggatttggctgctgctgcgtcctgcgtgggaaggggaggcggcggcggcggcagcagcagaggaaggggaacggttgctctgaagcggagggggagcgggctgacattgcttctgggagcatggcgagcttctaaggacgcgcagctcccgcagcccagccattctcatcgccgcaccttggtgttcttgcccccaggtcgtactggttggtgggagggaacatgaacctctccccgcccaagatgtcggagccatctccggcacgtggcggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcaaatcccaaactatccaaacctacctccacagttaatatgccagcttcataatgtcacaatgcatgctgatgcagagactgaagaggtgtatgcccaaatgacactgcaaccattgagcccggaagagcaaaaggatccttttcttccaattgaattgggtgctggtagcaagcagccaaccaattacttctgcaagacgttgactgcaagtgatacgagtacccatggtggattctctgttccgcgccgagcagctgagaaagtcttccctccattggatttttcacaacagcctccagtgcaagagctggttgcaagagatctgcatgataatgaatggaaatttcgtcatatttttcgtggtcagccaaaaaggcatctactgacgactggttggagtgtttttgtaagcgcgaaaagactagtagcaggggattctatcatatttatctggaatgataataaccagcttctcttgggaattcgccgtgcaagtcgtccacagactgtaatgccctcttctgtgctatcaagcgatagcatgcacattggtcttcttgctgcagcagctcatgctgcagccacaaacagtcgtttcactattttctacaaccctcgggctagcccttctgagtttgtcattccactggctaagtatgtgaaagctgtttaccacacgcgcgtatctgttggaatgcggtttcggatgctttttgagacagaggaatcaagtgtcagaagatacatgggtacgatcacaggcataagtgatctggactcagagcgctggccaaactcgcactggcgttctgtgaaggttggttgggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgggtctgaagccagatacttaccagcagatggctgctgccgcactggaagaaattagagctggggatcatttgaagcaggcatcttctctcctgccagtgcagcagcctcaaactttgaatggtggattagatcctttgtatggaaatcctgttctgcagcagatgcagttccaatctcagcagtcaacactgcaagctgtgcagcaaggttatggtcagaatgcaaacgactctgggtatgttcaaaatcaactgcagcagctgcagctgcaaaagcagcaggagccaccaccaccacagcagcagcagcagacacaagtccttcagcgacaagcacatcaggaaatgcaacagcacctctcagctagttgtcatgatattgctaatgtagcttctggtgtgtccatgtctggatctgcttgtcaatcacaatcttctctgctttctgggtcatcgttctaccaacagaacatctttgatggaaatggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccgggatctgaagctctgaaccaaaaccggcaatccagcatttgcaggatttgccatccgcaagtcgtttcgttcctgtgttatgatcctctcagtctcaggccctgttgatcgggaataacctagtcgtttaatatagctagatgatgatccatgtatcattatggtaatggacatgctgtacgatagctactgtagctctaaatgcaggcaaggcaagaattgatctatcaaagaacgaatgaatgcaggcactcactgtagaggtgatctagccctgtactcctaagtcctaagatatattctcatagctaaaactgatggttccatgtggcattggcacccaagctattgaaaccagtcacctttgccgattcctcctgcgaaaaaaaaaaaaaaaaa

SEQ ID NO: 1611 - DNA, 2886 bp, Zea mays
  Predicted polypeptide sequence is orthologous to G1451
gtcgacccacgcgtccggtctacctccgcagcttatatgccaactgcataatgtgactatgcatgctgatgctgagacagatgaggtgtatgcacagatgacactgcagccactcagtccacaagagctcaaggacccatttttgcctgctgagttaggcactgccagcaaccagccaacaaattatttttgtaaaacactaactgcaagtgatacgagtacacatggtgggttctctgttccacgccgagcagctgagaaggtgtttcctccactggatttcaatcagcaacctcccgcacaggagttgattgcaaaagatcttcatggcaacgactggaaatttcgccatatttttcgaggtcagccaaagcggcatcttctgacaacaggttggagtgtctttgttagtgcaaagagactggttgctggcgactctgtcctttttatctggaatgacaacaaccagctgcttctgggaattcgacgggcaaacagaccacaaaccgtcatgccatcatcagtactttctagtgatagcatgcatattggcctgctcgctgctgcagctcatgctgcatcaacaaatagtcggtttactatcttctataatccaagagcaagcccttgtgaatttgtcatacccatggctaagtatgtgaaagctgtgtaccatacccgtatatctgtgggcatgcgtttccggatgctttttgagacggaggaatctagtgtaaggcgttatatggggacaattacaggaataagtgatcttgatcctgttcgctggccaaactcgcactggcgctcagtaaaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcattacaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggtcatacacaacctgagtacctccaagtccaacagcagcttcaacgctgccaatcatttaatgagcagaagcctccgatgcatccacagcaacaacagcaggaaccacagcagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcacattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccggcacttcagttcttatcgagtagcaataccgctagtttagtccatccaatcaactacgttcttgttcctatgatcctgttgttgcgatgcagtaaaactttttttttcgtcataaaaaaaaaaaaaaaaaaaaaaagggaaaaaaaaagggcggccgc

SEQ ID NO: 1612 - DNA, 3033 bp, Zea mays
  Predicted polypeptide sequence is orthologous to G1451
ccgcttgtttccttgcccgcggtgggtagccgagttgtgtacttccctcagggccacagcgagcaggtagcagcatcaacaaacaaggaaatagagtctcagatccccaactatcctaatctgcctgccacagcttatatgccaacttcataatgtgacgatgcatgctgatgcagagacagatgaggtatatgcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaatggttgatcgggtaatacagcccctcgcacacaaaaataagtcgacgcggccg

SEQ ID NO: 1613 - DNA, 680 bp, Medicago truncatula
  Predicted polypeptide sequence is orthologous to G1451
  misc_feature (541)..(541): n is a, c, g, or t
ttcggcacgaggcgacaaactacttttgcaagaccttgactgctagtgacacaagcactcacgggggattctctgttcctcgccgggcggctgaaaaagtgtttcctcctttggatttctcccaacagcctcctgctcaagagttaatagcaagggacttgcatggtaacgaatggaaattcagacatatcttccgaggccagcccaaaagacatctacttacaactggatggagtgtttttgtgagtgctaaaagacttgttgctggtgattctgtgctgtttatctggaatgaaaagaaccaattgcttcttggtattcgccgtgctagccgaccacaaactgtgatgccttcctcagtattgtcaagtgatagtatgcacttgggacttcttgctgcagcagctcatgcggctgcaaccaatagccgtttcactattttctataacccacgtgcgtgtccatccgaatttgtcatacccttggcaaagtatgttaaagctgtgtatcatactcgagtttcagttggtatgcgtttcangatgctctttgaaacagaggagtctagtgtgcgacgatacatgggtacaataactggcatttgtgacctaaattctgtccggtggcctaactcacattggcgctcggtaaaggttggttgggatgaatccactgccgga

SEQ ID NO: 1614 - DNA, 705 bp, Solanum tuberosum
  Predicted polypeptide sequence is orthologous to G1451
ggagttgtgtattttcctcaagggcatagtgagcaggttgctgcctcaaccaacaaggaagtagatgctcatatccctaattatcctggtttaccgcctcaactaatttgtcagcttcacaacctgacaatgcatgcagatgttgagactgatgaagtatatgctcaaatgacattgcagccactaagtccacaagagcaaaaggacgtgtgcctgctaccagcagaacttggcatcccgagtaaacaaccaaccaactatttctgcaaaactttgacggcaagtgacaccagtactcatggtggattctctgtccctcgccgagcagcagaaaaagttttccctcctcttgattactctcagcagccaccctgtcaagagttgatagcaaaagatctccatgggaatgaatggaaattccggcatatttttcgcggacaaccgaagaggcatctattgacaaccggatggagtgtgtttgtgagtgcaaagagacttgttgcaggcgatgcagtcatctttatctggaacgaaaacaatcaattgcttttggggattcgacgtgctaatcgtcctcaaactgtcatgccttcttcagtcttgtcaagtgatagcatgcacattgggtctcctagctgcagcggctcatgcagctgcaactaatagccgctttacaatattttataatccagggcccagccatca

SEQ ID NO: 1615 - DNA, 617 bp, Zea mays
  Predicted polypeptide sequence is orthologous to G1451
tccaaagaattcggcacgacactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgcttgatgt

SEQ ID NO: 1616 - DNA, 512 bp, Sorghum propinquum
  Predicted polypeptide sequence is orthologous to G1451
gcacgagggttgctggcgactctgtcctttttatctggaatgacaacaaccagctgcttctgggaattcgtcgggcaaacagaccacaaactgtcatgccatcatcagtactttctagtgatagcatgcatattggtctgcttgctgcagcagctcatgctgcatcaacaaatagccggtttactattttctataatccaagagcaagcccttgtgaatttgtcatacccatggctaagtacgtcaaagctgtgtaccatacccgtatatctgtgggcatgcgtttccggatgctttttgagacagaggaatccagtgtaaggcgttacatggggacaattacaggaataagtgatctcgatcctgttcgctggccaaactcgcactggcgctcagtaaaggttggatgggacgagtcaactgctggagagaagcagccaagggtatctctttgggagattgaaccattgacaacttttccaatgtacccatctccttttgctcttggatta

SEQ ID NO: 1617 - DNA, 472 bp, Glycine max
  Predicted polypeptide sequence is orthologous to G1451
ccccaaggtcatagtgagcaggttgctgcatcaaccaacagggaagtagatgcacatattcctaattaccccaacttgccaccacaacttatctgtcagcttcacaatgtgacaatgcatgcagatgctgaaacagatgaagtatatgctcaaatgactctgcaacctctaagtccaagcaaaaggaggtgtatctgctgcctgcagaattgggtactcccagcaagcaaccaaccaactacttttgcaaaacattgactgcaagtgataccagcactcatggaggattttctgttcctcgaagagcagctgaaaaagtcttccctcctcttgattactcacagcagcctcctgctcaagaactaattgccagagatcttcatgataatgaatggaaattcaggcatatatttcgcggtcagcccaaaaggcatcttcttactacagggtggagtgtctttgtcagtgccaa

SEQ ID NO: 1618 - DNA, 484 bp, Sorghum bicolor
  Predicted polypeptide sequence is orthologous to G1451
gcacgaggggccatagtgagcaggttgctgcatcaactaataaagaagttgatgctcagatcccaaactacccaaacctacctccacaattaatctgccagcttcataatgtcacaatgcatgctgatgcggagactgaagaggtgtatgcccaaatgacactgcaaccattgagcccggaagaacaaaaggaaccttttcttccaatcgaattgggtgctggtagcaagcagccaactaattacttctgcaagacgttgactgcaagtgatacgagtacccatggtggattctctgttccgcgccgagcagctgagaaagtcttccccccattggatttttcacaacagcctccagttcaagagctggttgcaagagatctgcatgataatgagtggaaatttcggcacatttttcgtggtcagccaaaaaggcatctactgacgactggttggagtgtttttgtaagcgcaaaaagactagt

SEQ ID NO: 1619 - DNA, 485 bp, Hordeum vulgare
  Predicted polypeptide sequence is orthologous to G1451
cgtgatctgccagctgcacgacgtcacaatgcatgccgatgtggagaccgacgaagtgtacgcgcagatgacgctgcagccgctgaacccacaagagcagaacgacgcctacctgccggccgagatggggatcatgagcaagcagccgaccaactacttctgcaagacgctgacggccagcgacaccagcacgcacggcggcttctccgtgccccgccgtgccgccgagcgcgtcttcccccctctggatttcacgcagcagcctcctgctcaggagctaattgcgcgggatattcatgacgtcgagtggaagttcagacacatcttccgaggccagccaaaacgacacttgctaacaactggctggagtgtctttgttagcgccaaaagactcgttgctggagactcagtgctattcatatggaatgagaaaaaccagctttggctgggaatcaggcgtgccaaccggacacagactgtgatcg

SEQ ID NO: 1620 - DNA, 652 bp, Lycopersicon esculentum
  Predicted polypeptide sequence is orthologous to G1451
agaactatggcatgcttgtgctggtccccttgtttgtctaccaacggtagggagtcgagtggtttactttcctcagggtcacagtgaacaggtctttctcaaattaagctacattaattttgaactaattgttgcatatattagtatttagtcaattgctgatagttaccattggaattgagtgtaggttgcggcgacaactaataaagaagtcgatattcacatacctaattacccgaacttgccaccacagttgatctgtcaactccacaatgtcacaatgcatgtaggttcttttttcatattctatgttttcttatgaattagtgttgtgtaagttgtaatataggcttacgagggaatgacgattcctaggattttaggcagatgttgaaacggatgaagtatatgctcagatgacattgcaacccttgacactggtattttctgaacgatgcaataaagctcatttgcttttactgattaccggatattttgtgtgaattggtgacaaaatatgctgttgcattttcagcaagaacaaaaggacacgtatcttcctgttgaattgggtattcctagcaggcagcctactaattatttttgcaagacactcactgcaagtgataccagtacgcatggcggcttttct

SEQ ID NO: 1621 - protein, 908 aa, Oryza sativa
  Orthologous to G1451
MKLSPSAGGVSDQPPSPPEVAEEQKCLNSELWHACAGPLVSLPAVGSRVVYFPQGHSEQVAASTNKEMESQIPNYPNLPPQLICQLHNVTMHADAETDEVYAQMTLQPLSPQELKDPFLPAELGTASKQPTNYFCKTLTASDTSTHGGFSVPRRAAEKVFPPLDFTQQPPAQELMAKDLHGNEWKFRHIFRGQPKRHLLTTGWSVFVSAKRLVAGDSVLFIWNDSNQLLLGIRRANRPQTVMPSSVLSSDSMHIGLLAAAAHAASTNSRFTIFYNPRASPSEFVIPLAKYVKAVYHTRISVGMRFRMLFETEESSVRRYMGTITGISDLDPVRWMNSHWRSVKVGWDESTAGERQPRVSLWEIEPLTTFPMYPSPFPLRLKRPWPTGLPSLYGGKEDDLASSLMWLRDSQNTGFQSLNFGGLGMSPWMQPRLDSSLLGLQPDMYQTIAAAAALQNTTKQVSPAMLQFQQPQNIVGRSSLLSSQILQQAQPQFQQMYHQNINGNSIQGHSQPEYLQQPLQHCQSFNEQKPQLQPQQQQQESHQQQPQHQQMQQQKHLSNFQTVPNALSVFSQLSSTPQSTPSTLQTVSPFSQQHNFPDTNISCLSPSNVSSMHDTLRSFPSEAASDLPGVPRITPVPVSDPWSSKRVAVESTITSRPHDISSQIENFDLTPSSIPQNSTLAPLPGRECLVDQDGSSDPQNHFLFGVNIDSQSLLMQDGIPSLHNENSSSTIPYSTSNFLSPSQDDYPLSQTLTTPGCLDESGYVPCSDNADQVKRPHATFVKVYKSGTVGRLLDITRFSSYHELRSEVGRLFGLEGQLEDPLRSGWQLVFVDREDDVLLVGDDPWQEFVNSVSCIKILSPQEVQQMGKPGIELFSTSARRLGNSCDNYMSRQESRSLSTGIASVGSVEF

SEQ ID NO: 1622 - protein, 863 aa, Oryza sativa
  Orthologous to G1451
MSSSSAASIGPPQPPPPPAPPEEEKKCLNSELWHACAGPLVCLPTVGTRVVYFPQGHSEQVAASTNKEVEGHIPNYPNLPAQLICQLHDVTMHADVETDEVYAQMTLQPLNPVRRLGFLHDVCSAEVLMQEQNDAYLPAEMGIMSKQPTNYFCKTLTASDTSTHGGFSVPRRAAERVFPPLDFTQQPPAQELIARDIHDIEWKFRHIFRGQPKRHLLTTGWSVFVSAKRLVAGDSVLFIWNEKNQLLLGIRRASRPQTVMPSSVLSSDSMHIGLLAAAAHAAATNSRFTIFYNPRTSPHYLWEFYNWASIKIHNILMRPMHTLMKHRYMGTITEVSDADPVRWPSSYWRSVKVGWDESTAGERPPRVSLWEIEPLTTFPMYPSLFPLRVKHPWYSGVASLHDDSNALMWLRGVAGEGGFQSLNFQSPGIGSWGQQRLHPSLLSSDHDQYQAVVAAAAASQSGGYLKQQFLHLQQPMQSPQEHCNLNPLLQQQILQQASQQQIINPDAQNIQTMLSPSAIQQQLQQLQQMQQVQNDQKQKIQPDQSYQVPTSAVLPSPTSLPSHLREKFGFSDPNANSSSFITSSSSDNMLDSSFLQGSSKAVDLSRFNQPVASEQQQQQQQAWKQKFMGSQSVSFGGSVLHNSPTSKDGSVENKIGRDVQNQSLFSPQVDSSSLLYNMVPNLTSNVSDGNLSTIPSGSTYLQNAMYGCLDDSSGLLQNTGENDPATRTFVKVYKSGSVGRSLDITRFSNYAELREELGQMFGIKGQLDDPDRSGWQLVFVDRENDVLLLGDDPWEFINIYMNVSNAKKSYIMKRREYNTLVSWFPQLIAYRGKTVLPSIICVGQSLYVDAQLPKTLRESKHQT

SEQ ID NO: 1623 - protein, 662 aa, Oryza sativa
  Orthologous to G1451
MKLSPPASADMPQALPENDGEQRCLNSELWHACAGPLVSLPVVRSRVVYFPQGHSEQVAASTNKEVDAQIPNYPNLPPQLICQLHNVTMHADAETDEVYAQMTLQPLSPEEQKEPFLPMELGAASKQPTNYFCKTLTASDTSTHGGFSVPRRAAEKVFPPLDFSQQPPAQELIARDLHDNEWKFRHIFRGQPKRHLLTTGWSVFVSAKRLVAGDSVIFIWNDNNQLLLGIRRANRQQTVMPSSVLSSDSMHIGLLAAAAHAAATNSRFTIFYNPRASPSEFVIPLAKYVKAVYHTRVSVGMRFRMLFETEESSVRRYMGTITSISDLDSVRWPNSHWRSVKVGWDESTTGDKQPRVSLWEIEPLTTFPMYPSAFPLRLKRPWASGLPMHGMFNGGGNDDFARYSSLMWLRDGNRGTQSLNFQGHGVSPWLQPRIDSPLLGLKPDTYQQMAAAALEEIRYGDPSKQHPATLQYQQTHNLNSGLNSLFASHVLGQVQFQPQQSPLQVVQQGHCQNTGDSGFLQGQLPRLQLHNTQQLLKEQELQQQQRQHVLQEQSSQEMQQQLPSSDHHVADVASESGSAPQAQSSLLSGSSFYNQNLLEGNSDPPLHLHNNFHNFSYQEASNLLILPRSSQLMASDGWPSKRLTLESAVHPEAPSMHPKIEK

SEQ ID NO: 1624 - protein, 917 aa, Oryza sativa
  Orthologous to G1451
MRLSSSSGSVLPAQAASPEAVEEQKCLNSELWHACAGPLVSLPAVGSRVVYFPQGHSEQVAASTNKEMESQIPNYPNLPPQLICQLHNVTMHADAETDEVYAQMTLQPLSPQELKDPYLPAELGSANKQPTNYFCKTLTASDTSTHGGFSVPRRAAEKVFPPLDFTQQPPAQELIAKDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPSEFVIPLSKYVKAVYHTRISVGMRFRMLFETEESSVRRYMGTITGISDLDAARWPNSHWRSVKVGWDESTAGERQPRVSLWEIEPLTTFPMYPSPFPLRLKRPWPTGLPSLHGGKDDDLTSSLMWLRDSANPGFQSLNFGGLGMNPWMQPRFDASLLGLQPDMYQTIAATAFQDPTKQVSPTILQFQQPQNIGGRANTLLPSQILQQVQPQFQQQQYLQNINETTIQGHAQSEFLQQQLQRCQSFTEQKPQLQTQQQQQESQQQQQQQSQCMQVPQHQQMQQQKNMTNYQSVPNALSPFSQLSSPSQSSPMTLQTVLPFSQPQSYPDTSMSSLSPSNTSTMHNALRPFSSEAPSHLSMPRPTAVPVPDPWSSKRVAVESLLPSRPQVTSQMEQLDSTAPSIPQSSALAPLPGRGCLVDQDGNSDPQNHLLFGVNIDSQSLLMQGGIPSLQGENDSTAIPYSTSNFLSPSQNDFPLDQTLSSADCLDESGYVPCSQNSDQVINRPPATFVKVYKSGTYGRSLDITRFSSYHELRRELGRLFGLEGQLENPLRSGWQLVFVDREDDVLLVGDDPWQEFVNSVSCIKILSPQEVQQMGKPFELLSSAPGKRLGSSCDDYVSRQESRSLSTGIASVGSVEF

SEQ ID NO: 1625 - DNA, 1388 bp, Glycine max
  Predicted polypeptide sequence is orthologous to G1452
taaggctaatgcaacatattaataggaaagaagcagtttaacaaattgcctacgctttgtgtagcactaatcatgatttacacccgaaaattccccacaatacttgtcttgtttttgtcctctcactaaggacaaaaaatatagaaccatcaaagtgaaaacgaagaaagctaataccaccaaactgttggttgttctggcaaagaaggtattctttgatgagtgcattgtgcttgggaaacgaactactgcacgagaatgctttgaattcccaacccttaatcttattctccggtgtgctgggccttgtggggcaggttgcatctgtgtaggatcctgtgggcttgtgtgactctctaccaagactgatgattcatctaatttgatgatatcatcctttagtatctctgcataacaatcctcttcatacccctcctttggttgacctgaagattcagtgaaagtagcttcgttaactggtcgctgattcgattcggacacagaatcaatttgctccattgaaggagaaccataactgctactgtccctcttggagctacatccaacctctttgtcttgctcacaagcatccctttgatcaataccacctcctgagatagcacaaccactttcatgtgaattcaccggatgcctttgacttgatgaagctctattcgaagcatcgctcaaacggaactctgtgttcctcttgaggcgacaaatgaccaaagattcctgagatttgtcattaatgcagtactcgtgcataatccattcagtcctttcccctttaggtgcacgccctaagtggaacaccaaagtccgcttcgttcctataatgttggaacctgactttacattacgctctttgccagttgccttccagtatccacattcagttgctcttttactttgtgaaccatttgggtactttcttccgcggggagagaagaagaaccattcgttgtctgactgaatgaatgattgggctggtaaatcccaaggctcgtatttacaaagctcaccctcagaaatgacttgaacactctcctcatgaccctccaacttcttcctcaggtaataagaaatcaactcctcatcggtagggcagaatctgaatccaggaaacatggacgaagcagcaatcgacatctgagcctccctcgaaaccccttccatcatccaccaccctgctttttgcaccctcctctgtgttttttttttcctcaaccgattgccgacacaataatgaaaaaaaaagctagctacccagggtttaaggtggttgatggttataaacgaacagggttgctgtcggaagagttattccttgggggcagggaggggtggctccgcttatgaggttcaagtgtggttgtgctttgctt

SEQ ID NO: 1626 - DNA, 912 bp, Glycine max
  Predicted polypeptide sequence is orthologous to G1478
ggtttttggagacaaaaagtgagtatcagccattataattgctattgatataggttacaatatgagatgccaggaactaccatgacatacacttgtaagacatatcattgtatatctgccaacatagtataacttacttctgccagaaattcgctctcctgctttggaattggcttaaaataaaaataaccgtagaagtcaaatttcaattaaactaactacttctaccagaaattaaagaaataaaaaacattgcaaatgccctccttctattgaacacggttctattaccaaccattttttttaaatcatgacattaaaaacatttagcacttccctatgtacctgagatggtactcactaaccttttctattacaaaagatattctaaggagaaaaaaagaaagatggaagttataacaagagggaaaggttgttatgcattcttgagcactttctgtggattcctctgttgctagggagatttccaatggtccagttaatgttggctggaagaaccacctctattgatgctccaatgagatatcttcgcgtaaggttttgacatgtgttgcacagaaagcacctaatgtgcctaagggccaaaaaattagcttcatgaacccttttatcacattttctacacaagtatgcatcatcagcttgacaatacaatgaagcctgtaacccacatagctcacaacatgtagcacttctggttgcacattctttatgtagatagctgctgcagaaaccatgttgcttttctccttctgcacctttgcacatttttagaagctcaatgggataatgataataataataataataatcaagcttgctacttggtagtttcttgaacaaatgcccggcgcttgcgcgcgcccgcccgggcctcgaagcggccgccac

SEQ ID NO: 1627 - DNA, 497 bp, Glycine max
  Predicted polypeptide sequence is orthologous to G1478
cttttctattacaaaagatcttctacggagaataaagaaagatggaagttataaaaagagggaagggctgttatgcattcttgaacactttctgtagattcctctgttgttaaggagatttctaatggtccagtttatattggccggaagaaccacctctagtgatgctccaatgagatatcttcgcgtaaggttctgacatgtgttgcacagaaagcacctaatgtgcctaagggccaaaaaattagcttcatgaacccgtttatcgcattttttacacaagtaggcatcatcagcttggcaatacaatgaagcctgtaacccacatagctcacaacatatagcacttctggttgcactctctttatgtagaaagctgctgcagaaaccatgttgcttttctccttctgcacctttgcacattttcagaagctctatgtgatgataataataatcaagcttgctacttggtagtttcttgccccggcccgaattcc

SEQ ID NO: 1628 - DNA, 480 bp, Glycine max
  Predicted polypeptide sequence is orthologous to G1478
aaaaaattagcttcatgaacccttttatcacattttctacacaagtatgcatcatcagcttgacaatacaatgaagcctgtaacccacatagctcacaacatgtagcacttctggttgcacattctttatgtagatagctgctgcagaaaccatgttgcttttctccttctgcacctttgcacatttttagaagctcaatgggataatgataataataataataataatcaagcttgctacttggtagtttcttgaacaaatggtgtagcttggtgtagatgaatataagaatataaagcctttttataacaaagtgatcattctatggacgagttctactagacaaggacatggggtgccacttcttcacgtaatcacacgtgtctgtattttagtccatttgtcttttaccaatcttgcctaaaggtcaatttggtcattaaagatggagaaagaaatttgtgattccacttgttttg

SEQ ID NO: 1629 - DNA, 390 bp, Zea mays
  Predicted polypeptide sequence is orthologous to G1478
  misc_feature (325)..(325): n is a, c, g, or t
  misc_feature (337)..(337): n is a, c, g, or t
cggacgcgtgggcggacgcgtgggcggacgcgtgggcctggagggtgcaagggagggaggcggtcgaatccgtcatccactgagcaccgccagccccgcacgcggaggtcggagggctacgctccggagtccgaggggaaggcagaggaggcaagcaggccggatgggtgccgctggtgacgccgcggcagcgggcacgcggtgcgagctctgcgggggcgcggcggccgtgcactgcgccgcggactcggcgttcctctgcccgcgctgcgacgccaaggtgcacggcgccaacttcctggcgtccaggcacgtgaggcgccgnctgccgcgcggnggcgccgactccggggtgtccgcgtccgcgtccagcggctcctgcctgtccac

SEQ ID NO: 1630 - DNA, 1337 bp, Glycine max
  Predicted polypeptide sequence is orthologous to G1482
gaattcggctcgagggatggctcatttatcatagtagtgcttcctcctttaccatttgaccatatttatccatctcaatcacttcccactttttatgagcattggccaacccccacgcttcctttattctccctctcaagcttcaagctactcacaccaatgaagatccagtgcgacgtttgcaacaaacacgaggcctccgtcttctgcaccgccgatgaagccgccctctgcgacggctgcgaccaccgtgtccaccatgccaacaaactcgcctccaaacaccaacgcttctctcttctccgcccttctcctaaacaacaccctctctgcgatatttgccaggagagaagagcctttacattctgtcagcaagacagagcgattctctgcaaagagtgtgacgtgtcaattcactctgccaacgaacacacccttaagcacgataggttccttctcaccggtgttaaactttctgcttctgctatgcttcgttcgtcagaaactacctctgattcaaactcaaacccttctcttcttaacttttcacaccaaacaacattactacctccatcttccaccaccaccaccaccaccagcaacaacaacaacaacaaggttgctgttgaaggaactggttcaactagtgctagcagcatatcggagtatttgatagagactcttcctgggtggcaagttgaagactttcttgattcatattctgttccctttggtttctgtaagaatgatgaagtgttgccacggtttgatggtgaaatggaggggcatctgagttctttctcaaccgagaacatggggatctgggttcctcaagcgccaccaactcttatgtgttcttcacaaatggatcgggtgatagttcacggtgagaccaatatcaaaggtagcagcagatcaaggttgaaggatgataatttcactgttccacagattagtcctccttccaattccaagagagccagatttctgtggtagaaacaaataaacaaacaaacaagcctcagtttccattctcttgaggcagaattaacaaccctctttgttttgttttgtcccttttctctttttcttaccctggcttgtagtttactctgcccatgttttcaatttggttcagtttgactttttttttttccctttttcttgtttctcctccctctttccctactgggctgtgttttgataaatttgtgcacctttctactagtgattgtaaatataaaccttttcaaatgcatgttgttttttgacacatgtttagaagagaaacaacagagtatgagcttaatagatatgttgagtaaaattcccccccc

SEQ ID NO: 1631 - DNA, 1173 bp, Glycine max
  Predicted polypeptide sequence is orthologous to G1482
attcggctcgagccttcctttattctctcctcttaaacctttcacttcaagcttcaagttttcaagctacccacccactgctcatactcacacccaatgaagatccagtgcgacgtgtgcaacaaacacgaggcctccgtcttctgcacagccgacgaagccgccctctgcgacggctgcgaccaccgtgtccaccatgccaacaaactcgcctccaaacaccaacgcttctctcttctccgcccttctcataaacaacaccctctctgcgatatttgccaggagagaagagccttcacgttctgtcagcaagacagagcgattctctgcaaagagtgtgacgtgtcaattcactctgccaacgaacacacccttaagcacgataggttccttctcactggtgttaaactcgcagcttctgccatgcttcgttcatcacaaactacctctgattcaaactcaaccccttctcttcttaacgtttcacatcaaactactccacttccatcttccaccaccaccaccaccaccaacaacaacaacaacaaggttgctgttgaaggaactggttcaacgagtgctagcagcatatcagagtatttgatagagactcttcctgggtggcaagttgaggactttctcgattcatattttgttccctttggtttctgtaagaatgatgaagtgttgccacggttggatgctgacgtggaggggcatatgggttcgttttcaaccgagaacatggggatctgggttcctcaagcgccaccacctcttgtgtgttcttcacaaatggatcgggtgatagttcaaagtgagaccaacatcaaaggtagcagcatatcgaggttgaaggatgatactttcactgttccacagattagtcctccctccaattccaagagagccagatttctatggtagaaacaatcctctttgttttgttttgttttgtgccttctctctttttgttaccctggtttgtagcttactcttgcccttgttttcgatttggttctgtttgactttttttcttcttctttttcttggttctcctccctctttccctaccgggctgtgctttgaagtattgataaatttgtgcacctactagtgattgtaaatataaaccttttcaaatacatgttttttttgacacatgtttagaat

SEQ ID NO: 1632 - DNA, 857 bp, Glycine max
  Predicted polypeptide sequence is orthologous to G1482
attcggcgcgagcaaaagcaaaagatgaagatccagtgtgatgtgtgtgacaaagtggaagcctccgtcttctgtcctgcagatgaagctgctctttgccatagctgtgatcgcaccattcaccgcgccaacaagcttgcaaccaaacacgcccgtttctctctccactaccccacctccaaagacttccctctttgtgatatatgccaagagaggcgtgcatatctattttgccaagaagacagggcgttgttatgcagggaatgcgacgttcctatccacagagccaatgagcatacccaaaagcataacaggtttcttctcacgggtgtgaagctctctggtacttgtttagatcctgcttcgtcctccaccaattacaccaataataatagagtcactggctctgaaggaagaaacgacgctcgatctagaatgaacagacccagatcatcagtttccaatgaagaaaatgcaagtaattcttcttgcaaggttgaagacaacgtggctagtgacactggttcgatttcaactagcagcatttctgagtacttgattgaaacaatacccggttactgttttgaagacctccttgatgcttcgtttgcacctaatggtttctgtaagaagcagaactttgatcatccctgggcgtttcaggaccaaaagcgaacaagtggagacactatggccgtgccgttcctgaaactagtcatccattgatcaaaatatctaaaccctcgcggtcataaactgtttgtaaaaatctgttggaaaatatcttctttatttttgttatttgtaaaaatctgaaactttatgattttattttttattctctattcccaaccaca

SEQ ID NO: 1633 - DNA, 1242 bp, Glycine max
  Predicted polypeptide sequence is orthologous to G1482
acggctgcgagaagacgacagaaggggaatctttttgtaagaacgtgaaacatgacaccctaactcgcgttgcttgcttgagtgatttgactcgtgtcgagtgtattgtatttagtttaagcgtggctgatcgagtgagtatcagaatcaattcaattttgagctagtcatgaagatccactgcgacgtgtgtaacaagcaccaggcctctttcttctgcaccgccgacgaagctgccctatgcgacggctgcgaccaccgcgtccaccacgccaacaagctcgcctccaaacaccaacgcttctccctcacccacccctctgcgaaacattttcccctctgcgatgtttgccaggagagaagagccttcgtgttttgtcagcaagatagagcgattctgtgcaaagagtgtgacgtgcccattcattctgccaacgacctcaccaagaaccatagcaggtttcttctcactgggattaagttctctgcttctgccacgccttatgattattcatcaccaccaccaccaccaccaccaccacccaagagaaaccctgttctcgattctccttcaacaccgtcaccgcctaagcctgggggaaactcgctaacaaacgaagaagaacctggtttcacaggtagcagcatttcagagtacttgataaactctatcccaggcatgaagttcgaagatttcctcgattcacattctcttccctttgcttgctccaagaatagtgatgacatgttgtcgctgtttggtgagggaaacatggtttctttctcacccggtgggttctgggttcctcaagcaccaccatcttcagtacaaatggatcggcagagtgggtacagagagacaagggaaggtagcattagatcaagttttggagatgataatttcatagttccacagatgagtcctcccagcaatgtgtctaataagagatccaggcttctctggtaaaacagatatagctagttacaactagctaacccccttatgtggctttgtgtgacttaaatttcactctcccctcctattttgtattttttatgtggtattgttttaatttttgtttgttcgtttggttttggtccctctcccttcctgaactacactactcttctagctactttctctcttgataagttggtgtatctcttccaaattgtaaatatgaacgttttaagagctctctgggttgagataaaaaaaaaaaaaaaaaaaaaagcggccaa

SEQ ID NO: 1634 - DNA, 1111 bp, Glycine max
  Predicted polypeptide sequence is orthologous to G1482
ggctcgagttcaaatcctcctttctattaatctgaaacaagttattagtcatgaagatccagtgcgacgtgtgtaacaaacagcaggcatcgttgttctgcaccgccgacgaagccgccctatgcgacggctgcgaccaccgcgtccaccacgccaacaagctcgcctccaaacaccaacgcttctccctcagccacccctctgcaaaacattttcctctctgcgatgtttgccaggagagaagagcctttgtgttttgtcagcaagatagagcgattctgtgcaaagagtgtgacgtgcccgttcattctgccaacgacctcaccaagaaccataacaggtttcttctcactgggattaagttttctgccctcgattctccttcaacacctcctaagcctgcaggtggaaactccctaacaaatcaacaaccacaacaacaaactggtttcacaggtagcagcatatcagaatacttgataaacactatcccaggcatggagttcgaagatttcctcgattcacattctcttccctttgcttgctccaagaatagtgatgacatgatgttgtcgatgtttggttgagggaaacatggtttcgttctcagccggagggatctgggttcctcaagcaccatcttcagtacaaatggatcagcagagtgggtacaaagacacatgggaaactagcattagatcaagttttggggatgatagtttattagttccacagatgactcctcccagcaatgtgtttaataataagagatccaggcttctatggtaaaacagttacagctagctatcaagctaaccaccttatgtggcttttaatttcactctattcttaatttggttttctttgtttttttgtccctctcctccttcctgagtactacactactcttctagctacttaattccctcttgcgttctcgataagttgatgtatctcttccaaattgtaaatgtctatgttttaagagctctctgggttcagattaattgtttctgctacatgttaaaagatgactcaagtcttaattaacattgcataaatgaaccggaagaagacttaggcgatatcttcaaaaaaaaaaaaaaaaagg

SEQ ID NO: 1635 - DNA, 1018 bp, Oryza sativa
  Predicted polypeptide sequence is orthologous to G1482
  misc_feature (202)..(202): n is a, c, g, or t
ggcgactcgagcaaccacgcggtcgcagaagaaagagagagagagagatggcggcatgagcacctcctcctgcatcgccacctcccccgatcccccgcaaaccctagcgaccgcgccccccaccgtcatccttctctgcggcggcgccctggtgaggagggaggaggaggatggggaggtggagagggcggtcgctgcgacntgtgcgcggccgaggccggcctcggtcttgtggtgggcggacgaggccgcgctgtgcgacgcgtgcgaccgccgcgtccacagcgcgaacaggctcgccgggacgcgccggcggttctgcctcctccgaccggtggcgtggtggtggtccgcccagaagccaccggcgggcgcctcccgtcaggagaagagggggttcttgttctgcaaggaggacaggggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcaggtcagttcatccactgttaacgatccaaactttccatggcaacgaaaacctgaatacgtattcagtccggttcatgcatgaaaccctgaaaaaccaatccacacacgttcttgtgagcaccatgaacgaagcacaggcaaagcacggcgcgccaaactctgttcaggccctgccggccgtcgtgggcacataagccaatctgttcacaatatcgtgagcggacaaattttaccatgcaggtagtttgtagtcatgctcacacagctagcaataac

SEQ ID NO: 1636 - DNA, 478 bp, Oryza sativa
  Predicted polypeptide sequence is orthologous to G1482
gcacgcctcggacccgtccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgac

SEQ ID NO: 1637 - DNA, 1393 bp, Oryza sativa
  Predicted polypeptide sequence is orthologous to G1482
  misc_feature (1378)..(1378): n is a, c, g, or t
  misc_feature (1380)..(1380): n is a, c, g, or t
  misc_feature (1387)..(1387): n is a, c, g, or t
  misc_feature (1390)..(1390): n is a, c, g, or t
tttgttccctccacttcggcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtagggaggggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgcccgccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgtaaaantnaaaaaanttnaaa

SEQ ID NO: 1638 - DNA, 427 bp, Oryza sativa
  Predicted polypeptide sequence is orthologous to G1482
ccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcagagcgagctcaccatgcgccacagccggtacctcctcaccgtgcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccact

SEQ ID NO: 1639 - DNA, 700 bp, Zea mays
  Predicted polypeptide sequence is orthologous to G1482
  misc_feature (163)..(168): n is a, c, g, or t
  misc_feature (594)..(594): n is a, c, g, or t
  misc_feature (596)..(597): n is a, c, g, or t
  misc_feature (609)..(609): n is a, c, g, or t
  misc_feature (636)..(637): n is a, c, g, or t
  misc_feature (664)..(665): n is a, c, g, or t
  misc_feature (669)..(669): n is a, c, g, or t
  misc_feature (690)..(690): n is a, c, g, or t
gaattgttctctgtttcttttaagcggcaatgaagatccagtgtgatgtgtgtaacaaacacgaagcttctttattttgcaccgccgatgaagctgccttatgtgattcctgtgaccaccgtgtccaccatgctaacaagctcgcctacaaacaccaacgttnnnnnnttaatcacccttctgcagaacatttccctgtctgtgatgtttgcacggagagaaaggcttatgttttttgtcagcaagatagagcgattttgtgcaaagagtgtgacttgcctattcattctgcaaacgaacataccaagaagcataataagtttcttctaactgggattaagctctctgcttctgccaccctttattcatcactaccctcttctaattccaagtctgtgatgaaaaatcctgtgattgattcttcttcacaacaacctttgatggataagacttcttcttcaacagtatcagtgcctcccaccatcagcaaggctaatgaagaagctggtttcacaagtagcatatctgagtacttgataaatactatcccgggttggcaatttgaagatttgctcaattccccttctcttcctntnngtttctctaagnatggtgatgatatggtgtcactggtgnntggtgatgttgggggaaatatgttttnnttcncaccacccgagagcattggtnggatctggga

SEQ ID NO: 1640 - DNA, 1364 bp, Zea mays
  Predicted polypeptide sequence is orthologous to G1482
gaattcccgggtcgacccacgcgtccgcccacgcgtccggtcctctcctctgtctctctctctttgagcctcctttttcaacctaacctttgacgctgtagctcgagagcaagcatagtgcctagtgcctaccagattctctccctgagcggctgagctctgccgatccgcgataggctcgcgccatgcagatgctctgcgacgtctgcgccgccgcgccggccgccgtgatctgctgcgccgacgaggccgcgctctgctccgcctgcgaccgccgcgtccaccgcgccaacaagctcgcccacaagcaccgccgcatccccctcgcccagccctctggcgacgaatccgacgccgacgccaagccgctctgcgacgtgtgtaaggagcggaggggcctcgtgttctgcgtggaggaccgcgccatcctgtgccccgactgcgacgaccccatccacagcgccaacgacctcaccgccaagcacacccgcttcctcctcgtcggggccaagctctcagccgcgctcgtcgacgcccaggcgccccactcccctgacgacgacgacaacgactgcggccgcggcaacggcgccgccgccgagcccgacgctgtccccgccgtctgcgcgcagggctcctgcgcggccaaggcctcgtctcttgagtccggtggcggcggcggcggcggcagcggcagcggcagcagcatctccgagtacctcaccaacatctgcccaggctggcgcgtcgacgacctcctctttgacgactcggcgttctcagcggcatcgaaggccgacagctgcgacgacgggcacgagcaggtgccgtccctggacgccgacctcttcgacgtggtggctggcgccggctggccggggaagcgcggcagcgcgtggtcaggagtcggagctctgggcttcgacaaggtgccggcctccgttgttgtcgtcccgacggcggccaagcaacagcaggggtgcgtgagggagaggacctgggactcggacagcgacagcgacgtgttcgcggtgccggagctcccgcaaccaccgcaggccaagaaggcgcggccggcgccggctccggcgccgactttctggtgcttctgagctgcactgtcccagtccggtccggccggcctgtgtgcactgtgtacttgccgtgacttctgtaaccagtgtgtgtgagcgagcttgctcgtgctttttacccatgtactgttgttactgcatacacacacacacttaccactactattagtagctagcagtgctcaaacccaagttaattaagtttggcgcagtttatattatgacttaatcataaggtgattttgcggcggccggtcgagatcttgaact

SEQ ID NO: 1641 - DNA, 779 bp, Zea mays
  Predicted polypeptide sequence is orthologous to G1482
ctcgaggccggcccggcccgccatgtcctctcctctgttcctctccagcccccttttcaacctttgacgctgtagcttgagagcgagattagtgcctaccatattctcctcctgagcgactgagcgctggtctccgataggctcgccatgcaggtgctctgcgacgtctgcggcggcgcgccggccgccgtgctctgctgcactgacgaggccgcgctctgctccgcctgcgaccgccgcgtctaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttccacgtggtggccagcggccggccaggcaagcgcgtcggcgg

SEQ ID NO: 1642 - DNA, 1627 bp, Zea mays
  Predicted polypeptide sequence is orthologous to G1482
cgggatggtctacaaccgtatgcgtactttatcagttaactgcccatgatctagcagtggtccaatgtttgtcctagactcctagggggaaaaaagatctgcactttgtgctgtgctgtttcttcttcttgttgttgttgtacgtagcgccgagatttcccagcaccgcttgcgatttagaaacccacagtttgttctttttcgtttaggggatggctgtacactgctgctgcttcttactaatgatagaaaggagaggtgaagttcgcagttgctgagatagacagatgatagaaggcaacgctagctaccgcgagggggaggaagatgagcaatcgggaaagcacggcatcaagcaagttgttgccttgtagttgtaggagtgtccttattgcgactttgtcaccctggtgacctgagcgctcccacgcggccatgtctgatgaattacggcggcccattcgctcccatcagcaaacacccacgaatggccaatcgttgcccagcagcagcgggcttcagtattcgtcaaccaaattgtcagagagagtccttttgcgccccccggggcgcatactacagaggaggttgagcggagtaggcggcggccagcaatgaaggtacagtgcgacgtgtgcacggccgaggcggcctccgtcttctgctgcgccgacgaggccgcgctgtgcgacgcatgcgaccgccgtgtccaccgcgccaacaagctcgcggggaagcaccgccgcttctccctcctgcacccgtgttcttcctcttcctcctccgccgcgcacaagccgccgctctgcgacatctgccaggagcggaggggcttcttgttctgcaaggaggacagggcgatcctgtgccgggagtgcgacgcgccggtgcacagcgccagcgacatgacgaggcggcacagccggttcctgctcaccggcgtgcgcctctcgtcagcgccggtggactctgcgggcccatccgaagaggaggagcaggagaacagccgcggcccctgcaacgacgaatcctgcagcagcggcagcggcgccggcggcgcgaccacggcgaccgccagcgacgggagcagcatctccgagtacctgaccaagacgctgcccgggtggcacgtcgaggacttcctcattgacgacgcgtccgctggcgacgtcggcgcctgctcggatggcctctatcagggacaaaatggacagatcagtggggtgctgcaagaagcttacctgccgtggacggagcgggagcaggtgcaaactgacgtcgcagacgagcgggccagctgggagcggtgggtgccacagatgcatgcggagttcggcggcggcggcaagcgacctagagcgtcgccttcgcctccctgttcgtactggtgattggtgaaaagttcgccgtcttcagcaagatgatttgtattgggctaattagtagagctactgtaggaacgaccgaaaaatgagccaaaaaagtaacggcctccatcgagctcgttttaaattattctctgcctaaagccaaactttcagaaaggagaacggtattttcctgttcgattaattaggtcgatttcgatcgaactcgttccaaaaaaaaaaaaaaaaagggcggccgc

SEQ ID NO: 1643 - DNA, 835 bp, Zea mays
  Predicted polypeptide sequence is orthologous to G1482
ggtctagctaggactagtaagtagcataccattaccatcctccgcgcggctagctccggctcgctttcatccatacgattgcccggagctcaagccctgagctgagccgccagagcgcgcgcgatcatcgcttgagggaaaagcagagtggagtggccgagatgaaggtgcagtgcgacgtgtgcgcggccgaggcggccgaggtgttctgctgcgccgacgaggcggcgctgtgcgacgcgtgcgtaccgccgcgtgcaccgcgccaacaagctcgccggcaagcaccgccgcttctcgctgctcagcccggcgccaccgccgccgccgccgctctgcgacatctgccaggttcactcgatcatccatcccccgatccccgtgcaaaataaatctcttcggacggcgttctttccgattgttcagcctgccaggtgtgccctgcctgcctctgatcgatatgcatgcaggacaagcgggggctcctgttctgcaaggaggaccgcgccatcctgtgccgcgactgcgacgtgtcggtgcacacggccagcgacctgaccatgcgccacgcccggttcctgctcacgggcgtccgcctctccgccgagcccgccgccgcgtgcccggcgccggaggatgaggaggaggaggacgacgagaacagcagcggcagcttctgctgcagcgccggcgacgcagccgcacatcctcctcctcttccgtcgtcggcgcccgccaccagccacgggagcgacagcagcagcatctccgagtacctcaccaagacgctgcccgggtggcacgtcgaggacttcctggtggacgaggcggccgc

SEQ ID NO: 1644 - DNA, 727 bp, Zea mays
  Predicted polypeptide sequence is orthologous to G1482
  misc_feature (477)..(477): n is a, c, g, or t
  misc_feature (481)..(481): n is a, c, g, or t
  misc_feature (490)..(490): n is a, c, g, or t
  misc_feature (492)..(492): n is a, c, g, or t
  misc_feature (499)..(499): n is a, c, g, or t
  misc_feature (587)..(587): n is a, c, g, or t
  misc_feature (642)..(642): n is a, c, g, or t
  misc_feature (644)..(644): n is a, c, g, or t
  misc_feature (708)..(708): n is a, c, g, or t
ccggccgggctttcctgctaagccccggctagctaggaagtatcactagtagcatcccccatcatccagcctcgcggtcgctacagttagcttcgctttcctccagcccatccttctatacacgattgacctgagctgagccgcctcccgtctcgagagggagggagagggagagggagagcgagagctagcgcgcgcgatcgcaaagagagcggtgaaagatgaaggtgcagtgcgacgtgtgcgcggccgaggcggcgtctgtcttctgctgcgccgacgaggccgcgctgtgcgaggcgtgcgaccgccgcgtgcaccgcgccaacaagctcgccggcaagcaccgccggctctcgctgctcggcccggcggcgccgtcctcgtcggcgcacagacacccgccgccgcctccgctctgcgacatctgccaggagaagcgcgggctcctgttctgcaaggaggaccgggcgatcntgtnccgcgactncnacgtgcnggtgcacacggccagcgagctggcaatgcgccacacccggttcctgctcacgggcgtgcgcctctccgcagagcccgccgcgcgcccnccgccgtcggaggaggacgagaacgacagcagcagcagcagcatctccgagtacntnaccaagacgctgcccgggtggcatgtcgaggacttcctggtggacgagaccgccgccgcaactnccattggcgtctccgcaga

SEQ ID NO: 1645 - protein, 250 aa, Oryza sativa
  Orthologous to G1482
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAASSSSDGLFQGGLLAQIGGVPDGYAAWAGREQLHSGVAVAADERASRERWVPQMNAEWGAGSKRPRASPPCLYW

SEQ ID NO: 1646 - protein, 337 aa, Oryza sativa
  Orthologous to G1482
MRVQCDVCAAEPAAVLCCADEAALCSACDRRVHRANRLASKHRRLPLVHPSSSSSGDGGAAAAPLCDVCREKRGLVFCVEDRAILCADCDEPIHSANDLTAKHTRFLLVGAKLSPAALAEQPLPSSDCSSDDDAAAAATEEEYHSSAASTGAAVSAPLDASSNGAGGGGGVGGSSISDYLTTICPGWRVEDLLPDDDAFAAAAAVSTTNPSLRRVLATSPSMKPRLTYDSLEQQAGKEKDERVPFLDADLFDVVAGRPEKKGGAWAPHVPHLPAWCLDEVPVVVAASAAPAATPVKAKQGHVRDSHWSDSDAFAVPEFSPPPPPAKRARPSSQFWCF

SEQ ID NO: 1647 - DNA, 1129 bp, Glycine max
  Predicted polypeptide sequence is orthologous to G1488
acggctgcgagaagacgacagaagggggagttggaataccaattttggcgctctctctgtatttctcttccttctctttcatttcccctctcttgttggttcaaaattatactctctctaagttttaaccttatgaatatggatatgtgccaaaatgtatcagtttccggtgagtgccaacaagtgcaggtttttgccccttcttgctcaagcagccttgatgacctcttctctgctcagaacacggaagtggatgttgagttggagtggctttcagagtttgttgaagactgtttttcaagccctccaagctgtgtcttggtacctattggtgtcaagactacaagcacaagcaccaacctttcttcaggcacattgaagagaccccaacaacaaaatgagtcacctttgcaaaactttgctgtgccagggaaggcaaggagcaaaaggaagaggctttcagccccaagaaccaacaaagaccctctaaacatatggtcacaccatttgaatcctcaaaatgagtccttgtgttctgaccctcctcttctcaaacaggcttattggttagctgacagtgagctcatcatgccaaagccaaaggatgaggagcaagaagaggtggtgaccaaagaggatgaaaaagtgattaatgtgatgagcaaggaaagctttggggactctgagcttgaggagggtagcaatggtcaacaaccaatgccaacaaggaggtgcagccattgcttggctcagaggaccccgcagtggagggcaggaccattaggtccaaagacactatgcaatgcatgtggagtgaggtacaagtctggtaggttgctaccagagtataggccagccaagagtcctacttttgttagctacttgcactccaattcccacaagaaagtcatggagatgaggatggctgttttctccaccatttctagtgagcagtagtagtggttgttacttattagaggtatatttctatgtaaaaaaaaaaaatcaaacttcaaattttaggaacaaaaaactatttggcaaacagagagatactgttaaggggagagtgcttaatgctatgattgattataggcacatttatttatatgacttattatccagtttc

SEQ ID NO: 1648 - DNA, 1230 bp, Glycine max
  Predicted polypeptide sequence is orthologous to G1488
ggaaaaccacaactttgtcacactttgtgtctccaactccctatactttctcgcttcaccctccccggtaacgttttcgcttcagcccacaacgagccatggaagcacaagagtttttccagaacaccttctgtccccaattcccctcagacagcaacatcactccctccaacgccaacccctccgccgccaccaccgaccacttcctcgtagaagacttcttcgacttctccaacgacgacgacgccaccttcgactccctccccaccgacgtcgactcccccaccgttacccctgtcgacaccaccaccaactccaatttccccgcctccgcagacgcccatttccccggtgacctctccgtcccgtatgatgatcttgcggaattggaatggctgtcgaaatttgcggacgaatcgttttcgagcgaggatttgcagaagctgcagctgataacgggtgtgagagcgcaaaacgatgctgcatcgtctgaaacgcgtgacccaaacccggttatgttcaacccgcaagtgtcggttcggggcaaggctcggagcaagcggacacgtggacccccatgcaactggacctctcgcctcgttgtgctctccccgaacacgaagtcgtcgtcgtcttctcactccggcgcggaaggcggcagcgaggggcggaagtgcctgcattgcgcaacggacaagaccccacagtggcggactgggcccatgggcccaaaaacgctctgcaacgcgtgcggcgtgaggtacaagtctgggcggctggtgccagagtacaggcccgccgcgagcccaacgtttgttctgacgaagcactcgaattcgcaccgcaaggtgctggagctgcggcggcagaaggaaatggtgaaggtccagcaccagcagcatcagtttctccaattgcagcatcagcagaacatgatgttcgatgtcccatcatccaacggtgaggatttcctcatccatcagcacgtgggcccaaatttcacgcacctcatctagagtaggaaacttccgctacttaatttgtagttagctcagttatttcttctcttctcttttcttttcttgcctaattttgttaggaatttgtttaatttctttttcagtttatgctatatgtagactggtctcatgtttctttcttcaagtcattttgaccgacttgaaaacccacaaactctaaattttcctaatgcattattcttttcttttc

SEQ ID NO: 1649 - DNA, 567 bp, Glycine max
  Predicted polypeptide sequence is orthologous to G1488
ccacgcgcctgctccacctggtcgcgccggagaaggagaagccgccgcaggcgaagaaagagagagggaacgaatgtggagtgttccggacgcaaatgccttcactgcggcgcggagaagacgccgcagtggcgaacgggaccgatgggaccgaaaactctatgcaacgcgtgcggcgtgaggttcaagtccgggaggctggtgccggaataccggccggcggcgagtccaacgttcatgtcaacgaagcattcgaattcgcatcggaaggttttggagctcaggcggcagaaggagatgcaacgacagcagcatcatcagcagttgatgagtcaaagttcaattttcggcgtatccaacggtggagatgaattctcgatccatcatcatcatcataatcatcacctccattgtgggccagactttagacacgttatttagactacctagtttttaaattttcattttaattttaatttagggtgcaggtctaagtttaaactatcgtcagcttcagcacttcttttttcttatctgaaaaattttgtcttatgaatttgaattctt

SEQ ID NO: 1650 - DNA, 1022 bp, Oryza sativa
  Predicted polypeptide sequence is orthologous to G1488
  misc_feature (642)..(643): n is a, c, g, or t
  misc_feature (724)..(724): n is a, c, g, or t
  misc_feature (728)..(728): n is a, c, g, or t
  misc_feature (777)..(778): n is a, c, g, or t
  misc_feature (780)..(780): n is a, c, g, or t
  misc_feature (782)..(782): n is a, c, g, or t
  misc_feature (785)..(790): n is a, c, g, or t
  misc_feature (792)..(792): n is a, c, g, or t
  misc_feature (794)..(810): n is a, c, g, or t
gtcgggcaccgcggcgccggcattcccggccaagaaggcggcgaagtccgccaagaagaaggacgggccgtcccccgcgccggcgccgaacgcggccgcgcaggcggcggcggaggggaggaggtgcctccactgcgagacggacaagacgccgcagtggaggacggggcccatgggtcccaagacgctgtgcaacgcgtgcggggtgcggtacaagtccgggcggctcgtgccggagtaccggccggcggcgagcccgacgttcgtggtgtccaagcactccaactcccaccgcaaggtggtggagctgcggcgccagaaggagatgcagctcctgcaccaccaccagcagccgccgccgcacgtgggcgcgggcggcggcggcgccgccggagggctgctccacgtgacgagcccgctgctgttcgacgggccgacgtcgtcggcgccgctcttcgccggcgcggacgaattcctgatccataaccgcataagcccggactaccggcgccaggctacctaggaaactattcattagcccaggaataattcagcgataaaaacagctaatttttttttgtcctgcaaaccgcattttgggtactctttatttctcagcttcttaagtttcttttttctttnnttgagaattttagtgtttttcccccttagaagcagactctgaggagtttctttcgtagcacatttttttttcttttgattnttgnatgcaggactcttagaagaagaggaacaggagcagttttcattgtttcnncnanaannnnnntntnnnnnnnnnnnnnnnnnctcttgaggggggcccggacccaattcgccctttatgagtgtttaccgccctacatggccgtgttttacacgtgggaatggaaaacctgcgttcccactaatggcttgagaaaatcccttttcagatggtaattacaaaggccgaccatgcctttccaaatgccccctaattggatggaacccctttacgcctttaaacgggggggttgtct

SEQ ID NO: 1651 - DNA, 1897 bp, Oryza sativa
  Predicted polypeptide sequence is orthologous to G1488
ctagtggatccccgggctgcaggtgtcgtttgcagtgtgatgagctggacatggacattgcgcagctggagtggctgtcggggctgttcgacgatgaaccatcccgcacgagccgagttttccgggcgtcaactgcgcggcgccgatcaaggcgtcggcgctgacggcgaacgccggcgtcgtgctgccggacaaggcggaggaggcgctgttccgcagctccagccccatctccgtgctggagcacagcggcttcaacgtggcaaccaatgggggctcctcctcgtcgtcctcctcgtcggcgtcctcctcgtcggagtcgttctccggcagcggccgcgcgtggtccgcgcccgtgtcgccgcgcccggagccgcccgtgctcgtcatcccggcgcgcgcgcgcagcaaacggtctaggccgtccgcgttcccggctgtccgcggcgcgccggcggcgacggagaccaccatcctggtgccgacgccaatgtactcgtccacctcgtcgcactcggatcccgagagcattgccgagtccaacccgcacccgccgccgatgaagaagaagaagaaggccaagaagccggccgctccggccgccgcctctgacgccgaggccgacgccgacgcggcggacgccgactacgaggaaggcggcgcgctcgcgctcccgccgggcaccgtgcggcggtgcacgcattgccagatcgagaagacgccgcagtggcgcgcgggcccgctcggccccaagacgctctgcaacgcgtgcggcgtccgctacaagtccggccgcctcttcccggagtaccgcccggcggcgagccccaccttcatgccgtccatccattccaactcccacaagaaggtggtggagatgcgccagaaggcaacccggaccgccgacccgtcctgcgacctcctgcagtacatccgccgccgggattaatctcccggcggcggcggcggcgtcgtcggaggacggttggtcgtcggtctcagtcccccttagctatatatgtatacatgttagtatgtatgcatgcatgcttgcttcagtcgtcagtgcgtcgtcttcctcgtcatcaccatcaccatggacatggacatggacagcagtgtgatcatcagcagcattgccctcctgaagccatcatccatcatcgatcaccgcccgctctgcggcggctgccatcggcaccagcatcagcatcatcatcaatccatggatcgatcgccggggtcatactggcgttagtgcagctagggcttttcttggggttttatttttttcctttttgtctattgattaattggttccccttaaaaagatgattttttggttttgtatagaggtgggtgagagagagagaggaggaggccacgcagaaaatagatgaatcaccgtggttgttgcattgcagatttgcagttgcttgcaaaattaggtaggtgagaaggagagctaaaccagcagcagagggagacagatttagagaggaaaactttgcagctagtcagtcagtcaattaggaggaggaaaatgagatgtgttttttttaaggggggtgatgaggaggtggagtttgttggtttgctaattagaagtttcttcttgctagtagctactcaggggggacatccatcatagtttatattggagcttgatgtactgaactccgaaaaattctttttgcagttcatctatgtctagggattgataagtgttatttggtttctatactagccattactttgtagccattaattatatatctctatatgccttttttctgtttctcctgccttgttggttggtggtgcctccctctgtacaagttgtgatcatccaatttgaggagatatattcctttatgctctgaaaaaaaaaaaaaaa

SEQ ID NO: 1652 - DNA, 487 bp, Zea mays
  Predicted polypeptide sequence is orthologous to G1488
ctctgaacggggtgagtacccccgccgcctccgaggacggtacccgcggtggcgccgtcgttagcgccagcggtgtacctcgtcaagaagaagaaaaatcggtttcggcgaggaagccgtggcggcccccgaagtcggcgaagcagtgcttgcactgcgggtcgtcgtggacgccgcagtggcgggaagggccgttgggccgcagcacgctgtgcaacgcgtgcggtgtgcggtacaggcagggtcggttgctgccggagtaccggccgctggcgagccccaccttcgagccgtaggagcacgccaacaagcacagtcaggtgatgcagtttcaccggtagtggaagagccagggtcagtaccaccctgtgtccgtggagcatacgtgagccatggacgtgcttcagttttcccagcggtggcaggtgaaggaggagtaccttgtgagggcgattcaccagactttgccgtatccggtggtggacgg

SEQ ID NO: 1653 - DNA, 792 bp, Zea mays
  Predicted polypeptide sequence is orthologous to G1488
  misc_feature (714)..(714): n is a, c, g, or t
ctctcgcccctcgcgttatctccgctcccctcgcgcagcccacgtacaaaacgaaacaaaaaagcgccgagtaacgcactgccccgccgcagatagagaattgcggtgcctaccgctctcgcggcggccatggaggcgacggtgcccgactactacggccgcgacaagaagggctccgacctcttcgtcgtcgacgacctcctcgcgctgccgtgcgacgacgacgaggaggaggaggaaggggttggcgaggcgccgttcctgccggccaactccgcctccgccgccgccatcgtcgtcaagcaggaggccgggttcgggaacgcgtcggccgactcgtccacggtcacggccctcgacagctgcagcaactccttctccggcctcgccgatggcgacttctccggcggcctctgcgagccgtacgatcagctggcggagctggaatggctgtccaactacatgggcgagggcgaggagagcttcgccaccgaggacctacacaagctgcagctcatctccggcatcccctccgggggcttcccctcggcgaacggaccacctgctccggcggccaccgctgccacggcgcagcccggcatgttcctgccggagggccccgtccccgccaaggcccgtagcaagcgctcccgcgttgcgccgggcaactggtcgtcccgcctgctcgttctcccgccggcccgggcctcccgncgtcccccggcgtcatggccatctcgccggcagagtccggcgtctcagcccaggcattccatgtcaagaagccctcca

SEQ ID NO: 1654 - DNA, 615 bp, Zea mays
  Predicted polypeptide sequence is orthologous to G1488
  misc_feature (65)..(65): n is a, c, g, or t
gggcatgaggctcaagccagagcccaggttgtcagccgagcagcagtgcggccaggaagaacccnccaggaaggagcaagagccagacaggaagaggaagaaggcggccaagaagacgtgctacgagagcagcgacgcccccccgtcgtcgggccagcaagagaagcggtgcgccccctgcctgtcctccaagaccccccagtggagggcggggcctctggggcccaagaccctgtgcaacgcctgcggcgtcaggttcaagtccggcaggctgctgcccgagtaccggcccgccaacagccccccctttgtgagctgcttgccctccaactcccccaagaaggtcatgcagatgcggcaggccgtcgcgcagcagcagtgaggccccgatggccggccggccggccgagaacgtctcccgaaatctatcgttggaagcgcgttaggggatctcttagaccgtagcttagtcgatgctcagagaggatgagaacagagactttggttatagtagtagtaggccatcgtcgttagctctagcggtgttctagctcagactgatttgctcggtgtttttagacgtcggattccatacattctcgatgttgtcctggt

SEQ ID NO: 1655 - protein, 386 aa, Oryza sativa
  Orthologous to G1488
MEVAAADYAGGVRVKKEAGGCGGSGDMFLVDDLLDLPCDEEEEETGLCGAYGGGGAGLGAGVVGGGGDDRAAGNASADSSTVTAVDSCSNSFSGLADGDFSGGLCEPYEQLAELEWVSTYMGEETLPTEDLRKLQLISGIPAAPRAPPALAVSAVQLPAGGAGALPTEAPVPGKARSKRSRVAPCSWSSRLMVLPPPPASPPSPASAVISPSESGTAAPAFPAKKAAKSAKKKDGPSPAPAPNAAAQAAAEGRRCLHCETDKTPQWRTGPMGPKTLCNACGVRYKSGRLVPEYRPAASPTFVVSKHSNSHRKVVELRRQKEMQLLHHHQQPPPHVGAGGGGAAGGLLHVTSPLLFDGPTSSAPLFAGADEFLIHNRISPDYRRQAT

SEQ ID NO: 1656 - protein, 271 aa, Oryza sativa
  Orthologous to G1488
MRKPTPYVSLHDVVAFDFVDGDVPFDDLVDGEGLCCPDDPFEEVMRCLSAVDDPFLAAFKLDCSPPTPAADADVDSRSEEHMHADVGGGLDLQRAVGGGDEKAGTPSTVDDVPWLQASAVARKPRRAPAAVRKRVWSLVSPQLATAAAAAVDNSRDEVSSGGGGGGEGGEHCSRPAKRRRKCGEEKRCGHCQTTETPQWRVGPDGPSTLCNACGIRYRIDHLLPEYRPSTSPGFGSDGYSNRHRKVVKLREKKRKKAMLAATATALTSGPV

SEQ ID NO: 1657 - protein, 387 aa, Oryza sativa
  Orthologous to G1488
MEVTAEFGGAYYGGAAGREKKALQQGCGDHFAVDDLLVLPYGEEDETTREGEATGGKEEAAGFGNASADSSTITALDSCSNSFGLADGDFPGELCEPYDQLAELEWLSNYMNEGDDAFATEDLQKLQLISGIPSGGFSTASVPSAQAQAASAAASMAVQPGGFLPEAPVPAKARSKRSRAAPGNWSSRLLVLPPPPASPPSPASMAISPAESGVSAHAFPIKKPSKPAKKKDAPAPPAQAQLSSVPVHSGGSAPAAAAGEGRRCLHCETDKTPQWRTGPMGPKTLCNACGVRYKSGRLVPEYRPAASPTFMVSKHSNSHRKVLELRRQKEMHQQTPHHHQPQVAAAGGVGSLMHMQSSMLFDGVSPVVSGDDFLIHHHLRTDFRPPI

SEQ ID NO: 1658 - protein, 303 aa, Oryza sativa
  Orthologous to G1499
MTHNSSSSSSWDLDMSLGSHHHPLLFDQPPPPPPPPPPPPLPFHLHHHPLDPSPSSSLFPPPPHHHHHAHHLHHPLDLDQRRGHHDYGGGDQGGDEELRLQQEAAAGGGGGGQDGGGGGDQDADEELGAMKEMMYRIAAMQPVDIDPATIKKPRRRNVRISDDPQSVAARHRRERISERIRILQRLVPGGTKMDTASMLDEAIRYIKFLKRQVQELQHQPGPPPPPYPAGAAPAAGPSTSAVGPPGRPFLPLGGGGPMIDWVGLTRPVDIHGPTSSSSSSSMGGALGFGFGCGGGGQSSHGMH

SEQ ID NO: 1659 - DNA, 360 bp, Brassica rapa subsp. pekinensis
  Predicted polypeptide sequence is orthologous to G1499
cactactcttttctccggagatcaagaagaggatgaagacgaagaagagcctgtagaggaactaagtgctatgaaagaaatgatgtacaaaatcgcagccatgcagcccgtcgacatcgatccagcaaccgtcaagaaacccaaacgccgtaacgttagaatctccgacgaccctcagagcgtggcagcgagacaccgtcgtgagagaatcagcgagaggatcagaatcctccagagactcgtgccgggtggcaccaagatggatacagcttcaatgctcgacgaagcaatacgctacgtcaagttcttgaaacggcagatccggcttctcaataatcctcctccgcgcaagatcaagct

SEQ ID NO: 1660 - DNA, 1501 bp, Glycine max
  Predicted polypeptide sequence is orthologous to G1519
ccacgcgtccgaaaaaccgaataccccgggcggcccgcgcgccccggaaggcatggctcagattccgttgacggcgcggtggccggtcctagcacctccgccaccgaaccacggcggttccctctcgcagctcagccggaaatgatgcgcgccgccgagaaggacgatcaatacgcctccttcgtttacgaagcctgtcgcgacgcatttcgccacctctttggtaccagagttgcggtggcttaccaaaacgagacgaaacttttagggcagatgctttactatgttctcactactggctcgggacagcaaaccctgggagaggagtactgcgacatcactcaggttgcaggaccttatggacttcctcctacccctgcgaggcgtgctcttttcgttgtatatcagactgctattccttatattgcagaacgaattagttctagaattgcttcgcgaggcattgtccttgctgactatgagtctgctgagggttttggtgaaaatgcccacaggagccatagtgctcagatttctggcaccagtccttcatcctcgtctggccaatctgttactactctgtcaaggttgaaggggaaaatgagtgcattttggttgcatttggttcagagatggcctacgatgctcccttttgtccgtgagttgttgcagttggttctccgtgctaacctcatgctattctactttgaaggtctctattatcatatatccaaacgtgcggcaggcattcgttatgtatttattggaaaagcatcaaatcaaaggcccagataccaaatactgggagtatttttgttgattcaactttgtataatagctgctgaagggctgcgtcgaagaaatttaacttcaattactggttcagttcatcaagcatccttcgcaacccacgatagatcagcaggacatggtttgcctgttttaaatgaagagggtaatttggcaactccagatattgacaaaagaagctgggtctctgaatcttcatcttctgagtatcatgcaaccagtggggttagcaaatgcacactttgcctgagtaatcgtcagcacccaactgctacttcatgtggccatgtattctgctggaactgtatcacggaatggtgcaacgaaaagccagagtgccctctttgtcgcacgcccataacacactcgagtctagtttgtgtatatcattcggacttctagagtctgctcctctttacgtacatatatagaagatagcattaaaggcagcattttcctcatcttggatcttacaaggactgtatgaacatttaagcaattcaattttgtattaggatttcaataatcaatctgattacactattaggtccgtgtttcatctcttttattatgcaataatgatttttttttttttttggaaaaagataaccattatagcacaacactggatggtgattctgcattaattatttctctccagtgggtggtgctaatgaggtttatgccagta

SEQ ID NO: 1661 - DNA, 834 bp, Oryza sativa
  Predicted polypeptide sequence is orthologous to G1519
attgggaagccattgaatcagaggcccattatcaaatcttgggtatttttctgtgtagttcaggtatgtattcttggtgctgaaagacttccaagaagtaatttatcaacaatagctagttcgattaaccaaatctcatctggaggctatccttcatcaagaggtcgaggtgtccctgttctaaatgaagatggaaatataatcagcgacatccgccatgggaaaactgcagatttggctactagttcagaggcatccaggggtaagagcaaatgcaccctttgtctcagttcccgtcagaatcccactgccacaacctgtggccatgtcttctgctggagttgcattatggagtggtgtaatgagaagcctgaatgccccctatgcagaactccgattacacattcgagtttgatttgtatatatcattcagatttctagcaaatgattactagcaaggggtcatatcattctccagtggattcattaaaatgatactgaatccccacattttggcgagaactcttcttctgaagtgttttagtgtaccaaaagaggagagtagaaaccatccaatgaggctgaagatcaatgctgccattcaactgtattgtagagctcaaataacaaaacaatcaaacagaacaaaattttcattagagctcaaacggatacccatgtatatgtacattgtagacacaacttgattttgtagggtagaacagtggctgactggaatcattagagcaaaatgtatcgacctgaaattctgccgggaaatttaactatttgccaatattagattcgacaattattcaaaaaaaaaaaaaaaaa

SEQ ID NO: 1662 - DNA, 337 bp, Zea mays
  Predicted polypeptide sequence is orthologous to G1519
gtcctagtaatgttaaaccaggtcggagcatccatcttgtaaatgaaggtggaaatatagtcagtatcatccgcagtggtaaagctgcagatatagcttctcattcagagacctccaatggcaagagcaaatgcaccttgtgtctcagcatccggcaaaatcctactgccacaacctgtggacatgttttctgctgtgcaggaactcaatatagtttggtcactatgaagccaagcagcagttcggacaaccaggtgatttgtcaagctctcttggaggctgcagctcactgtgcatgtgagaaaacaactggtttgagaagtttggttcctaaaac

SEQ ID NO: 1663 - DNA, 929 bp, Zea mays
  Predicted polypeptide sequence is orthologous to G1519
ccacgcgtccgtctaatgttcttctattttgaaggtctgtattatcatttgccaaagcgagcagctggtattcgctatgtattcattggcaagccaatgaatcagagacctaggtatcagatcttgggtatttttctgttgattcagttgtgtattcttggagctgaaagactccgaagaagtaatatatcgtcaatagctagttccattaatcaaatatcatctggaggctatccatcgactacaggtcggggcatccctgttctaaatgaagatggaaatatcatcagtgacatccgcagtggtaaagctgcagatatagcttctcattcagagacctccaatggcaagagcaaatgcaccctttgtctcagcatccggcaaaatcctactgccacaacctgtggacatgttttctgctggaattgcataatggagtggtgcaatgagaagcctgagtgccccctatgcagaactccgattacccattcgagtttgatttgtatatatcattcagatttctagcaaatcatttcgcacagtaggagtccatatcatacttcactggcgtcaaaatttccagaccatatttcggcaagaaaactgcatgccaaaatggtttcgtatacttaagtgggagaagagtacgagaccatttcaagaggttaaagatcagagagttgcatacgataatttgttgtaggttgaaagtttagattgaattagggaccacaggtagtagaaattatttattggcagttcggatagtagataacttgtattggacaccgatgtgaattttattggttagaacaatgtccgactcgaatcatcgagctatttagcaatatgttgtgtccattttcgtcgcacttataccagcttgtatgttttgactaagttaggtgcaggtatgttattataatttt

SEQ ID NO: 1664 - DNA, 510 bp, Lycopersicon esculentum
  Predicted polypeptide sequence is orthologous to G1519
gtctggcacataaacatttctgaaatagtgacttttggctccttgtcttctgaaagatcccagttggacattattggctgctcaaaatgttcttttcgtgcagatatcaaatactaggggtcttccttctaattcaattatgtattcttgctgctgaaggtctgagacgtagtagtttatcatcggtttcaacttctgctcaacaagcaccctttggaacctatcaaacttctgcaggccgaggtttaccagttttaaatgaggaaggcaatctaataactgcagaaactgagaagtatggattggttgctgaatccacatcaacctcagagtctcaaggaaacagtccaagcaaatgcacactttgcctaagcagccgccaacatccaacagccacaccttgtggtcatgtattttgctggtattgactcctgaaagtttctctttatagaaaacctaaaaaagagaggtaaatgtgaaagaagagggaaaagacataatgctcttacc

SEQ ID NO: 1665 - DNA, 428 bp, Glycine max
  Predicted polypeptide sequence is orthologous to G1526
cgtgttcttcataattatgcttcaatattggagttacttttacgtcttcggcaatgttgtgatcatccatttcttgtaatgagtcgaggtgatactcaagaatttgcggatctaaacaaactagccaagcgcttccttagaggaacctatactgcttcagaaggtgaagtaaaagatacaccttcacgggcttatgttcaagaagttgtggaagagctacgtaaaggggagcaaggagagtgtccaatatgtcttgaagtatttgaagatgcagtgttaacgccttgtgctcaccgcttatgccgggaatgcctcttgtcaagttggcgaaatgctacatctggcttatgtcctgtttgtaggaaaacaatcagcaggctggatcttatcactgcccctactgagaatcggtttcaggtggatattga

SEQ ID NO: 1666 - DNA, 723 bp, Oryza sativa
  Predicted polypeptide sequence is orthologous to G1526
  misc_feature (657)..(657): n is a, c, g, or t
  misc_feature (663)..(663): n is a, c, g, or t
  misc_feature (673)..(673): n is a, c, g, or t
gccagttctagatgcacgtgctaacataggtcggcgcgcccgcccgtattacaagatttttcaagcatttggccttgtgaggaaggttgagaaaggcataactcgatggtattatccatctatgcttgatgatttggcatttgattcggctgcacttggaattgcccttgaaaagccgctggatttggtgaggctttatttgtctagggcaaccttgatagtggtacctgctaacttaattgatcactggacaacacagatacagcggcatgtttcctcggacacacttaatgtttatgtatggggagatcacaagaaaccatctgctcacaaccttgcatgggactatgacattgtcataaccacatttagtagattaagtgcagaatggggtccaaagaagagaagtgttttaaagcagatccattggtttagggtaatattagatgaaggacacacattaggttccagtctcgccctcacaaacaaattgcagatggctgtttcattggttgcttctaatagatggattctaactggtacccctacgccaaacacaccaactagtcaagttgctcaccttcatcccatgcttaagtttcttcatgaggaagtttacggtcaaaactaccagtcatgggacactggaaatcatangccttntgaggcacanatggaaagacgacgcagtcgtctcctgcagctacttcagaggactatgat

SEQ ID NO: 1667 - DNA, 600 bp, Oryza sativa
  Predicted polypeptide sequence is orthologous to G1526
gcacgaggctcaatattatacatccttcctttctttcgataattataatttctggttttagcatatccattttattaactgaacaataaattataagattctggcagatgcaatgggactggggaagactattatgacaatagctcttcttcttgccgactctagcaaaggatgcgtcactactcagcattctactcacatatgtgaagaagctagtggactgggtgaattgccagttcagcctcatgatgatgtgaagaagctagctatccctttctcttttagtaagcttaggaaacctaaaaccccgcttattgcaggcggcaatctaattgtctgcccaatgacactacttggtcagtggaaggcagaaattgaagctcatgctacaccaggttctgtaagtatatatgttcattatgggcaaaacagaccaaaagaagcaaaccttattggtcagagtgatattgtcctgactacatatggtgttctgtcatcggaattttcaaacgagaattcaacagaaagtgggggtctgtactctatacattggtttagagttgtgctggatgaagcacacatgataaaatctcccaaaag

SEQ ID NO: 1668 - DNA, 2051 bp, Zea mays
  Predicted polypeptide sequence is orthologous to G1526
gagcttatctagtcggcggccgctcgcctcctgggccggcccggttagcaaacacaagaaacctaaggccccactttattggaggaagcaatctaattatctgtccaatgacactaattagtcagtggaaggcagagattgaagctcatactaagccaggcactgcgaatatatatgttcactatggacaaaacaggccaaaagatgcaagcatcattggtcagagtgatattgtcctgactacatatggtgttgtgtcatcagagttttcaatcgatggttcaacagaaaatggggctttgtactctgtacattggttcagagttgtgcttgacgaagcacacatgataaaatcttctaaaagtttgatatccctagctgcggctgctctgactgcagatcggcgctggtgtctcactggtacaccaattcagaacaatttggaggatttatacagccttttccggtttctgaaagttgaaccatggaggaactgggctttgtggaataaacttgtacagaaaccatatgaagaaggtgatgaaaggggcttaaagctactgcagtccattttgaagccaataatgctgagaaggactaaaaattgcacagacaaggagggcaggccaatccttaatttaccccctgcaaacattgaagtaaaatactgtgttttatctgaggctgagaaggatttctatgaagctctatttcgaagatctaaggtaaaatttgatcaatttgttgagcaaggaagggttctgcacaactatgcttcaattttggagttacttttgcgcctaaggcaatgctgtgatcatccattccttgttatgagtcgtggggatacaaaagagtatgcagacctaaacaagcttgcaaagcgttttctgcgtggtggtaatggtgctgttaatggtgattcttgcatcccctctagagcttatatcgaacaggttgtccaagaattgcaaaaggatgaaggggagtgccctatttgtcttgaagcctttgaggatgcagtattaactccctgtgctcatcgtttatgccgagagtgtctcttatctagttggcggagtgcgacagcaggcctttgtcctgtctgtagaatgtcaatgagcaagcaggaccttataactgctcctactgataaccgctttcaaatcgatgtcgaaaaaaattgggttgaatcttccaagatatctgctctcctgcaggagttggaagctcttcgcagttcaggcgccaagagtatcgtgtttagccagtggactgcttttttagatctgttgcaaattccactttctaggaataatttctcatttgctaggctggatgggacgttgaatcttcagcaaagggagaaagttataaaggagttctcagaggacaaaggcattttggttctgcttatgtctctgaaggctggaggtgttggaatcaatcttactgccgcttctaatgcatttgtcatggacccttggtggaatcctgctgtggaagaacaagctgtcatgcgcatccatcgaattggtcaaacgaagactgtttctatcagaagattcatcgtgaagggcactgtcgaagaacgaatggaggctgtgcaggctcgaaagcagcgaatgatttctggagctttgactgaccaagaagtccgcactgcacgtatagaagaactgaagatgcttttctcctgagactacaaaagggctgttgtgcatcggatggtcggcaattcggcatggctaaaacaagatggctggtagccagaatgttggaaggtaagacgagggtaggaaattgcacgcccaaatatcttggcgtttagctgctgttgtgcgcacgatttgtacatcatgaatggttaatggctgacaagagtccaagacgcttcattgagtgaaaatcgaaagcatcatctcaaaattgaatatttctgtttgggttttgtataagtagataaactgaacatttgcagtaatacgaaggcagctacctgctcgatcattaatttaacaataaataaatttggtaaggtggtcaagtat

SEQ ID NO: 1669 - DNA, 731 bp, Glycine max
  Predicted polypeptide sequence is orthologous to G1540
ctcttttttcacctatataccctctaatattctaattctctctcttgatccaacaaacaaacactaccattttgtttgttctgagtagtgatccatgatggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcccatggagaaaagttttagggactgctcgatatcagctgggggtagcagtggccatgttggattaataaaccacaaacttgggtgggttggtgtggacccatataatttctcaacctatgccaacttctttg

SEQ ID NO: 1670 - protein, 289 aa, Oryza sativa
  Orthologous to G1540
MDHMQQQQRQQVGGGGGEEVAGRGGVPVCRPSGTRWTPTTEQIKILRELYYSCGIRSPNSEQIQRIAAMLRQYGRIEGKNVFYWFQNHKARERQKKRLTTLDVTTTTAAAADADASHLAVLSLSPTAAGATAPSFPGFYVGNGGAVQTDQANVVNWDCTAMAAEKTFLQDYMGVSGGGGAAAAAPTPWAMTTTTREPETLPLFPVGGGGGDGAHRHAGHGGFPSNFQRWGSAAATTNTITVQQHLQQHNFYSSSSSQLHSQDGPAAGTSLELTLSSYYCSCSPYPAGSM

SEQ ID NO: 1671 - DNA, 1088 bp, Glycine max
  Predicted polypeptide sequence is orthologous to G1543
ccacgcgtccgccctttcattgttttctgtgtgttttctatggcggttttaccaagtagctcctcaagcttggaattgaccatatctgtacctggttttgcttcttcaccaacccttcttccctcatcatctgtgaaagaattggacataaatcaagtacctcttgaagaagattggatggcatcaaacatggaagatgaagaagaaagcagcaatggagaacctcctcgaaagaaactccgtctcacaaaggaacaatctcttctccttgaagaaagctttagacaaaaccacacgttgaacccaaagcagaaagagtctttggcaatgcaactgaagctgcgaccaaggcaagtggaggtgtggtttcagaaccgtagggccaggtatcctaataataataatgaataaagtggagtaggtgtttattatgcaggagcaagctgaagcagacagagatggagtgcgagtacctcaagaggtggttcggttccctcacagagcagaaccggaggctccagagggaagtggaggagctgcgagccattaaggtgggcccacccaccgtgatctcccctcactcctgcgaaccgctcccggcctccacactttccatgtgtccccgctgcgagcgtgtcacctccaccgccgacaaaccgccctccgccgcggccactttgtccgctaaagtgccgccaactcaatcccgccaaccctccgcggcctgttgaccctataactatagtccatcgcctactctgcacgccacctctactacctcatcatctaattaatcagaaacagggcacaaacttaactaaactttacaaaactaaaaagttagtgtgaatgaagatataatatgtgttagaaaaaataatgtttttttttttttttttactaaaagggcgttttcggatagggaaacttttgtagttagtagtagtactttcaatggtcaatgcgtatctgattattgggctttcatattgactttctcctttttcaaatatggatagaacttttatttaaaaaaaaaaaaaaaaaaaaaaaaaaaaaaaaaaaaaaaaaaaaaaaaaaaaaaaaag

SEQ ID NO: 1672 - DNA, 1181 bp, Oryza sativa
  Predicted polypeptide sequence is orthologous to G1543
tctccctccgcctttgccccgccttccctgcccttttctcttgctgagccgcttctgcattggcttgtgatgatgggggccacttctccgtcaggcctggagctcaccatggctgtccccggcctcagctcctctggttcagaaggggccggttgcaacaacaacaacgccggtggcggctgcaacatgagggacctggacatcaaccagccggcgagcggcggcgaggaggaggagttcccgatgggcagcgtggaggaggacgaggaggagaggggcgtcggtgggccccaccgccccaagaagctccgcctctccaaggagcagtcccgcctcctcgaggagagcttccgcctcaaccataccctcacgccgaagcaaaaggaggccttggcgatcaaaacttgaagcttgcggccgaaggcaaggtgggaggtctggtttcaagaaccgtagggcaagggcgaagctgcccccgtcggtgatggagtgcgagtacctgaagcgctgcttcgggtcgctgacggaggagaaccgccggctgcagcgggaggtggaggagctgcgggcgatgcgggtggccccgcccacggtgctctcgccgcacaccaggcagccgctcccggcgtccgcgctcaccatgtgcccccgctgcgagcgcatcaccgccgccaccggcccgcctgccgtgcgcccgccgccgtcgtcagccgccgccgccgccccctcgcccttccaccctcgccgcccctctgcggccttctaggcccaaggtctcgcatcctaaaggccacaaaaagatgggcctcgccgtcccgtgtaaattgaaggagacgacgcagcggtagagggccccgtgtcggcgttgttgcgtcgggtccagtcgtctcagaggagtcagaggcgtggacaaaatgtttgttgcggtgtttgtgttccattggtcgttgatcttagcttgatgatctgtgattcgcgccttgctcgtctaggtttctcttgggccgacgcatgatcttttttcccccgtgtcggaccttattgggccttttgagatcgacgggccccctccttgtttcgcatgtggacatgttatttcgtccttttgggccaacaattcagcacggtggccaacggtgcgtagttcgtcgccgttttctttcaaaaaaaaaaaaaaaaaa

SEQ ID NO: 1673 - DNA, 1271 bp, Zea mays
  Predicted polypeptide sequence is orthologous to G1543
  misc_feature (807)..(807): n is a, c, g, or t
cctcgaggccggccgggcccctcttctcctctagcttctccttctctctccttcctggacattctctctctctcctctctctctaccatactcagacgagcagaagcagctagggacaccataggcaaactacttcagcaagaaattaaactatctcctacgcaagatcagaagaaactgtgtatggagcaagaagaggttggcctcgccctgggcctctccctcggctctggccaccaccaccaggagctcaagccccaacatccgtcgcatccgtgtgcggcgttgttggagccttctctgtcgctcggcagcccggcgaccaaggatgatggcccgaccgcaccggtgaggaggttcgctgccgtgaaaagggagctgcagacgatggaggggaacgacgacgaggccaccggcagggtacttgtctactcagtggcgtcgtcggcggtggttactgccgacgacgacgaagggtgcaacagcagccggaagaagctgaggctgtccaaggagcagtcggcgctgctggaggaccacttcaaggagcacagcaccctcaaccctaagcagaaggctgctttggccagacaactgaacctgagcccaaggcaagtgggaggtttggttccaaaacagaagagccagaaccaaactgaagcagacagaagtggactgcgagattctcaagcgctgctgcgagacgctaacagaggagaaccggcgtctccaccgcgagctccagcagctccgcgcctttttcatgcccaccgccgccgccgccgcgctctccatctggtcctctgncagcgccttgttgccaccggagcatctgccgccgccggagccaccgccggtgcagaaaataagcctaaggcgggcggccccggcggccgagcgccacacgtgttcagccctttcaccaattctgccgcctgctgaacacgcatacatatgtatatacatgcatgcgcacacatatatacgtatgtggtgcttagcgctagcggctagccacgctctatcattcatcgatggtcatctactagctagatagtaattggttcactagctagatggcatatattcctgtcccctccccccttaattcattagctttgttttttcacaagctaattaatgaattgatagcggcgtcgcgtgaggacgaaaaaaaaaaaaaaaaaaaaaaaaaaaaaaaaaaaaaaaaaaaaaaaaaaaaaaaaaaaaaaaaaaaaaaaaaaaaaagggggggcccgttttaaaagaac

SEQ ID NO: 1674 - protein, 228 aa, Oryza sativa
  Orthologous to G1543
MGATSPSGLELTMAVPGLSSSGSEGAGCNNNNAGGGCNMRDLDINQPASGGEEEEFPMGSVEEDEEERGVGGPHRPKKLRLSKEQSRLLEESFRLNHTLTPKQKEALAIKLKLRPRQVEVWFQNRRARTKLKQTEMECEYLKRCFGSLTEENRRLQREVEELRAMRVAPPTVLSPHTRQPLPASALTMCPRCERITAATGPPAVRPPPSSAAAAAPSPFHPRRPSAAF

SEQ ID NO: 1675 - DNA, 626 bp, Zea mays
  Predicted polypeptide sequence is orthologous to G1637
accctcgaggctggccgggcagaaataaaaaggaaaaatccgggagaggataacaaaaaagaaaaaaacccaaagagattcctctcaccaccaccaaccctagacgatcctcccccgccatgatgcgggacggcgtgcctccgtcggtggccggctccggcggcgcggcgggcggcgacgggcccaggcgatgctcgcagtgcgggcaccacgggcacaacgcgcgaacctgcacggggcggcccgtcaagctcttcggcgtgcgcatcgggggcaagcccatccggaagagcgccagcatggggaacatcgcgcacctcgccgcggagggcagcggcggcagggaggaagggtacggctccgacggggagcgcccgcacaagaagcgaggtgaggcatggactgaagaggagcacaagaagtttctgcttgggttgaataagctagggaaaggcgattggcgtggtatatcccgtaaatatgttgtttcaaggacacctactcaagtggctagccatgcgcaaaagtatttcaatcgccaaacaaatgtgcctggaagaaagagaagatcaagcctattcggtttggtgattgttgacccgtctgctcaacttccgctctcgcgt

SEQ ID NO: 1676 - DNA, 1428 bp, Zea mays
  Predicted polypeptide sequence is orthologous to G1637
gtcgttgtacattgggtacctcgaggccggccgggcccaggggggcggggcaccacaggtactcttctcctgcttggcctcttgtgccgcaaccgcgagtgcggcctacggtagcctccaaagcagcacatccaaagcagggaccgaatggacatggaccggccggaggaggaggggcagcagcggagggagacgatgacgccggtgctcctcaggctgttcggcgtggacgtccaccggggtggcggcagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggaattccatggaccgaggaggagcacaggaagttcctggacgggctaaggcagctgggcaagggggactggaggggcatctccaagggcttcgtcaccaccaggacggcgacgcaggtggccagccacgcccagaagtacttcctccggcagaccaaccccggtatgaagaagcgccgggcgagcctcttcgacgtcggtatcgcggactacaaggacaaccaggtgccaggccctcagagcatcgtcgctgccaaaccggcgcctacgcaggagataatccacaccgaccgcggcgacgtccccataccaagatatagaggcctcggagagattttaggcagtaacatgcaggttaatcaactgactgactactactatttcaacaagaactcccatgttcccgcggggacttcgctctccatggcctccggcctggaaacggcctcgaccgtcgacagcctggagctcagcatcgccgtcaacggcctggagctcagcatcgcgcccccttcccggtgcgtctgcggcggcgcggcgggggccatcaaggttctgtgactcggccgggacgccgagggagctactcgcatttggcttcccctgcgagcatgcgtttcatcaagtattatcagcctcgtcaggctgccgcgcgcagccgggtttcggtcttgctggttgtgttggtgtgttctgttctgttttgttgtgcgcaaggaatgtttgtgaagtgcattgcgttgtaatacactaatactagcagtgttgtggaatggaattaggggagagggatcagctgggatttgggggttgatgggtccctgtctcgacttcgagtgggttcgtttcggggtccaatccgaggaggcggcgacgggcgcgaggcgtcgtgtgggtgtggctctgagctccccgatcccgcccaataattggaccgtgccgtccaaaacgcatacgccaactaatcttcggaagaaagtcgcagctttacgttaa

SEQ ID NO: 1677 - DNA, 1374 bp, Zea mays
  Predicted polypeptide sequence is orthologous to G1637
ccggccgggaaggaaatacacagagaccgggcatataaatgtaagcaagtccaatgtaaggccgcccccccaggggggcggggcagcagcggagggggaagatgacgccggtggtcctcaggctgttcggcgtggacgttcgccgggttggcgccagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggaattccatggaccgaggaggagcacaggaagttcctggacgggctaaggcagctgggcaagggggactggaggggcatctccaagggcttcgtcaccaccaggacggcgacgcaggtggccagccacgcccagaagtacttcctccggcagaccaaccccgggatgaagaagcgccgggcgagcctcttcgacgtcggtatcgcggactacaaggacaaccaggtgccaggccctcagagcatcgtcactgccaaaccggcgcctacgcaggagataatccacaccgaccgcggcgacgtccccataccaagacgatatagaggcctcggagagattttaggcagtaacatgcaggttaatcaactgactgactactactatttcaacaagaactcccatgttcccccgggcacttcgctctccatggcctcccgcttggaaacggcctcgaccgtcgacagcctggggctcagcatcgccgtcaacgggctggagctcagcatcgcgcccccttcccggtgcgtcttcggcggcgcggcgggggccatcaaggttctgtgactcggccgggacgccgagcgagctactcgcatttggctgtggctctcgggcccctgcgagcatgcgtttcatcaagtattatcagcctcgtcaggctgccgcgcgcagccgggtttcggtcttgctggttgtgttggtgtgttgtgttctgttgtgttgtgttgtgttgtgcgcaaggaatgtttgtgaagtgaattgcgttgtaatactctaatgctagcagtgttgtggaatgtaattaggggagagggatcagctgggattggggggttgatgggtccctgtctcgacttcgagtgggttcgtttcgtgttccaatccgaggaggcgacgacgggcgcgaggcgtcgtgtggctctgagctccccgacccctcccaataattggaccgttccgtcgttggtaggcccgtgccgtccaaaacgtactccctccagtacaataaaggtagtcgtttaggacatgattgtgc

SEQ ID NO: 1678 - DNA, 1112 bp, Glycine max
  Predicted polypeptide sequence is orthologous to G1640
gaattcggctcgagcaacaaccttagcagttaattagcacaacacaaaaggagagagagagagagagagagagagagagagagagagagagagagatggggagaagcccttgttgttcaaaggagggtttgaatagaggtgcttggacagctcatgaagacaaaatcctgagagaatatattagagtccatggtgaaggaagatggagaaaccttcccaaaagagcaggtttgaaaagatgcgggaaaagttgtagacttcgatggttgaattatctcagaccagatattaagagaggcaatatatccccagatgaagaagagctcatcatcaggctccacaagctcctcggaaacagatggtctttaatagctgggaggcttccaggacgaacagacaacgaaataaagaattattggaacaccaatttagggaaaaaggtgaaagatggtcaccaaacaaccactggaaacaacacacagaatccaatgcccaacccatcaccctccctatctcctcctaaactagattcccatgttgtccgtacaaaggctaccaagtgctccaagttgttattcctaaacccaccccctcacccatcaatgcagaacaagttcaagactgaggcagaagaagaagaagaagaagcaaggcttgtgaatggtgtaattagaaaccaaatggaacacactacatacgacaacgggttcctgtcgtttcccgatgaagaaaaagaactctcaacagatttgctcatagatttcaacgtgggggatgtttgcttgtctgatctactcaactcagatttctcaaacacgtacaatttcagctgcactaatgttaaccaccacgagcagttatcgccttgttcggaccaacctgatgccatgttctcagatgaagttctcaaggactggacacacagcaattttgcagacgaagcgaatgcttccaacaaccttcattctttcatttcgtttgagtctactgaggaatgactagtgcaatgataatgacaacaaaaattgcacgtttgtactaatgtcaatatgccttctccaataaaattcgccagttaagtctctttaaaaaaaaaaaaagggcggccgccg

SEQ ID NO: 1679 - DNA, 538 bp, Glycine max
  Predicted polypeptide sequence is orthologous to G1640
aattcggctcgaggcttcagtacttgctacctttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaataaagaactactggaacacccatctaagcaaaaagctgaaaattcaaggaacagaagacacagacacacacaaaatgttagagaatcctcaagaagaggctgcaagtgatggtggcaacaacaacaac

SEQ ID NO: 1680 - DNA, 773 bp, Glycine max
  Predicted polypeptide sequence is orthologous to G1640
cccacgcgtccgctttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcaggtaattaaggttttagatgctcaactttcccaattcatttctcaatttgatgtctcatgttctggtttcgatcacaaattattatgtgtaacttttataataattatattaatattgatatatgattgaatgacagtatataattatatgtgtataatcattaaattcataatataaaattacatgtatcttttatccgaaaaattatgctggagtcggatagaataaattctgattcataactctgaatatacagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaataaagaactactggaacacccatctaagcaaaaagctgaaaattcaaggaacagaagacacagacacacacaaaatgttagagaatcctcaagaagaggctgcaagtgatggtggcaacaacaac

SEQ ID NO: 1681 - protein, 271 aa, Oryza sativa
  Orthologous to G1640
MGRRACCAKEGMKRGAWTSKEDDVLASYIKSHGEGKWREVPQRAGLRRCGKSCRLRWLNYLRPNIKRGNIDDDEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 1682 - DNA, 737 bp, Zea mays
  Predicted polypeptide sequence is orthologous to G1645
  misc_feature (649)..(649): n is a, c, g, or t
  misc_feature (688)..(688): n is a, c, g, or t
aagctgacagagagagctagcaacgctctgcaagatccgccatctaaactttgcagcactctactccaccactctcctccgtctgcgactgcgactaggtcccaaatggccgctccaccggtggccgccgctctgtctgcgctccatgaggcacaagagacccacggccatgacgacagccgcgctgggcacgcgagaggccactggcggccagccgaggatgccaagctcaaggacctcgtggcgctgtacggccccaagaactggaacctcatcgccagcaaactccacggcagatcagggaaaagctgccggctgcggtggttcaaccagctggacccgcgggtcaaccgccgcccgttctcggcggcggaggagcagcggctggtggcggcgcaccgcgcccacggcaacaagtgggcgctcatcgcgcgcctcttcccaggccgcaccgacaacgccgtcaagaaccactggcacgtcctcacggcgcgcaggcagcgggagcggaccggcgcgccgccgcgccgacgcaagccctcctcgtcgtcacccgccgcccaccaccaccgtgcaccatctcctctgccgttctgcgccggcaaggccacccgaccccgctcggtgcggcgacggcgacggcgacggnggcgggtccgacgagtccgcgtcgtccacctcctccggnaccgacctctcctccctaggctccgtgtgcgcccccgccgtcccctgct

SEQ ID NO: 1683 - DNA, 828 bp, Zea mays
  Predicted polypeptide sequence is orthologous to G1645
  misc_feature (15)..(15): n is a, c, g, or t
  misc_feature (803)..(803): n is a, c, g, or t
cattgggtacctcgnagccggccgggctgactgacctcagcctcaggctcagctgcaccgatcatccatccccatacaaagacactgtatacatacattttaacaacaacaaggtttagctccgcatggcctattactgcaatgcttgctgcgcagggaagagctgccgcctccgctggttcaaccagctagacccccggatcagcaagcgccccttcagcgacgaggaggaggagcgcctgatggctgcgcaccgcttctacggcaacaagtgggccatgatcgcgcgcctcttccccggccgcacggacaacgccgtgaagaaccactggcacgtcatcatggcgcgcaagtaccgcgagcagtccacggcctaccgccgccgcaagctcaaccaggcagtccagcggaagctcgaggcagcctccgccgcggtcgcaatgccgccgggcgcgggcgcgggagacgtcgccgtcggccagcaccaccacctgctggccgccgccgcggcggcccacgcccacgacgccgcctacagcttcgccgcggacccctacggcttcggcatccgccaccaatactgcaccttcccgttcccgccaggcgccgcttcggctgaggacccgccgccgccagcgttcatagatttcctcggggtcggagccacatgaacgcgcgcgcatgtgcatgcatgctcgacttcaccacgcgccttgcagttgcatgtagtgggatctagctaggacaggtagctcgagcagcctctatctagtatctagctagctacctttgccatatatgangagtaagtacatcgatccaaggctt

SEQ ID NO: 1684 - DNA, 1441 bp, Zea mays
  Predicted polypeptide sequence is orthologous to G1645
ccacgcgtccggtctcctctccccatcttctctcctggaagccgcctcggtcggacccggacaagatggccgccttcttcggtgctgcaccgccgccggctctcgcttcgttccgccacgaggaggaggaggagcagcatcaggacgccgccgaggaggtgtaccacgtggacgatgtcgacgagggcagcggtgacggccgtggccacggcggcgccggccaggggaagctgtgcgccaggggccactggcgccccgccgaggacgccaagctcaaggagctcgtcgcgcagttcgggccccagaactggaacctcatcgccgagaggctggacggcagatcagggaagagctgccgcctgcggtggttcaaccagctggacccgcggatcaaccggcgcgccttctcggaggaggaggaggagcggctcctggcggcgcaccgcgcgtacggcaacaagtgggctctcatcgcgcgcctcttcccgggccgcaccgacaacgccgtcaagaaccactggcacgtcctcatggcgcgcaggcagcgggagcactcgggcgcgctccgccgccgcaagccctcctcgacctcgccctcgccggcgccggcgccggcgccgcacctggcgcccgtcgtcgtcctccaccaccaccaccactacgccggcggctcccctcccatgccgccgttgcacgccgccgacgcccacacgcagtacacggcagcggcggcggcagcggacacccgcgcgcacagcggcggcgagtccgacgagaccgcctccacgtgcaccaccgacctctccctcgcttccgccgccccctgcttctaccagagtggctacgacgtggccccgcgcgccgcggcgttcgcaccgagcgcgcgctccgccttctccgcgccgccggcgacggcgcgctccgacgacaaggtctcgctgcccttcttcgacttcctcggcgtcggcgcggcgtgatgggggggccggcccgggccggccaggcggcggtgtacaggagggcggaggcggtcaaaggacgagagccccggcggcggtgaacccgtgcccgcgcgtagtttagctttagagcccgagttaaatcatcgagaacagaacatggcctgagcttgagagaggaggagaatggcgatccaccattgaactggtgcccgtggcattgcagactaacagctccgcatccgttcggctgctgatgttgctagtagtaatggtacggtgattactctctgctttgggttgggagagacgaatctgcaagcaccaccagaccaagcaagggcgacgatgggtatgggtggatgtttgcagaagaagaaaaaaccgcttgtaacacaaactgcaggacaaaggcagatcagagatcctctgctaactctctttttacaaaaaaaaaacccaagggcggccgctctagagga

SEQ ID NO: 1685 - DNA, 460 bp, Lycopersicon esculentum
  Predicted polypeptide sequence is orthologous to G1645
gatggacagtcaaaactttgtgctagaggtcattggagaccagctgaagatgctaagcttaaagaacttgttgctatttatggccctcagaattggaaccttattgctgaaaagttagaaggaaggtcaggaaaaagttgtagattgagatggtttaaccagttggatccaagaatcaacagaagggcatttagtgaagaggaagaggaaagattaatggctgctcatagattgtatggtaacaaatgggcaatgatagcaagactatttccagggagaacagacaatgcagtgaagaaccattggcatgtaataatggccagaaaatatagagaacaatcaagtgcttataggagaagaaaaatgggacaatttgtttacagaagatcaacaacaacagtagttgaagaagcagataattcaagtggccaaaattctgttaaccactttagtatgaaaa

SEQ ID NO: 1686 - DNA, 529 bp, Medicago truncatula
  Predicted polypeptide sequence is orthologous to G1645
tattctcttccattcttctgtaaacagattgattcagcctcctccttctgtaagcacttgattgttctctgtactttcttgccattataacatgccagtgattcttaacagcattatcagttcttccagggaaaagcctagcaatcatggcccatttgttaccataaattctatgagcttgcattaatctttcttcctcttcatcactaaaagctcttctattaatccttggatccaattggttgaaccatcttagcctacaactcttaccttcaaatccaaaaaaaaaaaaaaagttaagaaaaagaaaatgacccaaaaaaagaggacacaacaaaaagaggaaagaaatgaaatataacctgatctgccttctagcttttcagctatgagattccagttctgaggaccataaagagcaacaagttctttaagcttagaatcttctgcaggtctccaatgacctcttgcacaaagtttagagtgaccagtatctacctctttaccactgacataactattctcatta

SEQ ID NO: 1687 - protein, 338 aa, Oryza sativa
  Orthologous to G1645
MAHEMMGGFFGHPPPPPATAAVGEEEDEVVEETEEGGHGGGVQGKLCARGHWRPAEDAKLKDLVAQYGPQNWNLIAEKLDGRSGKSCRLRWFNQLDPRINRRAFTEEEEERLMAAHRAYGNKWALIARLFPGRTDNAVKNHWHVLMARRHREQSGAFRRRKPSSSSASPAPAPAPPPPPQPVVALHHHHHRYSQQYSGYSGAAESDESASTCTTDLSLSSGSAAAAAAAAAAANIPCCFYQSTPRASSSSTAACRAPRVAAAADTVAFFPGAGYDFAAAPHAMAPAAASTFAPSARSAFSAPAGRGEPPGAVDQRGGAQATTDSHTIPFFDFLGVGAT

SEQ ID NO: 1688 - DNA, 524 bp, Oryza sativa
  Predicted polypeptide sequence is orthologous to G1646
acggcgccgcgggccctcccgcctgcgaacccgagcgcgctccgggctcctccttggcctcctcccgcggcacgatgtcgacgaggaagtcgaacacgtcggtgcgcttcgatgtgcgcggcagacgtcttgcgctgcaggtcggcgcttgttctcctcggcgtcagccacgagcggatggtgagctccaggatgaagagctcgcacgccttggcagaacagcacgggcgcactccgccgagatcatgcgcacgtcctctgtccgccttcatgatcctcttgatccgcgccagcggcagctggtggttcttgaagtccgacgccgacgcgcagctccagcctcctgccgctggtacgcccagaacgcctgcagctgcgcctgctgctgctggagcaggtggtggtgcaggcaccgccggcggcccagcccgcgccaggcacgcccggcaccggggctccggcgcctgcgccgcttagaggatccaagcttaaacgcgtgcatgcgacgtcatagctctttaatt

SEQ ID NO: 1689 - DNA, 792 bp, Oryza sativa
  Predicted polypeptide sequence is orthologous to G1646
ccggccgggaacctcacatatattgtgttcatcctcataccaccaaccaattagtgccagtagcacatttctgcagttgtagttcaagtaaggtatatcattcagagcaacaaagggaagcaatgaagcaaactttggatgtacatagatcgttgaggccaccaatgccaatggctcaacaacaaatggatgaatcttggagggaccgacaaaaggagattgagatgacaaaggacttcagtgagcacatgatccctatggcccgcttgaagaagatcgtatcttctcaaaagggtaacatgatgatgacctttgacatgccagcgttcttatcaaagatgtgtgagctctttgtacaagaacttgctgcgcgtgcatgggcatgtgcccaatctcataaccgatgcatcatactagacatggatattgctgaagccgtagcctctactgagtcttatgactttcttgttgatatcctccacaatcacagtgtgaagcaaaaatccactccttgttcttccaccaagcgttgtaggttagttgatcaaccttctacatctcacattccccaccgacatctgctgccacagtttgctcctacatatactttggccatccctattactcctagtttaatgccattaatttctcaatgcacaccatcctcttttccatccttgccacaagaaaagttcccattgatggcacccacacccattgtgaatagatcaatgttgtttatcaataatatagcaaggggtctgggcttacaagggaacaatatcaatgcag

SEQ ID NO: 1690 - DNA, 1193 bp, Glycine max
  Predicted polypeptide sequence is orthologous to G1652
aacacaacttccacattccgatggaggagtcatgggaaaattggcatcttcatatggaaaccggttgcgagaacgatttcttaggcaagtgtcacggcactgacgatgacgagttcttcagagacatccttcagcaaccaccacctgcggctttctcttccgaaagcgaaagcgatcactccttcctcgctgtccaaaacacttctagcatccccaacgacggtgccgttttgtctcctaggaattacctcgtcaaaagcagcagctccaactccttggtctctcaaaacgcttccaaacgacctcgtcgtttgtcctctcccaggacttacattctgtccttcgacaactcaaccatggttccggccacacccgaaacccgcccccgctcctccaataattcccctctgcctgccaaacgggccctggaaagcccaggcccagtagcccgaaggcccaaccaaggagctaagaagataagaacctcttctcagaccatcgatcacataatggccgagagacgacggaggcaggaactcacggagaggttcatagcactctcagccacgattcccggcttgaacaagacggacaaggcttctgtacttcgagcagcaattgattacgtgaaacaacttcaagaaagggtacaggaactggagaaacaagacaaaaaaaggagtacagagtcagtaatattcatcaagaaacccgacccaaatggaaacgatgaagacaccacctccactgaaacgaactgtagcatccttcctgagatggaagcaagggtgatggggaaggaggtgctcattgagatccactgtgagaaagaaaatggtgttgagctaaaaatattggaccaccttgaaaatcttcatctcagtgttaccggaagcagtgtcttgccatttggaaattctgctctctgcattaccatcacaactcagatgggtgacgggtaccaaatgactgtgaatgatctagtgaaaaaccttagacaattgttctcaaaatcacatgtgctaagcgacagcgatccgtactagtgtatcaaacaatgagttgtagtgtatggaaatcgaaagttttggatttattaccctctttgattttggcttgttttcatgttgatcgtaacgttaataaacaaatactatatgtctgacctggatttatgcccggcatctaccctg

SEQ ID NO: 1691 - DNA, 1752 bp, Glycine max
  Predicted polypeptide sequence is orthologous to G1652
  misc_feature (849)..(851): n is a, c, g, or t
cggcttgagggaccaatatgattgaaagatgtcacatctattaatcagatatattaattaggttgatagcttcagctgtttttcatttcatgaggacttctcatatggagatttcatcaatcagagggttgcctgaaatggggataatagaggatcctaacttcctccatcactggcagttaaactctattgatacaactagcctaacaggtgctccttttggagagattttacaaaagcactcattctctgataactcaaatttcaaccccaaaacatccatggaaacatcaccaactggaattgaaagacctgcaaaacagctcagaaataacagctggaatcacaacaaaagtcaacaacagacaccagaaacacaatttgcttcatgctcaaatcttctttcatttgttaattcgaattacacgagcgaattgggactagtgaaacctaaggtggagatggtgtgtcctaaaatcaacaacaacgctctcgcagacatgttgatctctcaaggaaccttaggaaatcaaaactatcttttcaaggctagccaggaggccaaaaagattgaaacacgtcctaaactttctcaacctcaagaccacataatagctgaaaggaagcgaagagagaagctcagccaacggttcattgctctatctgctcttgttccgggcctaaagaagatggacaaagcttcggttcttggagaagctataaagtacttgaagcaaatgcaagagaaagtgagtgctcttgaggaggaacagaacaggaagagaactgtggaatctgtggtaattgtgaagaaatcccggctatctagtgatgctgaagactcttctnnntcagagaccggtggtacatttgtcgaggcactacctgaaattgaagcaagattttatgaaagaaatgtcctcataagaatacattgtgagaagaataaaggagtcatagagaaaacaatcagcgaaattgagaaactccatctaaaagtcatcaatagcagtgccttgacatttgggagtttcatcctggatataacaattattgctcagatggatatggaattctgcatgacagtgaaggatcttgtgagaagtttacgctcagccttttcatatttcgtgtgaagaaactcgttatgcattccgaaaggttcatgaagaataggagtgcaatcaattataccagttcatataaactattatcaagtttaagttcttcaataataattatgtttccaaggtctgcaatgtctgccatctacaccatgtttgctctgaggttcatttatgaagaagggttttttctagcgatcttttctttttgcatggtcaacttgttgacagtgttattgtcacacaccctactgtttcaagagtgaatgtagagcttgttaggcattttttggcagaaagttgaaaagttcaactagctgtttcccatctatttcttacctaaatctttagaagcaggcctttgttgagtgacttcctatcttcttttttttttttcaggtgttcttgagttacttttttatttgaaacaaaatatacgcctgtaaaagtttggttggatttggtaagtgatggaataatcgtccttttgtttatcttgtgtatatgctcgacatgttgcatggcctcaacatgatattctgcaaaagcattaatgctaccaatttaagcatatgtaaattgtaggtggtggattaagcttaaaaaaaaaaaaaaaaaaaaaaaaaaa

SEQ ID NO: 1692 - DNA, 1468 bp, Glycine max
  Predicted polypeptide sequence is orthologous to G1652
  misc_feature (1006)..(1006): n is a, c, g, or t
ctcaaattcgtcccctccaatccaacaacaccgatcagtttcatggtattgttgtttcttctgccttaagcccaaagcgataagaccaaggtgcttcagtttactcccacatacccggaaacgtttatcagaaaaccagaactttgaagctgaaagccccaaaggccatagaagctacaagtccccatctcacgttcgggatcacatcatcgccgagagaaaacgaagagagaagctcagccagagcttaatcgctctagcagctcttattcctggcttaaagaagatggacaaggcatcagtgctgggagatgctataaagtacgtgaaagagctccaagagcgtatgagaatgcttgaagaagaggacaagaatagagatgtggagtctgtggtgatggtgaagaaacaacggctgagctgctgcgacgatggttcagcttcacatgaagatgaagaaaacagtgaaagactcccccgcgtggaagcgagagtgttagagaaggacgtgctccttcggatccactgccaaaagcaaaaggggcttttgctcaacatacttgtcgagattcaaaaccttcatctcttcgttgtcaatagcagtgtcctacctttcggggattccgtacttgacataaccattgttgctcagatgggaaccggctacaatttgaccataaatgatcttgtaaaaaacctacgcgtggctactttgaaatccatgtcataacaccaacgtgatcttgtctgtttctggtccagcaggatggtctggtggtgggtggtaatattaataatgatattttcatgttttgtggtgtgcagatacccaaaaatgattgaaaatgagttattgtttgaaggtaaaaaatttggtcctccagtctatttttaattttggatttgatctcccactaaattaattcacaaatattatttttttattttataaaatcatgtaatgttcgtcctccagtccacacttgaaccttaacgggttacaagngtgacgttgattattgtcacgtgtcacttttttattgaatgatgactttcacgtgtcatgttttgatgggtcaatgaaaacaacaatgtatttcatcttttatggaattaacatccacatgatacgtgacaatcatcattcaataagaaagtgacacatggtagtcaatgtcactttgtaacaatcaacgtccaattgtgggttgagggaccaacattgcatgattttaaaaagtaggagaaaaaaaaattgtgaattaatttaatgggggacaaaatttgaaattgaagacaaactggagaatcaaaaatgtaattttgccttgattcaaatgctctcttgtcaatttgaatgcacaaaatttatatgtaattgaactttcatttcaaaatttacttctcttgatatttaatgcaaatatttattatatgaattgtttaaatgaaacttcaattttaattt

SEQ ID NO: 1693 - DNA, 1825 bp, Glycine max
  Predicted polypeptide sequence is orthologous to G1652
gaatagcctagaatagcgaaagaaagtgttgctgctaattccatttcagtgacccctaattatgatggaggaattgaacaaaccattggacggatcagcaaccagctggttatccgatttggtaagaaaaaaaaaaaaaaatcattttcattcttccattcttcaaatgcccaaatagatgatcataatccataaatcctttaacccttttgtgttcctcttttgttttgttttatttataggaaatggatgattacaatttatttccagatgaatgtcccttgaacttgaacttgtttgatgaccaagagtttctctcacaagacattgctagtgcccttcaagaacagacacagaccttgcaacaatctttgtcttcagagtgcccttcaaaaactgtgagcaactcatccaccgatgaaaccacttttgactttgagagaccagccaagttgctgaaaacgacaacaagcagtagttgttgtaactctgactcatccaccatcaccaaaagcctttcacccaaactttccccatcgtcatctttttcctcatttcagtctcagattctctcctttgacaatcctaacccaacctcatcttccaacaccaccacccagttttatgggtttgactgtaccttaaacccaacacagaacgagatggtgtcagtgtcagtccccaacatgagaaaaccacggttcccaactcaaaccgcaaaaggttcaccgaaaaatcaaaactttgaaacaaaaacctcacatggtaagaggtctccagctcatgctcaagatcacatcatggctgaaagaaaacgaagagagaaactcagccagagcttcattgcccttgcagctcttgttcctggcctaaagaagatggacaaggcttctgtgttaggggacgctatcaaatatgtgaaagagcttaaagagcggttaacagtgcttgaagagcagagcaaaaaatcaagggcagagtcagtagtggttctgaacaagccagacctctctggcgatgatgattcttcttcatgtgatgagagcattggtgctgatagtgtcagtgactcactgtttgaagtggaatcaagagtatcagggaaggagatgctgctcaggatccactgccagaagcaaaagggtcttttggtcaaattactggccgagattcaaagccatcacttatttgttgctaatagcagtgtattaccctttggtgattctatccttgacattaccatagtggctcagatgggagaaagttacaatttgaccactaaggaacttgtcaagaacctacgcgtggctgcattgaagatattgtcataacatgaacgtggcttgagtatggaggataccctcatgacatatgatatggattggaactctgaatcacatttaatgcgccagccaccgagtaaatcacaaccaaaatggaagccttgttattaatgtgtgatttccgctacaacctgcagtgttccccaatatgtagattcagcttgatcccaagtgatcttgtctttttcgtgttatgttttggtttctcaggccttcagtgtgtgcctgctcgagggaaaaataattgaataattttgtaaagatgttaggaataatttcaatctgacacggcttaattaacatgagcttaaatagagattagaagctggataatggtgacattgacagtttttgatgtaccatttgttcttttgaacatgtttgaaggatgcaaatctctctaatttctggttatgcttccactttaattataatattggccccccagcatttatgttaatcacctactactataatgggct

SEQ ID NO: 1694 - DNA, 1561 bp, Glycine max
  Predicted polypeptide sequence is orthologous to G1652
acgtgtcatgcactcgtcccttacctcggaattcggctcgaggaatggatcaaaccaatggacggatcagcaactcagctggttatccgatttggaaatggatgattacaatttatttccagatgaatgtcccttgaacttgaacatgtttgatgaccgagagtttctctcacaacacattgcttgcgccttccaagaacagacaccgaccttgcaacagcaatctttgtcttcagagtgcccttccaaaactgtgagcaactcatccaccgatgaaaccacctttgactttgagagaccatccaagttgctgaaaacgacaacaagcactagttctaactttgactcatccaccatcaccaaaaccctttcccccaaactttccccatcatcttcctttcaatctcagattctctcttttgacaacaccaacacccagttttatgagtttcactgtaccttaaacccaacacagaacgagatggtatcggtgtcagtgccccaaaagggaaaaccacggttcccaactcaaaccccaaaagggtcaccgaaatatcaaaactttgaaacaaaaacctctcatgctaagaggtctcctgctcatgctcaagatcacatcatggctgagagaaagcgaagagagaaactcagccagagcttcattgctcttgcagcccttgttcctggcctaaagaagatggacaaggcttctgtgttaggggacgctatcgaatatgtgaaagagcttaaagagcggttgacagttcttgaagagcagagcaagaaaacaagggcagaatcgatagtggttctgaacaagccagacctctctggtgataatgattcttcttcatgtgacgagagcattgatgctgatagtgtcagtgactcactgtttgaagtggaatcaagagtatcagggaaggagatgctgctcaagatccactgccagaagcaaaggggacttttggtcaagttactggctgagattcaaagtaatcacttatttgttgctaatagcagtgtcctaccctttggtaattctatccttgacattaccattgttgctcagatgggagaaagttacaatttgaccactaaggaacttgccaagaatctacgcgtggctgcattgaagatattgtcataacatgaacgtggcttgagtatggagaataccctcatggcatatggcatggatattgaaactctgaatcacatttaatgccccagccaccgagtaaatcacacccaaaatggaagccttgttattaatgtgtgatttctgctacaacctgcagtgttccccaatatgtagattcagcttgaccccaaatgatcttgtcttcttcgtgttatgttttggtttctgaggccttcagtgtgtgcctgctagagagggaaaaataattgaataattttgtagagatattaggaataatttcaatctgacatgtcttaattaagattttaattgagttgattaaccagaagggatgagttgtttaatttctatgaataaaaaaaatctgacccggcttaattaacattagcttaacca

SEQ ID NO: 1695 - DNA, 712 bp, Glycine max
  Predicted polypeptide sequence is orthologous to G1652
caaatcatcctcaatccatcataaagtactatacgataatgttcgtatcatggatatttttttttaatacaatctgagaacttccttgatgcactagcacggatcactaattcactattgcatgtcatacacctccaacagatattctctcagttttttcactaggtcatccttggtcatgctgttttcgccattcatctgagcaataatgttgattataagagtagaagtcccaaatggcaatacggtgctactggttgtagatagatggaggtttctaagcaaggcatgtattttgaacactatgtccttttgcttctcacaatggattccaatgagtacttccttatctaggactcttgcttcaacctcaaatagtgatatttctttgttcgtttcacaattgccggtgtttttatctgaggaggcttcagatttccttatgaatgttgctgaatctactttgttttgattttccaactctttaactcgctcttgaagttgttttgtgcaattgacagcttcacgaagcacataagccttgtccatcttcttgagcccaggaatagttgctgaaagtgctataatgctccctgtcagttcctgcctccttttcctctcagcaattatgtgatgccgtgtctcacatgaccttctaaccttcttctttggttgggtttggggcatcaatgcatcaaactcgagctggtgc

SEQ ID NO: 1696 - DNA, 1285 bp, Glycine max
  Predicted polypeptide sequence is orthologous to G1652
gctaaaatgggtttctattttggtaataggagattcgatcaatataaatatatatatatagatatatatatatatatatatatatatgattatatacgttatgtacaggcccgtccgagtcatggctaaaatgggtttctattttggacactaatgactatcatttattcagtgaatatgacatgaactctgtcgaggaacaattggagggagagaattcagtggatcctggtgaactctcatgggaaaatcactcttattcatatctcactaaagaaagcaccacccttttgagcaattcttcatctttggaagagatcaacactggctttgatatgacaagtctcaaacaagatgcttctccacagaaaccgaagtcttgcattctgtcttttgaggattccactttagtgccaattaatcccaagaaaacatgccaaatatatgatcatggtgaacattcaaaggagacacaagaaaagccacacaatagaaaacccctcaagaggggtagacgcttttctcagacacttgatcacatattggctgaaagaaaaaggagagagaatatcagcagaatgttcatagctctttcagcacttattccagacttgaaaaagatggacaaggcttctgtccttagcaacgctatagagtatgtgaaatatcttcagcagcatgtgaaagatttggaacaagagaacaagaagagaaagacggaatccttaggatgtttcaaaataaacaaaacctgtgatgataaacctataaagaaatgtcctaaagttgaagcaagagtctcaggaaaagatgttctcatcagagtaacgtgtgagaagcaaaaggacattgtacttaagctactggccaagcttgaagctcataatctctgcatagtgtgtagcaatgtcttaccttttgggaattccgctctcagcattaccagcattgctatgatggaccatgaattcagcatgacagtggacacgtacgacctagtgaaaatgttgactgaggaattgttggagtgctgtaaattgcaacgataatgagccacgctaacgaattggctaccagtaaatttaaaagtgcattttaagcagttcaagcattttatttggtgtccctattagataattaatattggcagtatcttcatatattatgcatttggtgtgcataatagttgtctttttggccatcttcacaaataatcatcatttttatggcaaaataaaatgattttgtgatttcacattttgtgcattttcaatatttttatatt

SEQ ID NO: 1697 - DNA, 683 bp, Glycine max
  Predicted polypeptide sequence is orthologous to G1652
  misc_feature (10)..(13): n is a, c, g, or t
  misc_feature (674)..(675): n is a, c, g, or t
  misc_feature (681)..(682): n is a, c, g, or t
gggaaaattnnnnttccgataattcttatctggatgaggtcaacgatgaatttggtagtgaagatgaagagggaggttcattttctggaatgggcgagaccgacagaaagaagagaaagcgagaactcgcagagaggttccttgcactttcagccaccatacctggcttcaccaagacggacaagacttcaatcctggccaatgctagtagctatgtgaaacaacttcagcaacgtgtgagggagctagagcaagaagttcaatccaacgtttctagcaatgaaggtgccaccagctcttgcgaagtgaactcatccaatgattattactctggtggtggaccaaatgaaattcttcccgaggtcaaagtaagagtgttacagaaggacgttctcatcataatccactgtgagaaacagaagggcatcatgctcaaaatactttcccagcttgaaaatgttaatctctctgtagtcaacagtagcgtcttgcgatgtgggaaaatcactctcgacatcaccattatggctaagatgggtgacggttacaagatgacggtggatgaactagtgaagaccctgagagtagcgatatcttgatgactcattagctagcctgtcctaatgtacctaccaagcaagtgcagtattaattgtaatttgagaaaaagctannaatgannc

SEQ ID NO: 1698 - DNA, 933 bp, Oryza sativa
  Predicted polypeptide sequence is orthologous to G1652
agctcagccagcgcttcatcgccctctccaagatcgtccctggcctcaagaagatggacaaggcgtcggtgctgggcgacgcgatcaagtacgtgaagcagctgcaggaccaggtgaaggggctggaggaggaggcgcggcggcggccggtggaggcggcggtgctggtgaagaagtcccagctgtccgccgacgacgacgacggctcgtcctgcgacgagaacttcgacggcggcgaggccaccgccgggctgccggagatcgaggcccgcgtgtcggagcgcaccgtgctggtcaagatccactgcgagaaccgcaagggcgccctcatcaccgccctctccgaggtcgagaccatcggcctcaccatcatgaacaccaatgtgctccccttcacctcctcctccctcgacatcaccatcatggccaccgctggagagaacttctcattatcagtcaaagatatcgtcaagaagctaaatcaagcattcaagttatccctgtgaaggacttgctttcctgatcaagtctaatctagatcaaatctttggttggtaatcttcctactacctttttatcattagccttgagagaaatctgaggctgatggttctaattaggtcctttccctgcttctgcttctgaagagagtttgcttgcaatccaccacagagcacaccccctcaaggatttagccattaaccacctgtttttgctgcatgggtgcagagaatttgcagattacctaaatatccacctacaagtcttctattttctctcccatcacatttttttgcatggattgagctagtcactccatgttcttgggagagggtagaaatgtaaaaaagagacctgtctttttctagggcctgtttatcaaggggagtttgactttttcaaaaaaaccttattttcatttctccccttctg

SEQ ID NO: 1699 - DNA, 904 bp, Zea mays
  Predicted polypeptide sequence is orthologous to G1652
  misc_feature (770)..(770): n is a, c, g, or t
tcgaggccggccgggccgggagacaaccccggccgtcagctggcaaaatggaggactcgagcctgttcctgcagtgggcgatgagcacgctgcggcatgagcaacaacccgcggcagccgtcaacgacgactgcagcagcgaggcaacgttcccctcactccaagcgctccgcgaggcctcgcatgcggccgagatggtccaggagctgatcggagaagccccagcgaacagctggagctcgggcgacaccaccgacggcagcataggaggcaacagcaactcggtccctggccctgctgcggcggccatggagcacgatgtctggcctgctgcgtcgtcgaagacctctccggccaggcgcgccttgagcaggagcagcagcgacaccaaccctcccgtgagctggaacttcagcgccgcagcctcggcacagctggccggcagcgccgacggcatgctgccggaattcgcccccaagagcgccctaccgccggaccaagcgtacggatcaccgcgggcaaggagagccggcttgaagagcctggcgggatccatgtcgtcggcggcgtacgctcaagaccacatcatcgcggagcggaagcggagggagaagatcaaccagcggttcatcgagctctccaccgtgatcccaggcctcaagaagatggacaaggcaacgatcctttcagacgcgaccaagtatgtgaaagaactccatggaaagctcagggacctgggaggctggcggcagcaaccggcgcaagagcantcgagacggtggtgctcgtcaaaaggccgtgccctcatgctgcgcccgcgccggacgacgatgccctcccattgtcagcgtcgtcaggcacgccggctgagacgaagacgcagctgccggagatcgaggcccgg

SEQ ID NO: 1700 - DNA, 1547 bp, Zea mays
  Predicted polypeptide sequence is orthologous to G1652
gctcccccgaggactactcctcgccgtctcatcctctccttcggcggccaccacgccagggcgcccaagcaggagctgctcgacgccgccgccgccgcgctgccgtcgttccagcaggcgcgcccggcgcccaagcgctcctacgacgacatgatggccgaggccgccagggcgcctgccgccgccgccgccgccgcacgcccggcctcacagaaccaggaccacatcttggccgagcggaagcgccgcgagaagctcagccagcgcttcatcgcgctctccaagatcgtcccgggcctcaagaagatggacaaggcatccgtgctcggcgacgcgatcaagtacgtgaagcagctgcaggaccaggtgaaggggctggaggatgacgcccggaggcgcccggtggaggcggcggtgctggtcaagaagtcgcagctgtccgccgacgacgacgagggctcctcctgcgacgacaactccgtgggcgccgaggcctccgccacgcttctgccggagatcgaggcccggctgtcgggccgcacggtgctggtgagggtccactgcgacaaccgcaagggggtgctcatcgccgccctctccgaggtggagcgcctcggcctctccgtcatgaacaccaatgtgctccccttcaccgcctcctccctcgacatcaccatcatggccatggctggtgacgacttctgcttgtctgcaaaggatattgtcaagaagctaaatcaagcattcaaatcacccttctgatgggattagcttaatctatgtcaacttttttcccattagccttaaggctttcgcccgcagcggttcggcatcaggtccttccttgcctttgcttccgaagagagttgcttgcagtccccaagagtccccccacacaaagatagccatttccactggttttttgctacatgggtgcagagattgatcacctagctagttacctacttaccatcccattttatctgtctctccagttttttacatggtttgatgttgtcactccatgtttttgggagagagcagattgtaaaaaaaaaacagcctttttttctagggctttgctatataggcctggggagtttgacttttacaaacctaatttttctttctccccttcgcccgtatgttgccctttaattcaccttgttttttccatgagaggatggtgtttttcaaacaccagcacctaccttcgccgtcctctcaaccttgatcacactgctcccagaaaaagcttcagttgtggagaaaatggcgccgtctttttttttaatcagctctgagggggactttgcaagccttgatttggaagtactgtagggatgcctcacttctattgtttctgttttttttgagggtcctacaagttggccgccacttgaaacttgatggagcctttgcctatagttttcacatgtgagttttgttgtcacaggacaggatgaaggtgtagttgttgtcatctcttgtttactctcatacaagcataaataaataaatgtgctcgtttggtaccttggcaccaa

SEQ ID NO: 1701 - protein, 338 aa, Oryza sativa
  Orthologous to G1652
MDDSSFFMQWAMDTLHQLPSDSTAAAAYATDVAGDSGAFPSLQALRNASAAGGGGGFRDLTVQVDQVHRANSWSSSDSPGGGAATAAAGWSPHVTGGGGRGHRPMSWNFSAASAQPTTEDSGGGGGGGVVPAPLQAMETTATARAAVKKGGGGGSSSSAAAPGYVQDHIIAERRRREKINQRFIELSTVIPGLKKMDKATILGDAVKYVKELQEKVKTLEEEDGGGRPAAMVVRKSSCSGRQSAAGDGDGEGRVPEIEVRVWERSVLVRVQCGNSRGLLVRLLSEVEELRLGITHTSVMPFPASTVIITITAKASSLSNHPALLCLYICIKLPCVISS

SEQ ID NO: 1702 - protein, 361 aa, Oryza sativa
  Orthologous to G1652
MAYSTNQIMILQHAWMLVGEANSQLIISTVAHSWYQSNSIEVVLWWFWSRIAQTPTEYGFFGQAMACRTDEENDDDPRALEHLDPLSMQQLAESLANELFNQPQEQQEEQHGYHNPSLRVLPFVGDINKPEGHTPAAAAIRDSFFSLTNGSSSSLNFSALEQQQDSGPMTKFCSPLSEMKRGGRRATSSMQEHVIAERKRREKMHQQFTTLASIVPEITKTDKVSVLGSTIEYVHHLRERVKILQDIQSMGSTQPPISDARSRAGSGDDEDDDGNNNEVEIKVEANLQGTTVLLRVVCPEKKGVLIKLLTELEKLGLSTMNTNVVPFADSSLNITITAQIDNASCTTVELVKNLKSTLRNF

SEQ ID NO: 1703 - protein, 322 aa, Oryza sativa
  Orthologous to G1652
MSTLSNKVSLSSNLLNLQTGLAEEPEELTYMYHQEEHARMQEQFAGTPLVEQPVRFDQFYPASMAPNQFHPSHCSSFPAFGGSSALPSLAFGAVATTKKEQVQQPSPSSSNVLSFAGQVQGSTTTLDFSGRGWQQDDGVGVFQQPPERRSRPPANAQEHVIAERKRREKLQQQFVALATIVPGLKKTDKISLLGSTIDYVKQLEEKVKALEEGSRRTAEPTTAFESKCRITVDDDDGGSASSGTDDGSSSSSSPTVEASIHGNTVLLKICCKERRGLLVMILSELEKQGLSIINTSVVPFTDSCLNITITAKARLALPVYYS

SEQ ID NO: 1704 - protein, 353 aa, Oryza sativa
  Orthologous to G1652
MEDSSLFMEWAMETLQHLHPLPATPPPAGGGYAGDNATFPSLQALRESSVSQNGMAPPEPTAHEGHRASNSWSSGDTDSVSGGGGGAVMEHDGWSTSPNSVRCAAGGGGGGGGGGLWPVSWNFSSAMTQPCNDQATPSNPPTTTRARYGGGGVRYLPAAVSPSPSAQTRRASSKGNGGGGSGSSSAAPYAQEHIIAERKRREKINQRFIELSTVIPGLKKMDKATILSDAVRYVKEMQEKLSELEQHQNGGVESAILLKKPCIATSSSDGGCPAASSAVAGSSSSGTARSSLPEIEAKISHGNVMVRIHGENNGKGSLVRLLAAVEGLHLGITHTNVMPFSACTAIITIMAKE

SEQ ID NO: 1705 - protein, 254 aa, Oryza sativa
  Orthologous to G1652
MDDSSLFLHWAVSTLQHQHPAAVAVVADDDATFFSFQELCDTEEVVVVPVQEEVITEAHGAAERRRRWRRAGDGVRVTAGGRGIHHQEDLGAHGGAAAAYAQLEHVVAERKRREKINQRFMELSAVIPKLKKMDKATILSDAASYIRELQEKLKALEEQAAARVTEAAMATPSPARAMNHLPVPPEIEVRCSPTNNVVMVRIHCENGEGVIVRILAEVEEIHLRIINANVMPFLDQGATMIITIAAKASSSLLY

SEQ ID NO: 1706 - DNA, 716 bp, Glycine max
  Predicted polypeptide sequence is orthologous to G1672
agagagagtctggaatttgagctttagtcagaaaattaaaaaccaaccggattttctttttctatcctgtttctttgcttctcttttttcctctctctctctctttctctttctctctcataaaccgctacatacatgcactttttaaattagcaaaaacgtaaaggtactatatgtgtgtttgaagcagctcctatagccaccttttcctttattatttctttttctcactgccttcagttaaagtagcgagctagataggaaattctggtgtttttccatggttaaagaaggtttatagctcaatcctattagaacaacctcggacatgctcagttgtggactgttccataaaaagggagttgaaatagtatttgaaggcatctggtttcatcaagagagatagcacacgcgcgcgcacgcgccagagatgagttagatcagcaactggagttctgtaagcagctctgatctcatagatgccaagcttgaagagcatcagttgtgtggatccaagcagtgccccggttgccgacacaagtttgaagggaagcccggattggctaggcttgcccgcaggggtgaagtttgatcccacagaccaagaactaatagaacatcttgaagccaaagtggaggcaaagaacatgaaatcacaccctttgatagatgagttcattcccactattgaaggagaagatggaatttgttatacc

SEQ ID NO: 1707 - DNA, 503 bp, Oryza sativa
  Predicted polypeptide sequence is orthologous to G1672
tcttgttatctcctttgctcttctactgctcatcctcctcttctactactcgtcctctttgctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgtgaccagggacggcctgagcaagcacttctttcaccggccgtcgaaggcgtacacgacggggacgagga

SEQ ID NO: 1708 - DNA, 602 bp, Zea mays
  Predicted polypeptide sequence is orthologous to G1672
ccttcctcctcttctcttcctctcgatctcgtttctctccaggctcggacggcacagcgcgcggcggcgtggatcccgtctccctctcctcgatccagccctctgaaccacatgcatgtgatcatgcacgggctggtatggtaaagggcgcgccgtgctgctagactcgtatgggctcttggcagcaaggagagctgcagggagcagccatggatggtgcagcggcggcggcgactggaagcggcggcggccaccgcgtcgtgggctcgaggaacgaggagcacgggaagtacctgtcggagtcgagctgctgcccacggtgcggacacaagctcgacccgaagctggactggctggggctgccggcgggggtcaagttcgacccgacggatcaggagctgattgagcacctgcaggccaaggtctggcctgcctcggcagcggcgccgtcgcaccctctgatcgacgagttcatacccaccattgaaggggaggacggcatatgctacacccatcctgagaggctgccaggtttgacgaaggacggcctgagcaggcacttcttccaccggccatccaaggcttacactaccggcactcgc

SEQ ID NO: 1709 - DNA, 2058 bp, Zea mays
  Predicted polypeptide sequence is orthologous to G1672
gccggccgggaatcctcagtcggcctttgactgctccttgacttgaacttcgcgcagcaagacggagaaacaagaaccatccctccccctaccgctgctactcatgcacgcgcgcactgcctcctggtgccgccgcgtatgatccagacatgaatagggcgcacagcagcagcagctccaagctcatcaacgagaagctcgtggaacaccggatctccactgcgaagcactgcccccactgcggcgagaaaatcgacagcaaaccggattgggtggggctgccggcaggcgtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgacgagggatggcctaagcaagcacttcttccaccggccgtccaaggcctacacgacgggcacgaggaagaggaggaagatacagacggagtgcgacgtccacaagggggagacgaggtggcacaagaccggcaagacgcggccggtgatggtgaacggccgtcagaaggggtgcaagaagatattggtgctgtacaccaacttcggcaagcaccgcaagccggagaagacgaactgggtcatgcaccagtaccacctcggcgacctagaagaggagaaggagggggagctggtggtgtgcaagatcttctaccagacgcaacccaggcagtgcagctggtcctccgaccggggcgccgccgccactgccttggcagcaacggcggcggcagcggcggcgcaggagcagcataggagggatagtggcagtggcagctgctcgtctagggaccacgaggtgtcagccacatcgttcccagccggatacacagtcaccacggccgtcgagatgcagcagcatatgaagcagcctgcggaccatttcagcttcgcgcctttcaggaaaaccttcgaccaggaggttggtataggtggtgatcaggtgccatctaatcagcttggacgttcagagccgcatcatgccggcctggggcagcagccacacggcccggtgctcgcgacgaagacggctgtgcctgctacagctttcctgatcagtaggccatcgaaccctgtctcgactatagtgccacctgcaatgcagcacgcatcagttgttctcgatcatgatcagttccatgtgccagcaatccttctccatcaccatgacaaatttcagccacaacagcaccaacagtcgcagccacaacaaaagcttgaccgcagatctgccggcttggaagaactgataatgggctgcacgtcgtccacaagcacaaaaggagatgcttccattgctcacccccaagagacagaatggccttacacgtactggccacctgacaaccaagatcatcatggatagtagcaacagggacctggtaaatagtggcgatgatgtgaatgctgaaggaacactaaccgcaaccactttcactggaatggtttttgtctgcttgaatatgcagcgttgctttcttggagaatgtacacctacaatagtggggaaagaacagagaaaaaaaacatatctctgtaaatctccctcaataaagaaatgaggataaaactagttaacagtgtgagctctccaagacagaagagacaaaatggccaacgaaaagagaagggggaaagaccgatgggaggaaaggtactgtgtgtgctgacattgaagggatcatgtgtggacagtttagatgtattagaacaccttaatcaagtataactataatcagtttacggtttatcacagttttttattcgtgctacctgttttcccaattgtaaaaactagtggcattgtttaatttgcatgtacattaacccttttaaattccttttagtttctaaattgatgctgattttcctttggttagttcatgctaatatgcatcacgaagaaataaagttagtaagaagcgcaaaaaaaaaaaaaaaaaaggccccta

SEQ ID NO: 1710 - protein, 505 aa, Oryza sativa
  Orthologous to G1672
MYTSPTLLALSFALLLLILLLYYSSSLLYSQLATRRRLTHACARSLPDAYESGMNRGHISSSELIDAKLEERRISTAKHCPSCGNKLDCKPDWVGLPAGVKFDPTDQELIEHLEAKVREEGSRSHPLIDEFIPTIEGEDGICYTHPEKLPGVTRDGLSKHFFHRPSKAYTTGTRKRRKIQTECDVQKGETRWHKTGKTRPVMVSGRQKGCKKILVLYTNFGKHRKPEKTNWVMHQYHLGDLEEEKEGELVVCKIFYQTQPRQCSWSSDRGGGAAATASAVTTAAVQQDQQRRRDSGSGSCSSTRDHEVSATSYSTAGYAVAAAVEMQHLKHAADHFSFAPFRKSFEEVGISGDQVHSNQLGRSEQQHAGQEQQPHRPLLATTTAVPATAFLISRPTNPVSNIVPPAMQHASVVLDHDQFHVPAILLHHDKFQQQQQQKLDRRSAGLEELIMGCTSSSTKGVVYTCTFRKLQFLTPKRQNGLTSHTGLLTTRIIMDSSNKAAFDMH

SEQ ID NO: 1711 - protein, 567 aa, Oryza sativa
  Orthologous to G1672
MDGVVAEDQAGGSGSGHRRLIGSRIEEHRKYMSEESCCPRCGHKIDRKLDWVGLPAGVKFDPTDQELIEHLEAKVRPGGEAAAHPLIDEFIPTIEGEDGICYTHPEKLPGVSKDGLSRHFFHRPSKAYTTGTRKRRKIQPPAAAASSGGGGGNASSSSSASAAAAVARHGHQQQQQQQRSETRWHKTGKTRAVVGGGRQRGCKKILVLYTNFGKHRKPEKTNWVMHQYHLGEAEEERDGELVVSKIFYQTQPRQCAAADAAATASASAVDRRTTSLRDRAAAAAAAAAAAAPMASANVSVAAFHGGAAGIDEFSFAQFRSSFEEAGMGASSSDHQSAMVDQRRRQQQHDDDEHDHRRGGGGHHYVGQQQSVAATFHVVSSPADPIARLMSPAAAHQGTVMLRQPEPPYIYHHQEDERPHQPRKFDGRSTSGSGLEEVIMGCTSRRSKGGETSGGKDGTEWQYPSFWPSDSQDHHGDKDDIEAKQKGETEKEKGEEKQSFSRYTFAKKYSMNKETLKISSILHSGILSESKLPENFPVCVVEGEYDEHGNAWMNLILPFSDSSKLRLM

SEQ ID NO: 1712 - protein, 567 aa, Oryza sativa
  Orthologous to G1672
MDGVVAEDQAGGSGSGHRRLIGSRIEEHRKYMSEESCCPRCGHKIDRKLDWVGLPAGVKFDPTDQELIEHLEAKVRPGGEAAAHPLIDEFIPTIEGEDGICYTHPEKLPGVSKDGLSRHFFHRPSKAYTTGTRKRRKIQPPAAAASSGGGGGNASSSSSASAAAAVARHGHQQQQQQQRSETRWHKTGKTRAVVGGGRQRGCKKILVLYTNFGKHRKPEKTNWVMHQYHLGEAEEERDGELVVSKIFYQTQPRQCAAADAAATASASAVDRRTTSLRDRAAAAAAAAAAAAPMASANVSVAAFHGGAAGIDEFSFAQFRSSFEEAGMGASSSDHQSAMVDQRRRQQQHDDDEHDHRRGGGGHHYVGQQQSVAATFHVVSSPADPIARLMSPPPAHQGTVMLRQPEPPYIYHHQEDERPHQPRKFDGRSTSGSGLEEVIMGCTSRRSKGGETSGGKDGTEWQYPSFWPSDSQDHHGDKDDIEAKQKGETEKEKGEEKQSFSRYTFAKKYSMNKETLKISSILHSGILSESKLPENFPVCVVEGEYDEHGNAWMNLILPFSDSSKLRLM

SEQ ID NO: 1713 - protein, 569 aa, Oryza sativa
  Orthologous to G1672
MLMNLCPAKCQDGRGYPPWNFLAGTGTAGWPYRSDLANPTSLQQQQQQRGDLISLPARRALLKEVIKQLSSVLLAIYIFEVHPHWINRPRVNRVSNITDSHAEKDHHSSTRPPPYAHLYSQLATRRRLTHACARSLPDAYESGMNRGHISSSELIDAKLEERRISTAKHCPSCGNKLDCKPELIEHLEAKVREEGSRSHPLIDEFIPTIEGEDGICYTHPEKLPGVTRDGLSKHFFHRPSKAYTTGTRKRRKIQTECDVQKGETRWHKTGKTRPVMVSGRQKGCKKILVLYTNFGKHRKPEKTNWVMHQYHLGDLEEEKEGELVVCKIFYQTQPRQCSWSSDRGGGAAATASAVTTAAVQQDQQRRRDSGSGSCSSTRDHEVSATSYSTAGYAVAAAVEMQHLKHAADHFSFAPFRKSFEEVGISGDQVHSNQLGRSEQQHAGQEQQPHRPLLATTTAVPATAFLISRPTNPVSNIVPPAMQHASVVLDHDQFHVPAILLHHDKFQLLFYPNIINNEHATQQQQQQKLDRRSAGLEELIMGCTSSSTKGVCFYSKHADERERERNLQYS

SEQ ID NO: 1714 - DNA, 2226 bp, Glycine max
  Predicted polypeptide sequence is orthologous to G1750
ctgaactcttgttcttctttaccgattcaacaacagctcagcagtggtagtacccatgagcctgcagaatctgcactttttttgccttggcttctattctctcctcactttgaatcggaagatatcctttccattcaaggcagcaagcagaagtttcaacgaaagtctcctctcccacacagctactatcttctcaacactattggaatcaccatcatctgaataattcccttttttctttctctttctctcacacacccccatgatgtcaaaagttgttattttctctttattcctatcatcagtcccgaccatgtcttaatatttctttctttcttctttttcaaccttttggaagatttcggtttaaccttccccttcacgattctctctccctctctccctcttattcccaaaccaagcccctatttgtgttcatttcgcgtcacattagaataagaaacgcaatatggaagacagtatcctatgcaaacacacagtgcatcacaccgttaccaagaaactcatctcccccaaaaaatcatcccaaaccaattcgacgacagagcgcagaatagtgcggatttcatacactgatccagacgcaaccgactcctccagcgacgaggaaggtttccccttcgttcgccaaagaatgaagcgctatgttaaccagattgaaatagaaaccgccgccgccgaaaaagttgttcggaaaaggcccgccggtgaggcttgccgccggccggcgaagcttcactccgggaagaagttccgcggcgtccggcagcgaccgtgggggaaatgggcggcggagattcgggatccggcgagaagagtgcgtctctggttgggaacctacgacaccgccgaagaagctgccatggtctacgacaatgccgctattcgtcttcgtggccctgacgcgttaacaaacttcgtaacgccgcctcaaagagattctccgtctccgtctccaccgccggcggcggcggagactccggcggaggtttgcgagatgaaggttgtggtcaccgaagaagcctccggctccggctacgactccagcgaggatcattgccaccacaacctctcctctccgacttcggttctccagttccgaagcaactcgagcgaagaaaattccgagtctcagcagaaagcagaacaagtgttgagagaatgcgagggtgagacagaaacgagtttgttcgaggaaacgggtgagtttttggcgctggataacatgcctttgcctgcctgggatgacgtgttcaatttcgaaacgccagagtaccctcctcttctgtttcaagaggaggagaatctgaatctacttcatcagtcccagatgttgggcgaaacggtgcagttttcctcggaggaagggttcagtgatgaaagcagtatcatgctggccgactcgctcatagatttcgacagagcctgcccttcaccatcctccttgtgccaagtggacgatttcttccaagacattttgtttgcttctgatcctctcgttctgctctgaacactcttaaaacttactaaactgtcattcgttaatcgtcaatcgtccacttcacggcttgcccaatattcatggcagatttttgcttccggtggtaaaaaaaaaatgcctagtttctatttaattaaaatactatatatatatatatatatatatatatatatatatatatatatatatagttttatttgcgtatttatttagatgttttagatgctccgttacaaatagctaacggggggatgagttgagaacttgtgagcgaagttttgtttagtttttggttatatttgtaatctttttgcttaataagtaggatcgtacgttgagacttgagaatgtaatgtatatttgtccagatgttaatctaagtgtaatggcgttcttttctttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1715 - DNA, 1184 bp, Glycine max
  Predicted polypeptide sequence is orthologous to G1750
cgtacgcgcggtttttatccagacgccaccgactcctcctttgacgaggaaggtttccccttggttcgcaaaagaatgaagcgctatgttaaccagattgaaatagaaaccgccgcggaaaaagttgttcggaagaggcccgccggtgagccttgcaggcgaccggcgaagcttcactccgggaagaagttccgcggcgtccggcagcggccgtgggggaaatgggcggcggagattcgagatccggcgagaagagtgcgtctctggctgggaacctacgacactgccgaagaagctgccatggtctacgacaatgccgctattcggcttcgaggccctgacgcgttgacaaacttcctaacgccaccgcaaagagagtctccgtctcaggcgacaacggtggcggtgaccgaaagaagcctccggctccggctacgactccggcgacgaccattgccagcacaacctctcatctcccacttccgtgctccacttccgaagcaactcggagtctgatcagaaatcagaacaagtgttgagagagtgtgagggtgagggtgagttttggccgctgggataacatgccttctgccctggcttgggatgaagtgttccaattttcgaaacgccagagtaccctccccttctcctttcaagaagggaattttcttcatgattatcagtcccagatgttgggtgaaacgggtaccgttttcctcggaccaagggttcagtgacagtagtatcgtgctcgcagactcgctcatagatttcgacaaagcttgccctccaccatctaccttgtgccaggtggacgatttcttccaagacattttgttagcttctgatcctctcgttctgctctgaacactcttagtcagtcgactcaagttagtaaactctcattcgttaatccttcacgccagattttgcttccggtggtaaaacaaaataatgcttagtttctattaattaataaataaatttttaagtttttagatgctccgttacaaatagctaacggggggatgagttgagaacctgagagtgaagttttgtttaaattttactttattgtttgtaatcttttgcttaataagtaggatcgtacgttgagacttgagaatgttaatgtatatttgtccagatgttaatctaagtgtaatggagttcttttctttaaa

SEQ ID NO: 1716 - DNA, 1335 bp, Glycine max
  Predicted polypeptide sequence is orthologous to G1750
  misc_feature (1305)..(1306): n is a, c, g, or t
gaacatctctgtctctctctcttccttaccccttgcaataaccaccctaaaccctcccatcttctcacacctagcaaattactgccatcaacttattttccttcatcacccaccactctctatttctcacttgcttcatgcaattaaaactaccactaccacctttttccatttccttactcttttcttcaataaaatgagtgacacacaccaaactttcatgtccgtacaaccacccctgaatctccaccacccctttaacccacaagcctcaagctcaaattttgacggcgacccaccatgcaaaaccgccgcaaaaaccaaacctccgcgcaagaagctactccgggtaattctcaccgaccatgacgccaccgattctgactcctccggtgacgacgacgacccaaaaaacccaccgaaacacaaaaaggtgaaaagacaaatcacccacatcaccataaaccttccctctttctcagaagccccaactccagcaccaataccaacaccttcttcgtcttcttctattgatccgacccgtttaaccctacccaagaaacgacccgccgtgcctcgccgccgtagcaagttccgcggggtccggcagcggccatggggacggtggaccgcagaaatccgtgacccgaatcagagaaaacgggtctggctcggaacgttcgacacggcggaggaagccgccgccgtgtacgacgacgccgccttgaagctcaagggccccaacgccgtcactaacttccccctctccgccgccggaaaaacggaacatgataccgcgccgccggaggcggctttctccggcgaaggtttttcatctcccacttccgttctcacttactttgacggagactcgacgccactttacggtttccgttacggcgaggtcgacgcgttcgggtttgacatcgatgcgccgtttagtttgacagacgttaacttaggggtgctgagtcagcggttcgggaaggaagatttccgcgaggttgacccggacgagctcttgacgtggccgagttaaggggcgtatttatcatttcgaaaaaaatacagggaatgtttagtaattctaatgaagtttttttgtcgtattctgcattgaattccgaaactaccctcgtgactaagtttttgtgcagcttagtagagtgttagagagcaatagagtgatccaagtagtagtagagaattttgtcctatgttaatttgtgtaattaattgtattgttatggagaaagaggatatgatggaaagtattagaatgattctcttgtagtttcttatatnnttttataaagtaaagtattagaattaatt

SEQ ID NO: 1717 - DNA, 1813 bp, Glycine max
  Predicted polypeptide sequence is orthologous to G1750
cccacgcgtccgctctacctcccactctcacaatccctctctctctttctatcttcactccggctattacttattagcataactctcttttgctctgccttcccgccaaaacccttctctgtgatcaccaaggattcaaggttgagcgttgaattcttgaaccttgttgttgttgttgttgttgatgtgagtggagtgagatttcacttgaagcgcatccaaagttggccatattctcttctctctttctctctctctcttggaatatatctctagagacgaaaagcaaaagttgttacccataaaacatcttggtttttctttctgcttcaccaccaccaaaagtgtttccaaacgtctcaattcccccccagcatatacatctacttgtccacttttcccccataccctctaaattcttctcttactctttaaaccccacccttcatgcactccagccaacaccatcacacaacaaccttccctcttccctctctcactcaaacaaaaacatccttaaccactccaaaaacactcttttaggcatgtccgtacacgcaaaactgaagcaccaccccatgaacctagcatccccaagttcccattttgaggacgacccaccatgcaaaaccaagaccaaaacccaaaggaggctccttcggatcataatcaccgaccatgacgccaccgattctgactcctccgacgaagaacaacagcagcagcaacaaaaaacaagaagagtgaacagagaaatcacccaaatcaacatgcaacttcctctatcacataatagttccttttccccttcatcttcttattactcttcagcttccacctcatcggaacaaaacctaaagtgcaagagacccaacaaaaagccgccaccttcctccgccgaggcccgccgccgcaacaagttccgcggcgtccggcagcggccgtgggggcggtgggcggccgagatccgcgaccccacccgccggaaacgcctctggctcggaaccttcgacacggcggaggaagccgccacggagtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattttactaccacctgaaacggcgattctttgtgtcgtatttggtagagtttaatttgtagttattatcatgaaaagaagaaaaaaaaaatgaagtgtcaaaactagtgagtgagaaaaggagaaaaggaaagatggtgttatttgagaaggaaggactatattgtaatttcggtatataaattttgataattatttaaagaaactttggtattgtctatatatagatcatgggttaactt

SEQ ID NO: 1718 - DNA, 1238 bp, Oryza sativa
  Predicted polypeptide sequence is orthologous to G1750
tttttgggtgtactgcaataatttgctactatattttattctaatcgaagaacatgtctatatctcacatcaaaggtcttatttagatgcaacatactaattccacaacaccttatcgaagcctaccatactgcatcacatatatcagcaaccataccgtatatacacatcataaccttaccaaatcaggtcacatgcagagtcatcttcacatcataagttcaatactaaccaaaattacacaataccaagtttccaatgatgctatgcataacaataaagctgctaacgatagtaattacggataattggaccctcaggccccgccaacttcttccacacaggcggacacagcatggaaggcacggacacgggttccacagcccgatcgcttcttacgcttgcctgaaatcatcgtccacattggctccggagcaagcacctggacctcacagctactggcctcctccttgacccgaccgccacagctctcaccttcctccttcacccgtggaagaagggtcggcttagctgtcccaattggcaaggtgattggcctcacagctgcttcaggcggtgaaatagttggcttgggtagctccagcggcagcgagtagcagcggacggaggcgaagttggtggcggcgctggaaccgcggaggcggacgctggcggcgtcgtatgcggcggcggcctcctcagcggtgtcgaaggtgccgagccacaggcggcggcggaggtgagggtcgcggatctccgccgcgaacctcccccacggccgctgccgcacgccgcggaaccgcgcggtcggcctcgcctcccccgcccccgcctccatcacgcggcgcttcacgcccccaccaccaccaccaccaccacccaccttacccctccgccgcggccgaggctgcgccaccgcaaccgcctcgtcctcgctggaggacgagtcggtggcgtcggcgtcgcgcacgaggatacgcaccacgcgtccccgcggcgccgcccccgccgccagctcgtgcaggctagggtttgtacccatgcctcgggaaacccacctcaatccatacagggtgttcgatcgatgtggctacgcgtagcctccgcgccccgccatgggagcgtggggggtggaaggcgaggtgggggggctagggtttagggttagggtttggttccgatcgatgcggcggcgtgcggcggggtgggggtgccacgggggcccgctagtttagagc

SEQ ID NO: 1719 - DNA, 1179 bp, Zea mays
  Predicted polypeptide sequence is orthologous to G1750
acccctcactcagcccgtccccttttcccccattgggtccccggaggccggccggggtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaataaaaaaaaaaaaaaaaaaaaaaaaaaaaaaaaaaaaaaagaaaaaaa

SEQ ID NO: 1720 - DNA, 1305 bp, Zea mays
  Predicted polypeptide sequence is orthologous to G1750
  misc_feature (1300)..(1300): n is a, c, g, or t
  misc_feature (1303)..(1304): n is a, c, g, or t
ttgggtacctcgaggccggccgggctcctcagcccgttctcttttcccccaccctatcaacacaatttacccttcgtcttcccgcttccagcgcacccccatcttgagtctcgccgccgcaagcttgtgtaaggtgtaaccctaaccctaaaacacttaccttcgcctccagcaccacacttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgccagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaatatgttcctgatctatgtgatgcaatgtgctgtgctttgattgtgggatcaaacctgtcatatagtagtacaatctagatcctttcacatgaacagtgatacctagatgtatttgatggttatttcagttgaattaaacaaaattgctcnccnnc

SEQ ID NO: 1721 - DNA, 365 bp, Glycine max
  Predicted polypeptide sequence is orthologous to G1756
gactgaacaagtgatcaaagcatcagaagagaaagtagctctacaaggattgaaagtcacgcgcagcacctaaatgtaaaaaaagcaagaagagccagaacaagagtgtggtgaagcaggtgacaacagcagaaggtcttgatgatgcatgggcatggcgaaaatatggacagaaaccaataaagggttcaccctatcctcgaagctattatagatgcagcagttccaaagggtgtttggcgaggaaacaggttgaaaggagccacttagatcctgcggtttttctggtaacctacactgctgaacacagccatccccacccaactcgaagaaactctcttgctgggaccactaggaagaacaat

SEQ ID NO: 1722 - DNA, 670 bp, Medicago truncatula
  Predicted polypeptide sequence is orthologous to G1765
  misc_feature (598)..(598): n is a, c, g, or t
  misc_feature (613)..(613): n is a, c, g, or t
  misc_feature (615)..(615): n is a, c, g, or t
gataactttgatgacaagaaagaagatgaagttgtgcttcctgggtttagattccacccaacagatgacgagcttgtcggattttatctacggcgaaaagtggagaagaagcctcttcgaattgaactcatcaaagagattgacatatacaaatatgatccatgggatctaccaaaagctagtactgtgggggagaaggaatgctatttcttttgtttaagaggaagaaaatataggaacagcataaggcctaatagagtgacaggatctggattttggaaagctacggggattgataaacctatatattgtgttaaagaatcacatgaatgcattggactcaagaaatcattggtttattaccgtggaagtgcagggaaaggcaccaaaactgattggatgatgcatgaatttcgtctaccacctaaaggaaaaactagcaataatcaagttcttaaccataccaatgatgttcaagaagctgaagtgtggacactatgcagaatattcaaacgaattccatcatacaaaaaatacacaccaaatgtgaaaaaagactcggaagcagcagcattcactattaactcttcaagttccnaaacatgcagcttanantcagaccacacccaaccacaattcttgactttcacaactcacacatggttgttca

SEQ ID NO: 1723 - DNA, 2780 bp, Glycine max
  Predicted polypeptide sequence is orthologous to G1777
  misc_feature (3)..(3): n is a, c, g, or t
ggntagaggtcgtttctctctcttactctctctctttctctgcgtgtgttcgtgagtggagtggcgtatgtgtagctgcgctctctatcgccggcgctctcgtcggaatttccgttattgatttttccgatcaccggattcgatccaatccctaatccctaatcccgcgattccatcaattgaaaaaattgaatagccattgaaccgtttcgtttcggaggtggcggatatggacgattacgcgagcagcgacgaggattaccattacgactccgatcaggaggactccgtcgaggcctacgaaaacgacgagaattacgccttgctctcttccaagggcaccactactaaggtgattacaaaggaatcactgctagctgcacagaaggaggatttgcgcagagtgatggacatgctatcggtgagagagcaacatgctcggacgctgcttatttttcatcgttgggatgtggagaatctgtttgaagtgttagtagacaaggggaaatcatttctctttgctgaagctggtgttagtgtggatgaacatcgcaactctgactcacctgttcctcctgcattcatgtgctacatctgtatggaggaagttcctagtagcaaaacaacgagaatggactgcggtcactgcttttgcaacggctgttggatagagcactttattgtcaagataaatgagggtcaaagtaagcgcattagatgcatggaacacaagtgcaattccatatgtgatgatgccgttgtaagaactctactcagtagagagcaccctcatatggcagagaaatatgaacgctttctgcttgaatcttacattgaagacaataagagagttaaatggtgccccagcacacctcattgtgggaatgcaatacgggtcgaggatgatgaactgtgtgaggtagaatgttcatgtggtgtacaattttgttttagttgtttgtcagaagcacactccccttgttcatgtctgatgtgggagctttgggctaagaagtgtcgagacgaatcagaaactgttaattggataactgttcatacaaaaccatgtccaaagtgtcacaaaccagtggagaagaatggtggctgtaacttggttagctgtatctgtggccaagctttttgttggttgtgtggtggagctaccggccgagagcatacttggtcaagtatagctggtcatagctgtggtcgatacaaagagcaagaaaagacagctgaacgtgcaaagagggatctatatcgttatatgcattatcataaccgatataaagctcacacagactcctttaagattgaaagtaaactgaaagagactatacaagggaagattgccatttcagaagaaaaagattctacactcagagattatagctgggtaaataatggactctccagacttttcagatctaggcgagtcctatcatattcatatgcatttgcattttatatgtttggagatgagctttttaaggatgaaatgacagatgctcaacgggaaataaaacagaacttatttgaggatcaacagcaacagcttgaggcaaatgttgaaaagctctctaaaattttggaggagccttttgaaaccttttcagatgataaggttgttgagataaggatgcagatactcaacctttcaacaattattgacaaactttgtcaaaaaatgtatgaatgcattgagaatgatctattgggttctctcaatcttggcattcatagtattgctccatacaagtcaaagggcatcgagagggcatcagaactttcatttggctggaacaacaaagtcaataatactggtaaatgccttttgtgggttttgtttgaataattagctggaccaaaacccttttgcgttagcattgccattgtttgtgatacctcctctcataatgcattaacaggaaattaagtgagcccaattttgatttcttgcttccatttttgtttcttttgttatgcattaaaatgaagaagtattacttgtagatgaggttacgtatataattatgcttatagtgcttattgtagatcttgttgttatttaccaacatggaaatatggtggcaactcataaatttatatttttagcttccttatcttattatgttatgaatgttcttatgtatgtcttcttcagtttgactttgtggatgctcatcagaaaatgtttctgagtgaaaaggattattgtatatatgctgcaagcgtaggtgtaacagaagaacttgatcgaccatctggatcagggagttcagacgataatggatgttcttctcgtaaacgtgctagaaaagagggtcttggaggtggtggtttttttgatctaaacttgccagcagagtttgtagacagaaattgactttgaaggacaccttattatacgtacaggcgtacaggtctaacaacataaaattgctttgcttgcctttggaaggaaggaattattctttttggatttcacaccccatttgctttctcatatctttcttttagccatatgtctctgctgagataagatatgtttccaaagtttcttattcctatgccatctacctttctgtttgaaatcctagcgctgtatatagataccttggcatttatttgctagtagttttatgtaaatggctaccttgaggacaacttctagggtgcttttattcctatcttatggagttattataggtggaggtaacttcactgatttttcttcccccatgtttacactattttaacttgtttaagttacaattttc

SEQ ID NO: 1724 - DNA, 965 bp, Oryza sativa
  Predicted polypeptide sequence is orthologous to G1777
ccgggctgcaggaattcggcacgaggcgccgaggaggtctccccgacggcgtctcgtcggaattggagcaggaggacgatgacgatgactgctacctgagcgatcaggaggacgacgccttggaggagtccgtcctccaggtgctggaggacgaacgcgacgaggattgccattggtcctccacctccgtgatcaccaaggaatccctcttggcggcgcaggtgattccgcgatctgagattgaagccttttccctttccttgccttggtaaaattttgtttggtttgtttgggattttgcagagggaggatcttaggaaggtgatggagttgctagggttgagagagcaccacgcgcggacgctgctcatccactacaggtgggatgtcgaaaggattttcgagctgcttgatcagaaggggagggacaggctcttctcggaggctggtatccctctccaacctgctaataatcccggctcgccctcctcaacggaggtaacctgcaatgtttgctatgacgatgtgcccctctcggacgcctccaagatggactgcggccacaactactgcaatgaatgctggacaggatatttcattgtgaagataaatgagggacaaagccgccgtatcaagtgcatggctccgaagtgcaatactatctgtgacgaagcaatagttcgtaagctagtaaatgcaaagcggccagatattgcagagcgctttgcaaggttcttgttggaatcttatattgaggacaatgatacagtcaagtggtgcccctgcacaccgcattgtggaaatgctatacgcgtcaaaggtgatattcactgtgaggtggaatgtacatgtggacgccagttttgttttaattgctcctcagaagcacattcaccatgttcctgtgtgatgtgggagctctggatcaagaaatgcccgtgacgagtcagagaccgtgaattgga

SEQ ID NO: 1725 - DNA, 2670 bp, Zea mays
  Predicted polypeptide sequence is orthologous to G1777
gccggttcatcaaaggacgccgcaaagacatcagcccagccttccccaattccggccacacccgctacgcctgtggcgccgcctgccgcctccccttcctcttcgcttcccgtgcaagcttcaccgccgccgtctccgcctcccgtcgcgatgcttccccttccgcgccgcggttcctctatccccgccttccccgcccgcgccggctcttgcacctgaccgacccaatccgcctatctgttcccctcttccgtgcgagaggtactatcgccggccgtttcgtttcggggctgatcggatcggcgtaggctgatgggccgcgacgctgaggagacctcgccgccggtgccctcgtcggaattggagcaggaagacgacgacgactgctacctgagcgatcagggggacgatgccctagaagagtccgttctccatgtcctcgaggacgagcacctcgaggactgccattggtccgcctcatccgtgatcaccaaggaatccctcttggcggcgcagagggaggatcttaggaaggtgatggagctgctagggttgagggagcaccatgcccggacgctcctcatccactaccgctgggacgtggagaggattttcgagcttctcgatcagaagggcagggatagcctcttctcggaggctggtattcctcttcagtacaccaataatgctggcccaacctcctcagcggaggtgacctgcaatgtttgttatgatgatgtgccaccctcgtgtgccttggagatggactgcggccacagctactgcagtgattgttggactgaatatttcattgtgaaaattaatgagggtcagagccggcgtgtcagatgcatggctccaaagtgcaatgctatttgtgatgaagcaataattcggaaactagtcattgcgagacacccagatattgcagaacgttttgaaagatttttactggaatcatatattgaggataatgatacagttaagtggtgcccaagcacaccacattgtggaaatgctatacgcgtcaagggcgatatttattgtgaggtggagtgcacatgtggatgccagttttgttttaattgctccttacgagcacactcaccgtgttcctgcatgatgtgggagctctggatcaagaaatgccgtgatgaatcagaaacagtgaattggataacagtaaatactaagccctgtcccaagtgtcacaaacctgtggagaagaatggtggctgcaacctggttgcatgtatatgtggacaagcattctgctggttatgtgggggtgctacaggtagagatcacacatggtcaactattagtggccacagttgtggcaggttcactgatgatcagactaagaagacagaacaagcaaggcgagacctctatagatatatgcactaccacaatagatacaaggctcacaccgactctcttaagcaggaagcaaagctaaagaatgagatccaggggaagatatccatttcagaaaataaggagtcaaagataaaagattattcttgggtcataaatgggttaaacaggctgttcagatcaaggcgtgttctttcctattcgtatccgtttgcattctacatgtttggtgatgagattttcaaggatgagatgactcctgaggaaagagaactgaagcagatttatttgaggaccagcaacaacagttagaatttaatgtcgaaagactgtctggtttccttgagaaagattttcaactttttaccgatgatgaggtcatggatacaatgaagcatgttataaatctttccaatgtggttgataggctctgcaaacaaatgtatcaatgcattgagaatgatttgttatatcctctacgcacacctcacaacattgctccatacaaatctaagggcattgacagggcctcggagctcaatattagttgggatcctggtgaacaaagttcacagtcaacaaaacatagccaggatgaacacaggaacaaacaagcatcaaatattttgggtaaacgaactcatgaattgcatggttcgagttcttctaacaagcgagagagggtagatgttaacggtggtggtggtgcactttttgatctcaacgtgccagctgaagtggtggacaagatctgaaacttcattatctgatgggtgatggcacattcctttgaactgtacagctgacttaagcttcgtcaccaacataaaggaaaaaatactgttcttttttgctgccttaccaccatagagtacctgcatgtcaaatttttaccctggtgcttggatcccaaggtatagagtagcttttaagttctatatgtcgcatttcatggcgtgatctgaagccaatgttcatagttctgatgaagttgtacccctcaagcaagatgaggatattttggaatagaaccatgcctgtgttgcaaattccagatataatgtatgcagcatggtgaaaagggaattgtttgttgacaagaatgtgggtgattatttcctggcaaatgggtggttctattgccaatgaagacaatgactgattcgtcgtattaaatgtgcactttgttgcttccggcccccccccatcttgtttctaggacagttttgtattcaacctgtgaaaatcccggttttctgggcacacattccagatttttatggctaaaaa

SEQ ID NO: 1726 - DNA, 514 bp, Zea mays
  Predicted polypeptide sequence is orthologous to G1777
cgaggtctcatgaaatatttctgaaaagcttacataagtgccgaatttgtcttagtgaaaatactggcagaaatttcatcaagctcccatgccaccatttgttttgcttgacgtgtatgaagtctcactgcagaattcacgtaacagaagggagtttaaccaagctcacatgccctgatacaacttgctgcagcccacttccaccatcagttttgaaaagcctcctgggagatgattgctataagcgatgggaatcattcgcgttacagaagctcttagatacaatgcctgatctggtatattgtccgaggtgtaatgctgcctgcttggaggatgacaatgatgctcaatgcccagagtgttttttcaccttctgctctttgtgcaaagaacgcaggcatgtggggaaggattgcgttactccagaagaaaagattaggattctgagggaaaaacaccagaaatattccctcccagaaaaacaattgttgaaagaacagagggaaatagatga

SEQ ID NO: 1727 - protein, 624 aa, Oryza sativa
  Orthologous to G1777
MVTDAEEVSPTASSSELEQEDDDDDCYLSDQEDDALEESVLQVLEDERDEDCHWSSTSVCPPTIHRFILVVFVVRVPIASVVDGFLRLQVITKESLLAAQREDLRKVMELLGLREHHARTLLIHYRWDVERIFELLDQKGRDRLFSEAGIPLQPANNPGSPSSTEVTCNVCYDDVPLSDASKMDCGHNYCNECWTGYFIVKINEGQSRRIKCMALKCNTICDEAIVRKLVNAKRPDIAERFERFLLESYIEDNDTVKWCPSTPHCGNAIRVKGDIHCEVECTCGRQFCFNCSSEAHSPCSCVMWELWIKKCRDESETVNWITVNTKPCPKCHKPVEKNGGCNLVACICGQAFCWLCGGATGRDHTWSSISGHSCGRFTEDQSKKTEQARRNLYRYMHYHNRYKAHTDSLKQEAKLKGDIQGKISISENKDSKIKDYSWVINGLNRLFRSRRVLSYSYPFAFYMFGDEIFKDEMTSDERELKQNLFEDQQQQLEFNVERLSGFLERDFQNFSDDEVMDTMKHVINLSNVVDRLCKQMYQCIENDLLYPLRTPHNIAPYKSKGLDRASELNVCWDSSEQGSSIFGKRQLGSSSNNNGRPHKRERNDAHGGAALFDLNVPAEVADKI

SEQ ID NO: 1728 - DNA, 635 bp, Glycine max
  Predicted polypeptide sequence is orthologous to G1792
gcacgagccacattggcatgcctagaagaagaggctgaggatgatgatgaagcagcagaggaataagtggcagcattagtggcaccaccagcagtcatagggtactcatcaggaaagttaaggattgcaaatggacctctcatggcataagcagctctatcataggctctggccgcttcctccgcagtgttgaaagtccccagccacaccctctgaccctgcctcgtggagtctcgaatctccgccgcgaacttcccccacggccgcctccgaaccccccggtaccggacatctccggcatcctccttagccctccccctcgacccttcttcatccatggttgcacttttggtaaggtactaatttttgtgttttttgcatgcatggtaaggtatgacaaggttggagtatatatatatggttgaaaaggcacaatctgattaggccacgcaagcattgttgccacgtgacgattagaagtttctgctattgaaaccaatgaccaatattgaaaagttcttgtgtccattgtatctggatggtcaaggtggtgggctttgcaaggtatagagattcttgtgccgcgctagcactcgctctttgaaacgccttctgcacatcgttgtttgggaatc

SEQ ID NO: 1729 - DNA, 520 bp, Glycine max
  Predicted polypeptide sequence is orthologous to G1792
ggtgaagtaccgtggagtgagaaagaggccatggggtaagttcggagcagagatcagagacccaacaaaacctacgggaaggcaatggttagggacatttgacactgctgaagaagctgctagagcttatgatcgtgcagccattgctttgaggggtgctcttgcaatccttaattttcctcatgagttccattctcatctcccttttatattatcaaattcttccactaagggaaatggaagttcttttgataaggaagttattgagttagagtatttggatgacaaggtgttggaagagcttcttgagttagaagagaagagaaggagtaacgaagactaagatcactggagtactattcattgttttgagatccccggccccttttattttctctagctctccacttgtattaatatctgaacttatgatttagggttcagattgatttccaaaaatcttccccacccattgattgaattaaattgtgtatgcttcaaaaatcttacaattaatgca

SEQ ID NO: 1730 - DNA, 517 bp, Glycine max
  Predicted polypeptide sequence is orthologous to G1792
aagaaaatggagggtggaagatcatcagtttcaaatgggatatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtg

SEQ ID NO: 1731 - DNA, 527 bp, Glycine max
  Predicted polypeptide sequence is orthologous to G1792
gtcactaagcaactttactgtatttaattgtacacaggcactacataccaatttaggattaaaaagttgaaccttatcttcctaataatccaagttttcattgatggttttccccatcgcaatcaaggagttcctctaacaatttgtcatccaagcactcaaataccacaacttgtttaccaatctcagtgttagatgatgaggacttcttgctaagagaagtcacattgcaaggagggtgttcatctgggaagttgagaatggccgtagcacctctcatctcaaaggcagcacgatcataagctcttgcggcctcctcagcagtgttaaatgtcccgagccacacacgagcaccatgtctagctgaatctctaatttctgcagcaaattttccccatggtctcctacgtactcctctatacttaatttgcgttggttccccttcattgaccttttcctttaaatcctccatttctgtcacacttatgaatcccttctgtcgtcttctcgccgtacggacgcgtggg

SEQ ID NO: 1732 - DNA, 596 bp, Glycine max
  Predicted polypeptide sequence is orthologous to G1792
  misc_feature (583)..(583): n is a, c, g, or t
cgggattaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggtgaatgtcttcatatatgatatgatttccttttaggcagcactttactttggtgagtatggtttataacttaagaatgactttgttgaaccatnttagtttgatcgt

SEQ ID NO: 1733 - DNA, 806 bp, Zea mays
  Predicted polypeptide sequence is orthologous to G1792
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 1734 - DNA, 472 bp, Lycopersicon esculentum
  Predicted polypeptide sequence is orthologous to G1792
tgaaagaagaactaatggtggtggcggagagataaaatatcgaggcgtacgtaggcgtccgtggggtaaatttgcagcggagatacgtgactcagcacgacaaggggcacgtgtatggctagggacatttaatactgcggaagaagcagcaagagcttatgatagggcagcttattcaatgaggggacatttagctatactaaattttcctgaggagtataatttacctagtagctcttcacatttttatagtgccggttcttattcttcatcatcaatggcttcatcatcatcgtcatcgtcctcgaggcaagttcttgaatttgaatatttggatgataagttgttggaggaacttcttgattgtgatgaagagccaaactagaggaaataaagatcatttcaaatgtgacggacgcatgcaaaaaggtttcactaagaaagctcatcatttatcatatataagctcaag

SEQ ID NO: 1735 - protein, 136 aa, Oryza sativa
  G3380  Orthologous to G1792
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 1736 - protein, 131 aa, Oryza sativa indica
  G3381  Orthologous to G1792
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 1737 - protein, 124 aa, Oryza sativa japonica
  G3383  Orthologous to G1792
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 1738 - DNA, 2088 bp, Glycine max
  Predicted polypeptide sequence is orthologous to G1793
ttccggtccggattcccccgtccgcccccgcctccgcaagtttcgaaattgaaaagggtgggagagatacaaagtgttcattgatttaaacccttgctagaacccttggtaaagcaagcaaataagggctcaatgaacaacaactggctttcgttccctctttctcctactcattcttccttaccagctcatgatcttcaagcaactcaatatcatcaattttcccttgggttagtgaacgagaacatggataaccctttccaaaatcatgattggaatctgattaacacccatagtagcaacgaaattccaaaagtggctgattttctaggagtgagcaagtctgaaaatcagtcagaccttgcagccttaaacgaaattcattcaaatgattcagattatctgttcacaaacaacagtctggtgcctatgcaaaaccctgtgttggacacacctagcaatgagtatcaagaaaatgctaatagtaatttgcaatcattgacattatccatgggaagtggtaaggattcaacatgtgaaaccagtggtgaaaatagcacaaacactactgttgaagttgcacctagaagaactttggatacattcgggcagagaacatccatatatcgtggagtaactcgacatagatggactggaaggtatgaagctcatctttgggataatagctgtagaagggaaggccaatcaagaaaaggacgccaagtttatttgggtggatatgataaagaagagaaagcagctagggcttatgatttagctgcactgaagtactgggggacatccaccactaccaactttccaattagtaactatgagaaggaattggatgaaatgaaacacatgacgcgacaagaatttgttgctgccattagaaggaaaagcagtggtttctccaggggtgcatcaatgtatcgtggagttacaaggcatcaccaacacggaagatggcaagcaagaattggcagagttgcaggaaacaaagatctttacttgggaactttcagtactgaagaagaggctgctgaagcatacgacatagctgcgataaagttcagaggtctcaacgctgtcacaaactttgacatgagccgctacgacgtgaaagccatccttgaaagcaacactctcccaataggaggaggagctgcaaagcgtctgaaagaagctcaagctctagaatcttcgagaaagcgcgaagagatgattgcactaggatcatccacattccaatatggaaccacaagctctaattctaggctacatgcttaccctctaatgcagcaccaccaccagtttgaacaacctcaacctctgctaactttgcaaaaccatgatatcagttctcacttctctcaccagcaagaccctttgcatcagggttacatccaaacgcagcttcagttgcaccagcagcagagtggtggttcttcttcttatagctttcagaataataatataaataatgctcagttctataatggttataatcttcagaaccaccctgcattgcttcagggaatgattaacatggggtcttcatcttcttcatctgtgttggagaataataatagtaccaataataatgttggtgggtttgtgggaagtgggtttggtatggcttctaatgcaacgtcggggaacacggtggggacggcggaggagctagggctggtgaaggtggactatgacatgccgactggtggttacggtggatggtcggcggcggcggcggcggagtccatgcagacgtcgaatagtggggtgttcacaatgtggaatgactgagggaagggaagctagttctagtaatgtatggcacaacgtacgagttagttaccatacaattttgttatgcttttttcttttttttttgtttttgggttttttaatattctcgcaattggaaaagaaaataggtgctgattttctgtgactaaggaagtgagcaaagaccatatatctatttatatttatgtctcttgttatggcgaatgtttgtgagacttttgcttgatttaggtaaactaatcaaacactgacttatatgtactaatgttttatttgttt

SEQ ID NO: 1739 - DNA, 788 bp, Oryza sativa
  Predicted polypeptide sequence is orthologous to G1793
  misc_feature (322)..(322): n is a, c, g, or t
  misc_feature (423)..(423): n is a, c, g, or t
  misc_feature (441)..(441): n is a, c, g, or t
  misc_feature (483)..(483): n is a, c, g, or t
  misc_feature (493)..(493): n is a, c, g, or t
  misc_feature (495)..(496): n is a, c, g, or t
  misc_feature (502)..(502): n is a, c, g, or t
  misc_feature (504)..(504): n is a, c, g, or t
  misc_feature (507)..(507): n is a, c, g, or t
  misc_feature (511)..(511): n is a, c, g, or t
  misc_feature (513)..(513): n is a, c, g, or t
  misc_feature (515)..(515): n is a, c, g, or t
  misc_feature (517)..(517): n is a, c, g, or t
  misc_feature (519)..(521): n is a, c, g, or t
  misc_feature (531)..(531): n is a, c, g, or t
  misc_feature (539)..(539): n is a, c, g, or t
  misc_feature (541)..(541): n is a, c, g, or t
  misc_feature (546)..(546): n is a, c, g, or t
  misc_feature (550)..(553): n is a, c, g, or t
  misc_feature (555)..(555): n is a, c, g, or t
  misc_feature (558)..(558): n is a, c, g, or t
  misc_feature (563)..(563): n is a, c, g, or t
  misc_feature (565)..(565): n is a, c, g, or t
  misc_feature (569)..(569): n is a, c, g, or t
  misc_feature (571)..(571): n is a, c, g, or t
  misc_feature (575)..(575): n is a, c, g, or t
  misc_feature (584)..(584): n is a, c, g, or t
  misc_feature (601)..(601): n is a, c, g, or t
  misc_feature (612)..(614): n is a, c, g, or t
  misc_feature (617)..(619): n is a, c, g, or t
  misc_feature (627)..(627): n is a, c, g, or t
  misc_feature (640)..(640): n is a, c, g, or t
  misc_feature (645)..(647): n is a, c, g, or t
  misc_feature (657)..(657): n is a, c, g, or t
  misc_feature (659)..(659): n is a, c, g, or t
  misc_feature (663)..(664): n is a, c, g, or t
  misc_feature (666)..(666): n is a, c, g, or t
  misc_feature (673)..(676): n is a, c, g, or t
  misc_feature (683)..(683): n is a, c, g, or t
  misc_feature (689)..(690): n is a, c, g, or t
  misc_feature (692)..(692): n is a, c, g, or t
  misc_feature (694)..(697): n is a, c, g, or t
  misc_feature (701)..(702): n is a, c, g, or t
  misc_feature (704)..(704): n is a, c, g, or t
  misc_feature (706)..(706): n is a, c, g, or t
  misc_feature (708)..(710): n is a, c, g, or t
  misc_feature (712)..(715): n is a, c, g, or t
  misc_feature (717)..(717): n is a, c, g, or t
  misc_feature (720)..(722): n is a, c, g, or t
  misc_feature (724)..(727): n is a, c, g, or t
  misc_feature (730)..(730): n is a, c, g, or t
  misc_feature (735)..(736): n is a, c, g, or t
  misc_feature (744)..(745): n is a, c, g, or t
  misc_feature (747)..(747): n is a, c, g, or t
  misc_feature (751)..(751): n is a, c, g, or t
  misc_feature (754)..(755): n is a, c, g, or t
  misc_feature (758)..(759): n is a, c, g, or t
  misc_feature (763)..(764): n is a, c, g, or t
  misc_feature (774)..(774): n is a, c, g, or t
  misc_feature (777)..(777): n is a, c, g, or t
  misc_feature (782)..(783): n is a, c, g, or t
  misc_feature (785)..(785): n is a, c, g, or t
ggagctccaccgcggtggcggccgctctagaactagtggatcccccgggctgcaggaattcggcacgaggggcacatgaccttgcagcccttaaatattggggtgcagggccaaacaccaaacttaacttcaatgtttctgattatgagaaagaaatcgagaggatgaagaccatgtcccaagatgaatttttggtgtacataagaaggcagagcagctgtttctcaagaggaacttcatcatataggggtgtaacaaggcgaaaggatggtagatggcaagcacggattggtaggattggagaaagtagagacaccaaagncatctatcttggtacctttgaaacggagatagaggcagctgaagcttatgacctagctgccatcgagcttcgtggtgcccatgcttgtgacccacttttgntatttagtaacctacttntaaggttggtttttaaaaattaggagccttattagagggttncaaagttctngnngggccntncgnaggntntnantnnntttgccggtntggtaaangntcaancttnnnnantgnttttngnttantnattnctttttacnccaagttgccccttttnggttcccccgnnnatnnnttttgggntttttttcccgtntcaannntggttccccntncctnngnttggccnnnnttttttngggttnncntnnnnttcnntntntnnntnnnngntgnnntnnnntcnttatnntaaattcnntnggtnccnnccnntttnntttttttttnttnttttnncnttc

SEQ ID NO: 1740 - DNA, 549 bp, Zea mays
  Predicted polypeptide sequence is orthologous to G1793
cccacgcgtccgcccacgcgtccgcccacgcgtccgcccacgcgtccgcccacgcgtccgcggacgcgtgggtgcgcaagtacgctgccccgcggtcgtcgcgcttccacggcgtcaccaggctcaagtggagcggcaagtacgaggcgcacctttgggacaacaccagccaggtcgaaggccgcaagcgcaagggcaagcacgtgtacttaggcagctatgtcgatgaagagcaggctgcaaaggcacatgatttggctgcccttaaatattggggcacagggccaaacaccaaactgaacttcaatatttctgattatgagaaagaaattgaggttatgaagaccatgtcccaagatgaatttgtggcctacataaggagacaaagcagttgtttctcaagaggtacttcatcataccggggtgtaaccagacggaaggatggtaaatggcaagcaagaattggtaggattggtgagagtagagacaccaaagacatttaccttgggacctttgaaactgaagaagaggcagcagaagcttatgaca

SEQ ID NO: 1741 - DNA, 2006 bp, Zea mays
  Predicted polypeptide sequence is orthologous to G1793
cattgggtacctcgaggccggccgggacgtcccccggcagcagtagccccagcccccagtgccgcagttgcgctcagctatctctgctgagccgattagataaatccggcggaggaagagggaagaattatcgtgcgatatttcccccctcccactccctctctctctctctcgatttgcccgagaaatttttttggttgtttcccgcatcactctccactaggccgccgtctcccccgctggtgctcgtcgcttcctgcccaattcggcgccattcgcccggcgcactccctattaattccctgcctcggtagtcactggccgattgccacgtgaaatttcctgttccgttgcctttcgggtgcgcctgaagtacccacacgctactagggttcaatcgtcgtcagcaggcttacctctcaatcactgcggggcggcggctcgagagtttgtggacagttggcgaagagatagttaggtttttttttttgtctcccgtgtccgatggaggaatcggacttgggaggtaatctgggtaagcaaacggaagaggataaggctgcgggagaatcaggggatgagggtaagatcgagaggagccaatctatcaatctgaatagagtgccagcagttgctgtagaggcgatgagcacccagggaaactgtgagacgcacggtgcagcagtgccaggaactaaggatgcaggcacaggaaaggcagggcaatccagtggcgatcgacaggaggagaagttacccaagtgtgagcaggtcgactatggaagtgaagttgaaggctgcgcagatgatgagaaccctggcaagagggctgctttagttactttggttggaaatgaatactgcggcgacgaggatgagagagttcaagtgctcaccattgtcaagaaggacgagcatgcagatgacattgtcgaccgtattaatcctggcacagttgcagggtacagtgaagtgaagggtgctgtaggtgcttctgccgccacttctgcggtgcgacctgctggctcccgatcgtcaagtttccatggtgtgactaggcatagatggagtgggaaatatgaagctcatttgtgggacagttcttgcagagtagagggacgtagaaggaaagggaaacaagtttatctaggaagttatgataccgaggaaaaagcggccagggcttatgatgttgctgctattaaatactggggcgaaaataccagactgaactttccgatttcacaatacggcaaggagttggaggacataagggatttgtctcgagaggaatgtgtgacatacttgagaaggaggagcagctgcttttcaagaggagcttctatttatagaggagtgacaagaaggcagaaagacgggagatggcaagcacgcataggactggttgctggaactagagacatttacctgggaacattcaaaacagaggaagaagctgcagaggcttatgatattgctgccattgagatacgtggcaaaaacgctgtgaccaattttgaccgaagcaactatgtcgataagggtatgcactgtatagaaggcgaaggcttgaggctgcttgcatccaagccagaagaatgacttccaagttcaatgcagtgattgtcgatcgagcagatttggccagacgtatatgcagcttagttggtacatatacagataggagaaccggttgcagtttgtcaatattcctgctttacatgacttgggattacagttaaatcgacccgctagcaaaaaaaagtgtgcaaatgttagtagatttggccagacatatatgaagattttggggttgtatcataaggcctcgtaggatagatctttctgcaaatgttagcgaagccagtgtttatgttctgtttgctagattagcgttatcagtttgcacgttccccttttttttctgaataattgtccttgtatgatcttgagggaatgcgtttacctggtcgttcgccattcttttaaaaaaaaaaaaaaaaaac

SEQ ID NO: 1742 - DNA, 806 bp, Zea mays
  Predicted polypeptide sequence is orthologous to G1793
atcgacacgttcgggcaaaggacctctatatatcgaggtgtaacaaggcatagatggacagggcggtatgaggctcatctatgggataatagttgtagaagggaagggcagagtcgcaagggtaggcaagtttaccttggtggctatgacaaggaggacaaggcagcaagggcttacgatttggcagctctcaagtattggggcactacgacaacaacaaatttccctataagcaactacgaaaaagagctagaagaaatgaaacatatgactagacaggagtacattgcatacctaagaagaaatagcagtggattttctcgtggggcatcaaagtatcgtggagtaactagacatcatcagcatgggagatggcaagcaaggatagggagagttgcaggaaacaaggatctttacttgggcacattcagcaccgaggaggaggcggcggaggcctacgacatcgccgcgatcaagttccgcggtctcaacgccgtcaccaacttcgacatgagccgctacgacgtgaagagcatcctcgagagcagcacactgcctgtcggcggtgcggccaggcgcctcaaggacgccgtggaccacgtggaggccggcgccaccatctggcgcgccgacatggacggcgccgtgatctcccagctggccgaagccgggatgggcggctacgcctcgtacggccaccacggctggccgaccatcgcgttccagcagccgtcgccgctctccgtccactacccgtacggccagccgtcccgcgggtggtgcaaacccgagcaggacgcggccgc

SEQ ID NO: 1743 - protein, 622 aa, Oryza sativa
  Orthologous to G1793
MASADNWLGFSLSGQGNPQHHQNGSPSAAGDAAIDISGSGDFYGLPTPDAHHIGMAGEDAPYGVMDAFNRGTHETQDWAMRGLDYGGGSSDLSMLVGSSGGGRRTVAGDGVGEAPKLENFLDGNSFSDVHGQAAGGYLYSGSAVGGAGGYSNGGCGGGTIELSMIKTWLRSNQSQQQPSPPQHADQGMSTDASASSYACSDVLVGSCGGGGAGGTASSHGQGLALSMSTGSVAAAGGGGAVVAAESSSSENKRVDSPGGAVDGAVPRKSIDTFGQRTSIYRGIDGQEDMKLICGIIAVGEKAKVARGDRMSNYEKELEEMKHMTRQEYIAHLRRNSSGFSRGASKYRGVTRHHQHGRWQARIGRVAGNKDIYLGTFSTEEEAAEAYDIAAIKFRGLNAVTNFDMSRYDVKSILDSSTLPVGGAARRLKEAEVAAAAAGGGVIVSHLADGGVGGYYYGCGPTIAFGGGGQQPAPLAVHYPSYGQASGWCKPEQDAVIAAGHCATDLQHLHLGSGGAAATHNFFQQPASSSAVYGNGGGGGGNAFMMPMGAVVAAADHGGQSSAYGGGDESGRLVVGYDGVVDPYAAMRSAYELSQGSSSSSVSVAKAANGYPDNWSSPFNGMG

SEQ ID NO: 1744 - DNA, 1723 bp, Glycine max
  Predicted polypeptide sequence is orthologous to G1794
caagtttgttcactccacacaaaagcaaccatatttttcagttttcacacctaaatcctttgacccatcatcactattaatctacaagctccatgttttgtttgcaatcccctgcgtctgcttgttggtatcatcagagctttgtgaaacataaagttaaagcagggcatattgcagagggagcaaaccgaatatttcaaaacttgttctactttttattatcactgttgcatttatttcagatatttagtatttgcctacaagtttgttctttagtttaaacacagacaagacgactctttatggcggctataaccaatttgaacttttcttccttgtgtaaaaaaaggttttgtgtgcgtttgtgcgtgttggagttggctttttgaagtgggtgcatgctgaagttatatgtgtatgtgaaagatgaagaacaatagagataaagaaaagggtaacgacgttgaccagagttacagacagcatcacacgttgtcaatgccaatgatgttttctggtttgaacagagagaaggagatgtcagccatgatctctgctttgacacatgtggtttgtggagaagatgagcatcatggtgctgattactctcttcttaatcacaatattaataatactaatagtgcagttgttggtgatgatgattttactgtaacatcaaatatggcttctggttctatgccaccttcttctacttgttcatctcaaggtggcaactctgttctcaagagaagacgggaatatgataatacaaatgatttctcacgtggaggttcattccctgctatttcaacaattgctgaaagttcaagcacggtaacaagaagaacggcgaatacagtatacgattacgaatacagaacagagaacgtgaaagtagtggaggaagaaccgaggagaaaatacagaggagtgagacagaggccatggggaaaatgggctgcggaaataagagaccctttcaaagctactagggtgtggttaggaacatttgaaaccgctgaggacgcagccagagcctacgatcaagcttcattgcgtttcagaggcaacaaagccaaactcaacttccctgaaaacgttagactcagacaacaacaagaacctccgttgaacttgaaccctccaccaccacctaatcatggggctattttgtcaattccttcaaccactgttcacactgaggctcttcagggttcacttggttcaagcaatttttatgagcattcttattcgcatcttcatgagtttcccgtgagtctctacgatcagattgcagagtcaacatctactactatggcttctcatcatcttcaatttttgccgccagcttcttcctcaactatgactatgacatctccgcaggcaccaccttcgatttatcctacgcatccagcggcatggtcttctggttatagttataatagctcttcttctgcttcggggtgatgtaaattgcgttttatttcaagtctctctcgtttttgccccttgtattgtatcattgttactctcctctgttttttgcatttgcaccacgaccatttccatccaggagtggttttttgtgaccatgttattatgatcaagcaaatcatataattcacagttaacagtttagtatctgtgtataatagagttttatttatcctcccatcacatttctccaaacaaccatatcaatcttatatctcttccttcttct

SEQ ID NO: 1745 - DNA, 1023 bp, Glycine max
  Predicted polypeptide sequence is orthologous to G1794
gaaaagggtaacgaggttgaccagagttacatacagcagcaccactcgttgtcaatgccaatgatgttttcgggttttaacagagagaaggagatgtcagccatgatcactgctttgacacgtgtggtttgtggagattattctcttgttcatcacaatattgataatactaatagtgcaattgttggtggtggtggtggtgatgatgtttcaaatatggcttctggttctatgccaccttcgtctacttctttatctcatggtggcaactctgttctcaagagaagaagggaagatgataatacaagtgatttcttacgtggaggttcattccctgctattttaacaactgcggaaggttcaagcacgataagaagaagaagagcgaatacggtatacgattacgaatacagaagagagaaggtgaaagttggaggaggaagaagaagcgaggaggaaatacagaggagtgagacagaggccgtgggggaaatgggctgcggaaataagagaccctttgaaagccagaagggtgtggttaggaacatttgaaaccgctgaggacgcagccagagcgtacgatcaagcttccttgcgtttcagaggcaacaaagccaaactcaacttccctgaaaacgttaggctcagacacactgagactcttcagggttcacgtgcttcaagcaatttttatgacaactcttattcgcatgttcatgatttacccgtgagcctctacgatcagactaccatggcttcttcatcaactatatctatgacttctccccaggcaccaccttcgatttatcctacgcatctactaccggcatggtcttctggttatgcttataatagctcctcttcttctgcctgatgtaaattgctttttatttcgagtcgacataggctatacttttatctcacacaacttagtttgtcattatatctacctatgtttgacactaaactgagttttacttggaagcaacatatgaattgcttctaaaaattcatttttcgttg

SEQ ID NO: 1746 - DNA, 1850 bp, Glycine max
  Predicted polypeptide sequence is orthologous to G1794
ggctcgaggggacataccatatatacatatattatagtttagtttgcactattttaatggtggctggctaccttaattccacatgctaaaattttgcacccctttattatataaccgtttcattctctatagcatctcaaagggtgtcctgagaaggaatcacacaagagaaattttgggtggatcttggcaatttaaatttggtccaaaaatagtaagaaagaaaaccatagtttatatagttttcatgtccttgctaacggtggcgcaccaaagggggtcaggtgagtttatgcggttcacggaaagtcatggcggcggtggtggcggtgacggcgatggtgaatatggttatggacatgatgatggtagaggtggtgggggtggtggttcactagggttgaattttaaccaagtgatgcaacaaggtgaggttacaacgcaaggaggtactttggtttcagggtataacaggggtgatccagatttgagagaaatggtttccgctttgacacatgtggtggtgtcttcagggtcaggccagaggagcaccgaatggatccagcaaagtggttttcctatgatgtctgcatcttctctttcatgtttgtcttctttctcttctccttcttcttctggagcctcttgggttggccacaaaagaggcagagaagaagaagagagtagctcttcccataacatgatccaacaacaacaacaaagtgctccaagactcttcagaaacattggtgacttcatggtgccttctcaaggagactcatcttcagcgacagaagaagcccccacctccacaactacaagtgtaaccgctgtggcaacaacggttactgaaaccccacccccaccgggaggtggggaaaggaggagaaagtacaggggagtgaggcagaggccatggggaaaatgggcagcagaaattcgtgatccacacaaagcagcaagagtttggcttggcacattcgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactcgtcacggaggcgccgcccttcattcagcagccacagattcagggctcctctgacttgatcagagattacttgcaatactctcagcttctacagagtgattttcaacagcaacatatacaacatcaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaagacttgttatacttatttcttttttcaagggtgaaactatgatatagttttttttaagtatttttggtactattctcgtatcagaattagagtttcagtaatttatgttgatattcaatacaaatctttattatgtaaaaaaaaaaaaaaaagg

SEQ ID NO: 1747 - DNA, 1585 bp, Glycine max
  Predicted polypeptide sequence is orthologous to G1794
ctcaaagggtgtcctgagaaggaatcacacaagagaaattttgggtggatcttggcaatttaaatttggtccaaaaatagtaagaaagaaaaccatagtttatatagttttcatgtccttgctaacggtggcgcaccaaagggggtcaggtgagtttatgcggttcacggaaagtcatggcggcggtggtggcggtgacggcgatggtgaatatggttatggacatgatgatggtagaggtggtgggggtggtggttcactagggttgaattttaaccaagtgatgcaacaaggtgaggttacaacgcaaggaggtactttggtttcagggtataacaggggtgatccagatttgagagaaatggtttccgctttgacacatgtggtggtgtcttcagggtcaggccagaggagcaccgaatggatccagcaaagtggttttcctatgatgtctgcatcttctctttcatgtttgtcttctttctcttctccttcttcttctggagcctcttgggttggccacaaaagaggcagagaagaagaagagagtagctcttcccataacatgatccaacaacaacaacaaagtgctccaagactcttcagaaacattggtgacttcatggtgccttctcaaggagactcatcttcagcgacagaagaagcccccacctccacaactacaagtgtaaccgctgtggcaacaacggttactgaaaccccacccccaccgggaggtggggaaaggaggagaaagtacaggggagtgaggcagaggccatggggaaaatgggcagcagaaattcgtgatccacacaaagcagcaagagtttggcttggaacattcgacacagaagaagcagcagcaagagcatatgatgaagctgcattgaggttcagaggcaacagagcaaagcttaacttccctgaaaatgtaagagcagttccacccattcaaccttttcaagccaccactaggctaaccgtttctgattccaccacctctcaattccggccactcgtcacggagacgccgcccttcattcagcagccacagattcagggctcctctgacttgatcagagattacttgcaatactctcagcttctacagagtgattttcaacagcaacaaatacaacaacaatcaccttctagtttgcttcagcagttgtactataatgcacaattggcttcacttcaatcaccttcagtgctatcatcatctccttcattttcttcttccgtgtcaccaacaccattcccattgttctcaacctctgctcagttttcctctgcttctttccccatgttttcaagtcaacaaatgggctatttccagctgccggaaagctgccctcccgctggcggcgtgccagagtttccgccgtccacatggtcgggtaccagtggccagccaccaccttctggttgatacagtgtctcagtttccttcatattttccttttttctctttctttcatacttacgataaaaaaatgatttgttttacttatttccttttttaaaaaaaaaaaaaaaaaaaaaaaaaaaaaaaaaaaaaaaaaaaaaaaaaaaaaaaaaa

SEQ ID NO: 1748 - DNA, 1594 bp, Glycine max
  Predicted polypeptide sequence is orthologous to G1794
cccacgcgtccgcccacgcgtccgcaaagaaggattcacacaagagaaattttgggtggatcttggtaatttaaatttggtccaaaaatagtaagaaaaaaaaaccatagttcatttaattttcatgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaatggacccagcaaagtgggtttcctatgatgtctgcttcttctctttcacgtcggcctgctttctcttcttcttctccttctccttcttctggagcctcttgggttggccacagctgaggcagagaagaagatgagaatagtacttcacataacttgatgccacatcaccatcgaagcgctccaagactcttgagaaacattggtgacttcatggtgccttctccaggagactcatcatcagcgacagaagaagcccccacctccactgctacaactgtaaccgccgtcacaacggcggttactgaaaacccacccggtggtggggaaaggaggagaaaggacaggggagcgaggcacacgccatggggaaactgggcagcagagatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaaagacttgttatacttatttcttttttcaagggtgaaactatgatatagtttttttaaaaa

SEQ ID NO: 1749 - DNA, 1172 bp, Glycine max
  Predicted polypeptide sequence is orthologous to G1794
tctaacggcgtttggggtttttttttttttttttttttttggtagaggaataattattattattattattaattagtgtttgaaaaaaatggagagatacgataaaagacgggaaaatatagactcaataaaaacaaagaaacaaaaaaggatcatggggaggaagaagagctatgaccagaggccgaccatgggggcaactgggcagaatacaaggaagaaagtgaagtgatgttctgaggaggagaagttagagaagaggaggttgctggtggcagcggcaaagaagattgaagatgatgagaagccatggtattagaagtcagaaacatcctatgatcataaaggttggtacccgagagttgaaatgggtctgttgatgtggaaacagtgaattgaggttgtcggagagtgacattctcggggaagttgagtttggccttgctgcccctaaaacgaagggcagcttcatcgtaggctctagctgctgcctctaccgtctcaaatgttcctaaccatactcttgctgctttgaatgggtctcttatctccgctgcccattttccccacggcctctgcctcacccctctatattttctccttccctcctccttctttacattctctgttcctcttgttctgtattcgtacacagcatttcccattccactctttgaacattctgcacttgttggcatagcagggaatgatgaaggtggatgtgagaaggatggtgtatatgtatcatgttgtctacttctcttgagagaagaggtggcaacaacataagtagatgaaaagggtgttgtagaaggcatgtttggtttaacagtaacagcatcatcatcatgaggttgatgatgaagaactgaagaagaatcaccggttggaacctctccggagacaacgtgggtcaaagctgagaccatggcagacatctccctctccctattgatacccggaaacagccttgacaataatgcagggttgttcatcatcccttcatggaataatatattgtcaacctcgtttcccttcttctctttaggatttgccacctttaacaaacacgtgtaaacgcaatcaaaaagcttgttttagttagctactagatcgaatccctcgtttctgattgatgcatgcaaaagcaaaaatactaccccttcaatctc

SEQ ID NO: 1750 - DNA, 470 bp, Glycine max
  Predicted polypeptide sequence is orthologous to G1794
aaagaagattgaagatgatgagaagccatggtattagaagtcagaaacatcctatgatcataaaggttggtacccgagagttgaaatgggtctgttgatgtggaaacagtgaattgaggttgtcggagagtgacattctcggggaagttgagtttggccttgctgcccctaaaacgaagggcagcttcatcgtaggctctagctgctgcctctaccgtctcaaatgttcctaaccatactcttgctgctttgaatgggtctcttatctccgctgcccattttccccacggcctctgcctcacccctctatattttctccttccctcctccttctttacattctctgttcctcttgttctcccttctgtcgtcttctcgcagccgtacccttctgtcgtcttctcgcagccgtacccttctgtcgtcttctcgcagccgtacccttctgtcgtcttctcgcagccgtacga

SEQ ID NO: 1751 - DNA, 354 bp, Zea mays
  Predicted polypeptide sequence is orthologous to G1794
gcgggcgcggctgccatggaggagcaccaggcggcaggtgcgctgtccagttattagggtcccgagacgccgcggaggcgctaccgcggggtgcgccagcggccgtggggcaagtgggccgccgagatccgggacccgcacaaggcggcgcgcgtctggctcggcacgttcgagaccgccgaggccgcggcgcgcgcctacgacgaggccgcgctccgcttccgcggcagccgcgccaagctcaacttccccgaggacgcgcgcctctacccggcgtccaccgcgggcgcggcggcgcctctcgacgcggcggcctcgacctgcccacctgtctactccggaggcgtccagggc

SEQ ID NO: 1752 - DNA, 1130 bp, Zea mays
  Predicted polypeptide sequence is orthologous to G1794
ctttttcttaatgagatattatttattatcacgtgcgtcttcgatttagttgcaaccagaatcattatcacatgatcgatacaggattcaacaccaccacaagcaaagaagaaacacaatctcgcaacctcttctcttggatcttgcacggatgcatgcatcttgaacaaaatcatctatctatctgtgtcttctgaaccacaaaagctttgttctttgtggagtagatgggggaaaaaaaggaaggccgtgtatacgtcttatatgaaatgaaacatggagcatggactattgaggtggacgagttgacggtggatactcatactggcttgatccagaccaagaagccgtggtcgccggatagctccacgcactactctccggccagctgcctgcccactgcgccgcctcgccatagctgggagcggaggaggcagaggacgacggcacagaagccacggtaaccgtggaggcggggaaagagtaggagctgctcatggcaccaccaccagcgccagcgccagccccgccgtggccgccatagtcgtagtacagaggatacccgccatgactgctgctgctgccttggccgctggtggccccctgcagaagcatcatctggtactgcaggtagtctgcagagacgacggcggcgctggcctcctgctggtacgacccgcccgccgaggccgccacggccatcgtcgtcgtggatcccgccgccgccgccggagcgaccgcagcggatggcgccgtggtgaggcgcgcgtcctcggggaagttgagcttggcgcggctgccgcggaagcggagcgcggcctcgtcgtaggcgcgcgccgcggcctccgcggtgtcgaacgtgccgagccagacgcgggccgccttgtgcgggtcgcggatctccgccgcccacttgccccacggccgctgccgcacgccgcggaaccgccgctcgccgcccgcctcggcggcggaggccgtgggcgagtagtggccctccatggccgccgcgccctgcacgtcgtgggccgcctgctctcctcctgcgtgcgcggatagatagagatgagatgagtacactgtgcacagcactagctagctagtcgcgcacacggacacggcaccccggg

SEQ ID NO: 1753 - DNA, 636 bp, Zea mays
  Predicted polypeptide sequence is orthologous to G1794
ccgccgtcggcggtggtttcgcgagcgtggcggactccgggaagttgaggttagcgcggctgccgcggaacctgagcgccgccacgtcgtacgcccgggcggcggcctccgcggtgtcgaaggtgcctagccacacgcgcgccgccttgtgaggatcccggatctccgccgcccacttaccccacggccgctgccgcacaccgcggtaccgcctccgcggcgtgccggagccggtggaggacggcgagggggcctgcgagctagagctgggtgacgccgtcgtcgcgggaatccgtgccgctccgtgctcgtgagcggccggtgcaggaagagaggccggcggcggcggcggcgttacatctccggcgtagtagtcgctccaccactggccctcaggcgacacctgctgctgacgggcaccggccgttgccccgccagcgacgaccgtggccagcgcgtcgaccatcatggacgcctcccggctccgctcgtaccccgatagcattcgccacgccgctgccgggtgttggcggtcctagtcgtcctcctcacccccggcgccccaacgacagggccctcgtccaaccgcgaaaaccaccttgggcgcgcagcacatgaatgtagtatgtatgggcc

SEQ ID NO: 1754 - protein, 217 aa, Oryza sativa
  Orthologous to G1794
MAALFEAAETAAIVAALTRVIADGGRGGGGGVCVPPPAPSLVVPPRAGTGGGRRVDVAREEEMVGVVSAGDHAGGANVAEAAAAVVVAAPATARRYRGVRRRPWGKWAAEIRDPRKAARVWLGTFRTAEDAARAYDAAALRFRGRRAKLNFPEEVSRPWQGHDVDHMSCSPPSISNARFLGSWTFGPPQPPSRSVAAAATTLLGGSHGGNGAENGRE

SEQ ID NO: 1755 - protein, 351 aa, Oryza sativa
  Orthologous to G1794
MTVAGASELMSGYYQAQEMSTMVSALARVVAGGGGGGGDGDGDQWAWSSPSPSSSAAAAAARGVQERRREEQAMHELAGYACGGAPSPEFAGSEQSSDTQSASAATMDEHHSPVGGGGNAEGPDTPRRRYRGVRQRPWGKWAAEIRDPHKAARVWLGTFETAEAAARAYDEAALRFRGSRAKLNFPEDARLYPTAATTTTAAPPPAPVAAASPSAAIYPGASQSAEYLRYQMLLQGRLTTATPNQGTLLPFYGGGGGGGSMTNPYGGGGGGAMSGFLGSYYSFPTPSVSVATVPSSTSSAPGNYYSSHGGSHQSMSAAEEWNWENALVYPATAASWSESSYHHHPPPPHTQ

SEQ ID NO: 1756 - protein, 364 aa, Oryza sativa
  Orthologous to G1794
MADQRRRFRGGGDWQASVDDVVDDGGELEAAAAAAARGSVLSGEYQAQEMSTMVSALTWVVAAGHDDHGGGQWSGLVDVPATTLAGGGGGDYGHGAQGSYYYYGAAPTSTPEFVAGGQQEQLSSDVPQGGASLGLAMDEHSPTYTVEASSSADQHGGGGGGRRYRGVRQRPWGKWAAEIRDPHKAARVWLGTFETAEAAARAYDEAALRFRGSRAKLNFPEDARLSSPPAGAGAGGATAAAQTVPVAYPASAVSDYLQYQMLLHGGGGGGGGRYPLYYGGGAAAAMSSSLGPYSSIPTSSVTVASVPSSSSAASSSSGYGAPAEHGEAVQWTSWPDGGGWTYPATTSSWSGSSQYPPPPRPPQQ

SEQ ID NO: 1757 - DNA, 397 bp, Glycine max
  Predicted polypeptide sequence is orthologous to G1804
acgaggcaaatatcattcttccttagcttattattaaagcattatttatttttatatctctcttatattagtactgtttttctttcttatcacctcttctaggaagaagaaaaagatggtgattgaggagggcgagatgaagtcccaaggtgaggtggaatcatggctccagcaagaagcgaagaagaaccaccattctccattattctcatcttcttcatatctgggaagacaaacatcatcgatatactctctcacactggacgagttccagcacagtctatgcgagagcggcaagaacttcggctccatgaacatggacgagttcctcagcagcatctggaacgctgaagagaacagccaagccatcaccaacaacaacgtccctctgtcgtcg

SEQ ID NO: 1758 - DNA, 597 bp, Glycine max
  Predicted polypeptide sequence is orthologous to G1804
gctcggaatccggctattcggctcgatgaagctaacaatagccttgccaggaatgagccactactcaaaaggcagcaaacacttggggaaatgactttggaggatttcctagtaaaagctggggtggtacaagaatcatcatcactattcaagtcttcattactatatcaaaatcagattggtaacattgcaagtaatgggccattgagtgcaagttataggttcaggcatgtaatagggacaggatctagtgtgtcttgtaatgggcttgaaacacaaaacatgttggcacagaataacaacttagttataaaggatgtcactacaaatggtgctgtggagaaatgtccaagcttaggagaatcaagtgggaagggtaataggaagaggatcattgatggccctcctgaagtggtagtagagagaaggcagcgcagaatgttgaagaatcgagaatcggcggcgcgttctcgagcaagaagacaggcatatacagtagagcttgaagcagagctgaatctgctaaaagaagagaacgaaaagctcaaacaaactctggccgatgctgaacgcaagagaaaacacgagatttctcag

SEQ ID NO: 1759 - DNA, 1883 bp, Glycine max
  Predicted polypeptide sequence is orthologous to G1804
cttttttttttttttttttttttttttttttttttttttgtttcataaataattagattgattctggtaattaattacttatatctggcaatagtgccgaccaacgatcaaatcagtaactaaacaagggtgtggtaactggtaagcgtaaacaagatgaaatggcagcaacaatgcaataactatgttggacatttgagtaactagttatcatatgataaagaagcttccaaattggatgatctaatccttcggtgatcttgaacttgaggactcttgcagcttggctttataattaaatttcataactccgaccttttgtttctctgtttcttcaaccggctttgacttgagtagttctttagttttcttctcccctcttgatttgtgtcatgactatttcttcgtttagccacacaagtagtagatgcatcacaacaaactcttgttgtgcgtactaaaatccaagtatttcactgctaccattaccgtgcagtttcttcacaaaggacaactcatgttccttctcaaagctctcagtttctcttttgctttctgagctttggttttaacactaacgttcacttcctcaaaacactgttgttttcttcccctctcgagctcggccagcgcctgtttcagttgggagttctcttctcttaactggtttagttctgcttctaattccactgtgtatgcctgttttctggctctagatctggcagctgactctctattcttgatcatcctcctctgccttctctccaccaccttttccacaggaccatccaccaccctctttctccctctcaaaccccccatgtcaagcccaaactgccctccatcattccctatcccatcagacgaattagccggactcacaggcccacccattcccattgtgggccccaccccatacccaccaccaccacctccaaaacaatgatacccaccaccattatgatccctcttaccatacccaccagaagcctccccaacaacttgttgataacccggtgcaaccacgttactcactgcaccaacatgcctaccaacaaaagaaggagccattgcaacgttgttgttattattcgcgtaatgcggctgatgagagtgagacaccggtagtggcggtgcacacgttgtttcccgaactacaccggccttaaccaaaaaatcctccaaagtcatctcaccaaaagtgggttggcgaggggcagactcggtattatcattaagaacattgctaatgttgttgttcttgttttgttctttttgaatctgggaccaaacctcgtcaacggttttcctacaaagaggagcagggagggacagtgagggttggcgagggaggcttggctgtttccttaatattgttagggtcgacgacagagggacgttgttgttggtgatggcttggctgttctcttcagcgttccagatgctgctgaggaactcgtccatgttcatggagccgaagttcttgccgctctcgcatagactgtgctggaactcgtccagtgtgagagagtatatcgatgatgtttgtcttcccagatatgaagaagatgagaataatggagaatggtggttcttcttcgcttcttgctggagccatgattccacctcaccttgggacttcatctcgccctcctcaatcaccatctttttcttcttcctggaaattgaaattcgaaagcgaagctggtaaatgaagttccttttgtaacagtgacaagagcttattattcttatgatactgaggtgaggatgagatggatgtgtctgttgaatttgagcagccaccgcgcgagttcaaatttgtttagaacatgcaaccccaaattaataaagaggtacagtacatataagcggacgcgtgg

SEQ ID NO: 1760 - DNA, 719 bp, Oryza sativa
  Predicted polypeptide sequence is orthologous to G1804
ttttttttttttttttttttttacagatacaaactagtatactattgtataattttattcatcgttgttttgtacaaacagcgacatgtaaccatataagcagcaaggaccggtgaacacgatggcaagacatgtgggtccaggcaggtttacaagcatcacagcatatatgtatatcaactactaccataataccttcacatcacttagtctgaaagaagacttaatgtgcaaatcctcttcagagcctcagaggctagtgccacaccagaagcaggatgagtgtgccactcgccggtcaccgctatgcccgtttcaccacatgcagctgccgctgcggcgcagctgggctgccacccctatttgcattcatcttctccttggactgctccatcattttctcaaccagcatttgcttctttgtcagtagaaccgtcttctctgcctctttgagacgagcgttctcctgcttgagatagttcagttcagcttcgagctccaccgtataagcctgctttctagcacgggaccgtgcagctgactcacggttcttgatcatgcgccgttggcggcgctccaccgtcttctcggcgcagccatcctctctgtggggacgctttcttgttccattctcaatcatcatcccattcccaatacaattcatcatatcagcatgtgtcatggcactcatcccatctgatcggacgccgtgggtcgac

SEQ ID NO: 1761 - protein, 388 aa, Oryza sativa
  Orthologous to G1804
MASEMSKNVKVTDDQEVTSQERDQSGGTKVGGEEEIAPLARQSSILSLTLEELQNSLCEPGRNFGSMNMDEFVANIWNAEEFQATTGGCKGAMEEAKVVDSGSGSGDAGGSGLCRQGSFSLPLPLCQKTVEEVWTEINQAPAHTSAPASALQPHAGSGGVAANDRQVTLGEMTLEDFLVKAGVVRGSFTGQAAMGSGMVNGPVNPMQQGQGGPMMFPVGPVNAMYPVMGDGMGYPGGYNGMAIVPPPPPAQGAMVVVSPGSSDGMSAMTHADMMNCIGNGMMIENGTRKRPHREDGCAEKTVERRQRRMIKNRESAARSRARKQAYTVELEAELNYLKQENARLKEAEKTVLLTKKQMLVEKMMEQSKEKMNANRGGSQLRRSGSCMW

SEQ ID NO: 1762 - protein, 378 aa, Helianthus annuus
  Orthologous to G1804
MNMDEFLNSIWTAEENQAHTQAHPPTAATIGGGISTSAAMATNGASSSGQFLMGINANSAEPNMIARQVSLSRQGSLTLPGPLSRKTVDEVWSEIQKTRQDHQQPSNDNNSCNEQVPGAQRQPTYGEMTLEDFLVKAGVVREQNHPNAPPVPQQVPASFGLYPTNGNNRIIGPPPSSAHMVRPMLGLSTGGGASVIPPYSPLIRETPGYPGGKRAGNYQQQPPPYGGIGGNAGGVAGGYGQGLGIGSPPSPVSSDGIATTQLDSGNQYALEMGGIRGGRKRIIDGPVEKVVERRQRRMIKNRESAARSRARKQAYTVELEAELNMLKEENAQLKQALAEIERKRKQQFSEEIRMKGVTKCQKVRDKSRMLRRTSSCPT

SEQ ID NO: 1763 - DNA, 2128 bp, Glycine max
  Predicted polypeptide sequence is orthologous to G1838
ggtccggaacgcccccgtcgtcccgcgccgcccctcgcgtcgagcaacaacaccttgcatgcattctacttctcttagttctccccttaaccaaaccaaaaccacttgatctattctttttcatttaatcgaaaaataatagtaactataatatcaccaccacaccgacatggagaagaagtagctgtccgttcaaagagactagttcttcattttgcaccatttcattcatatatctcaatggctcgtgctactaactggctttcgttctctctctccccaatggaaatgctccgaacctccgaacctcagttccttcaatacgacgccgcttccgctacttcctcacatcactactacctcgacaacttgtacaccaacgggtggggcaacgggagcctcaagtttgagcagaatctcaaccacagtgacgtgagttttgttgaatcttcgtcgcagagcgtcggccacgtgccgccgccgccgccgaagctggaggattttctcggcgactcctccgccgtgatgcgttactccgacagccagacggagacgcaggactcgtcgctgacgcacatctacgaccaccaccaccaccaccaccaccaccacggttctacttcgtacttcggcggtgaccagcaggatctcaaggccattactggatttcaagctttttcgaccaactccggctccgaggttgatgattctgcatccatcggaaaagcgcaggccagcgagttcgggactcactctattgagtcctccggcaacgagttcgccgcgttctccggtggcacaaccggaaccttgtcgctcgccgttgcactgagctccgagaaggccgttgtcgcggcggagtccaatagctcgaagaagatcgtggataccttcggccagcggacttctatttacagaggtgttactaggcaccgatggacaggaagatatgaagcgcatctatgggacaatagttgcagaagggagggtcaagccagaaaagggcgtcaagtttatttgggtggatatgataaggaagaaaaggccgcgagagcttatgatttggcagctctgaagtactggggtcccactgctaccaccaacttccctgtttccaattattcgaaggaagtggaggagatgaaacatgtaacaaagcaagaatttatcgcatcattgcgaaggaaaagtagtggtttctccaggggagcttccatatacagaggtgttacaaggcatcatcaacagggtaggtggcaagcaagaattggccgtgtagctggaaacaaagatctttacttgggaacattcgcaaccgaggaggaagcagcagaggcatatgatattgcagccataaagttcagaggtgcaaacgcggtaaccaactttgagatgaatagatatgatgtggaagctataatgaagagttctcttccagtgggtggggcagcaaagcgcttgaagctttcccttgaatcagagcagaaagctcttcctgtgagcagcagcagcagcagcaatcaacagcagaatccacagtgtggaaacgtgagtgccagcatcaatttctcatccattcatcagccaattgcttctatcccttgtggaattccctttgattcaacaacagcatattatcatcacaaccttttccaacattttcaccctaccaacgctggcacagcagcgtctgctgttacttctgccaatgcaaatgcactaactgcactgccaccaacagcagcagctgagttctttatttggcctcatcagtcttattgatctaatcaaaactagaaatcatcttttgttaatttcctggttatgctaacaaatcaaaagctatagtctctggcacagtttagctgacccccctcctctattattaacccctttaggctgctaaaaaagaaaaaaaatgaggtttttgagttggctagtcttagttactgtaggaagctggatatgtaactaactgctcaagaaatgagaaatatttcgtgcatcataattttgcacaagaatttccttaatggcttatagcttgcagtggagtatgaccgcttttgtttaattgtcaatttggcttcgtgttttaaattacagtttataacattcttttgacatg

SEQ ID NO: 1764 - DNA, 1144 bp, Glycine max
  Predicted polypeptide sequence is orthologous to G1838
ccacgcgtccggggactttggtgcatttctggctgtcattaaactttttgactcttctacagtttatttgggtggatatgataaggaagaaaaggccgctagatcttatgatttggcagctctgaagtactggggtcccactgctaccaccaacttccctgtttccaattattcaaaggaagtggaggagatgaaacatgtaacaaagcaggaatttatcgcatcattgcgaaggaaaagtagtggtttctccaggggagcttccatatacagaggtgttacaaggcatcatcaacagggtaggtggcaagcaagaattggccgtgtagctggaaacaaagatctttacttgggaacattcgcaaccgaggaggaagcagcagaggcatatgatattgcagcccattaagttcagaggtgcaaacgcggtaaccaactttgagatgaatagatatgatgtggaagctataatgaagagttctcttccagtgggtggggcagcaaagcgcttgaggctttcccttgaatcagagcagaaagctcctcctgtgaacagcagcagtcagcagcagaatccacagtgtggtaacgtgagtggcagcatcaatttctcagccattcatcagccaattgcttcaatcccttgtggaattccgtttgattcaacaacagcatattatcctcacaaccttttccaacattttcaccctaccaacgctggtgcagcagcgtctgctgttacttctgccaatgcaaccgcactaactgcactgccagcatcagcagcaactgagttctttatttggcctcatcagtcttattgatctaatcaaaactagaatcaaaatctttttctaatttcctggttatgctaacaaatcaaacgccatagtctctggcacagtttagctgacccccctcctctattattaacctaaactaaaaaaggaaaaagaaaaagaaaaaaaagaggaggtttttgagttggctagtcttggttacagtaggaagctggatatgtaactaactgcttaagaaatgagaaatatttcgtgcatcataattttgcacaagaatttcctcaatggcttagcttgcagcattagtatgatcgcttttgtttaaaaaaaaaaaaaaaaaaaaa

SEQ ID NO: 1765 - protein, 490 aa, Oryza sativa
  Orthologous to G1838
MSPPTNGAISLAFPPMGPLPADALIYPFDGLSYDDFVLPVAAAPQHPLPVAVADPAPLLLLPPPSSCTCNGASSGMGAVAPRTLALGATTDGSVMTPTSWGSDGGGGGSSSARAVRSPSPVLPLVQGTGQRTSCYRGVTRHRWTGRYEAHLWDNTCRREGQKRKGRQVTTPVELFLLSVLVDWHLATNFCTLLDTLAELHSAVVPFFFLRKDYQWFHDSDTMTCCFFAFSGYDIEDKAARAYDLAALKYWGANATTNFPKESYVKEIEEMQKMSKQELVASLRRKSSGFSRGASIYRGVTRHHQHGRWQARIGRVAGNKDLYLGTFATEEEAAEAYDVAALKFRGANAVTNFEPSRYNLEAISQSDLPISVSGRRHNSSSNSNNPAPEAGGQITLMSSPPISQQSSSAPPYLIHNLLQFQPCGPPYAPPPPPPPPPPPPQALPLPGSYNFAEPVGFYWPYGDGEEQKVQLNSNMVGMASGGFLHLANAAN

SEQ ID NO: 1766 - DNA, 2043 bp, Glycine max
  Predicted polypeptide sequence is orthologous to G1841
gtgccaaaatcatctccgaggcaccaacatcggcagccacatatttctttatttattggtacagtattgtttttttcttcttcttcttcttcatttttcattaacatatatttctttttcgaagaatcaaaggtagaatctacaatattaaaaaaaactgtataagaaattaaaggtagtggtagtggagtgtgtgtctcgagccgattcggctcgaggcatggtggaagctagagtaatagaggcgcaacatggtcactgtttctgtgggggctatagccagcttctcatcatgttcgatttctcttattcttacccatcttcttatatataaatatttataataacgtgtttcagtttctttctcagaaggaatcagtatataaaacacctgctttctaacggtggcgcaccagaggggtttaggttcaggttcggggaagttcttcgcggcggagcaaggcggcgatgaggaagcggaagagagtactgaggtaggttctgttccgagccatgtggtgtcagcctctgcagcttcggcccaaaccaatcagtgggtgccgcggggaagtggttttcccatgatgtcacgttttatgcatgcgccttctcccgttctgtcttcttcgcatcctcatttgggagttggccacaagagagagcgtgaagatgacactggcgctggtgcgagtggaggtgttgctattgcagcagcttcttcacaaacgcaaacacaagagattgaaagtgctggcggcgacaggaggaggagatacaggggagtgaggcagaggccgtgggggaaatgggcggcagagattcgcgatcctcacaaagcggcgagagtgtggcttgggacattcgacactgccgaggctgcggccagagcctacgatgaagccgcattgaggttcagaggtaacagagcaaaacttaatttccccgaaaacgttgtaccggttccacctcctcctccggttcccgatttaccggcaagtgcggtagccggttccgattccatttccggttccggttcagtggtggcaggtttttcgccgacgctgatgcagggagcgccgtttcagggctcctctgcttttctgagagattattgggggtattctcagctgctgaggagtacaggggacttccatggactcgaccagtggttctttgattctcaaatggcagcgtttcaatcttcttcatcgtcgttgttgccatcgccgccgccgccgtcgttttcgccttcctctgcttcgtatcctctgttttcttccagccagcaaatggggattttccggccgccgggagagcagggtcatggcggagaagacggtggtagtgggtcagagttttcggagcttccaccttcgacgtggtcagataccagtggctatcctcctccaccacctggttgacatggaatacacatttttttctttattctattttttctctttctttggttaaagaaagaacaaggctttcttctgtttatttattttaatttatctgtttttgcttttttagattatttggagtccagttcactgaatttttatgtggttttgggttaaactgttactatttgctgctgttatttgaataaatactatttgaagagtagggagtagggaatgggaggttggaggatgcatgataaaggctttaagcctttgaggtagatacgaatggagtttaagtggtacgaggcagcactttgaagaattgtttagagataaagacaaagcagtacttaggttggaagctgagtttattccagattatcaactcaatggatttgatgttaacattttgtcaacaatccacgcaaaggtgaagaaaccaatatcttttataaaacctgttcccaataaaccaacttttttattaaggaatgacgattgagggatgtatttagaagatataatactaatttagtgtgatatgcataattttggtttttaagctggtgttaattgtttggtaagtgtattaaaatgtctaaatagtaatatttggaagtttgagtaaaaaaaa

SEQ ID NO: 1767 - DNA, 1467 bp, Glycine max
  Predicted polypeptide sequence is orthologous to G1841
attcggctcgaggttttcaaccagaccgtccttcgtcagttaactatgggctaatcacaattcaggaagcccaaaactattaaagaaaccgacaacacaaaggatttgcagaaagtgcagctacttagttccattttcatcctctctccattaactttcagtcaaaacaaaacaaaacctctttaggtgtgaaattccacgtgccaaaatcatctccgaggcaccaacatcggcagccacatatttctttatttattgaaggaatcagtatataaaacacctgctttctaacggtggcgcaccagaggggtttaggttcaggttcggggaagttcttcgcggcggagcaaggcggcgatgaggaagcggaagagagtactgaggtaggttctgttccgagccatgtggtgtcagcctctgcagcttcggcccaaaccaatcagtgggtgccgcggggaagtggttttcccatgatgtcacgttttatgcatgcgccttctcccgttctgtcttcttcgcatcctcatttgggagttggccacaagagagagcgtgaagatgacactggcgctggtgcgagtggaggtgttgctattgcagcagcttcttcacaaacgcaaacacaagagattgaaagtgctggcggcgacaggaggaggagatacaggggagtgaggcagaggccgtgggggaaatgggcggcagagattcgcgatcctcacaaagcggcgagagtgtggcttgggacattcgacactgccgaggctgcggccagagcctacgatgaagccgcattgaggttcagaggtaacagagcaaaacttaatttccccgaaaacgttgtaccggttccacctcctcctccggttcccgatttaccggcaagtgcggtagccggttccgattccatttccggttccggttcagtggtggcaggtttttcgccgacgctgatgcagggagcgccgtttcagggctcctctgcttttctgagagattattgggggtattctcagctgctgaggagtacaggggacttccatggactcgaccagtggttctttgattctcaaatggcagcgtttcaatcttcttcatcgtcgttgttgccatcgccgccgccgccgtcgttttcgccttcctctgcttcgtatcctctgttttcttccagccagcaaatggggattttccggccgccgggagagcagggtcatggcggagaagacggtggtagtgggtcagagttttcggagcttccaccttcgacgtggtcagataccagtggctatcctcctccaccacctggttgacatggaatacacatttttttctttattctattttttctctttctttggttaaagaaagaacaaggctttcttctgtttatttattttaatttatctgtttttgcttttttagattatttggagtccagttcactgaatttttatgtggttttgggtt

SEQ ID NO: 1768 - DNA, 579 bp, Oryza sativa
  Predicted polypeptide sequence is orthologous to G1841
gcacgagggagcgcgagcgcggcgacatggacgagcaccactcgccggtgggcggcggcgggaacgcggaggggcccgacacgccgcggcggcggtaccgcggggtgcggcagcggccgtgggggaagtgggcggcggagatccgggacccgcacaaggcggcgcgggtgtggctcggcacgttcgagacggcggaggccgcggcgcgggcctacgacgaggccgcgctccggttccgcggcagccgcgccaagctcaacttccccgaggacgcgcgcctctacccgaccgccgccaccaccaccaccgcggcgccgcccccggcgccggtcgcggcggcatcgccttccgcggccatctaccccggcgcctcccagagcgccgagtacctgcgctaccagatgcttctgcaggggaggcttaccaccgccacccccaaccaaggcacccttcttccgttctacggcggcggcggcggcggtggctccatgaccaatccctacggaggcggtggcggcggcgccatgagcggcttcctcggctcctactactctttccctaccccctctgtttccgtgg

SEQ ID NO: 1769 - protein, 286 aa, Oryza sativa
  Orthologous to G1841
MAAMVSALASVVAGGGGTSLPAKRPAEREPEEGAAVEGVWWSYCSELAAAAAAPSPAAPFPAGYVPSPGQHSPASAAAGDEEELPSPSSADSSGGTARKRYRGVRQRPWGKWAAEIRDPHKAARVWLGTFDTAEDAARAYDGAALRFRGSRAKLNFPEHATLPPPPTTTTAAAHRCPPPPRTDALLESQELSPGAGGGDPYSQYARFLQGSGGDGGEAAARPGGGASQRTPPATTLLYSFEGDAASAACLWQPESGGGGMGWPATSPAAWLEYGFYPPPERRDTDT

SEQ ID NO: 1770 - DNA, 652 bp, Solanum tuberosum
  Predicted polypeptide sequence is orthologous to G1852
gcgagaatcaatagccaattgagtagagagatgaatttttacagggaaagacattgtccattgcctaaggatacgcctctttgtttgattccaccgacacaaggttaccgcgttcctgttcaatggcctgagagtttgcacaagatttggcatgagaatatgccatataataaaatagctgacaggaaaggacaccaaggatggatgaaaaaggaagggccatattttatctttcctggtggtggaactatgtttcctgatggagctgagcagtatattccgatagctggtggagttttgaggaccgcccttgatatgggatgtggggtggctagttttggtggctatctactttctgaagagattttaactctctcttttgctccaagagattcacataaatcacaaatacagtttgccttggaacgaggaatacctgcatttgttgccatgcttgggacacggaggcttccttttcctgccttctcgtttgatttggttcattgttcacggtgtttgattccttttactgcatataatgcgacatacttcattgaagttgaccggttactccgccctggaggccaccttgtcatttctggtcctcccgtgcagtggcccaagcaagataaggaatggcgggatctccaaa

SEQ ID NO: 1771 - DNA, 945 bp, Gossypium arboreum
  Predicted polypeptide sequence is orthologous to G1852
  misc_feature (640)..(641): n is a, c, g, or t
  misc_feature (678)..(678): n is a, c, g, or t
  misc_feature (723)..(723): n is a, c, g, or t
  misc_feature (741)..(741): n is a, c, g, or t
  misc_feature (802)..(802): n is a, c, g, or t
  misc_feature (817)..(817): n is a, c, g, or t
  misc_feature (837)..(838): n is a, c, g, or t
  misc_feature (861)..(861): n is a, c, g, or t
  misc_feature (866)..(866): n is a, c, g, or t
ctgtctcaaactcacttcaaacacttccacttccctttctatgcaaaaaagctaaaaagtcttcaatgaatcattgaaatttaaatctaatcaaagcttcaacaaaacatgggtcacttaaatctaccaccatccaaacgaaatccgcgccaatggaaacttttggacatcgtctccgccttcttcttcgccctcgtactcttgtttttcttgttggtcttcacccctctcggcgattccttggctgcctctggtaggcaagctttgttgctttccacctccgatccaaagcaacggcatcgtttggtggagctgttggagcttggccatcatcaccagcctatcgaagcttgccctgctgattccgtcgatcatatgccgtgcgaggatcctaggcgtaatagtcagctcagtagggagatgaatttctatagagaaaggcattgccctttgcctgatgaaacgcctctttgcttgatccctcctcctcttggctacaagattcccgttcagtggcctgaaagcttgcacaagatatggcattccaacatgccacacaacaaaattgctgataggaaaggtcaccaaggatggatgaaagaggaaggtccttactttattttccctggtggtgggacanntgtccctgatggagctgcatcgtatatagagaaactnggacagtacattcccataaccggtggaactcttaagacggccctngatatgggctgtagaggntagctagtttggagggtcaatgctaaaagatgcattttgaactctcatttgctcagggatnacacaagcacaatcnaattgttagaagaggatcanncttgtctatgctggcacgcaacncattnctgcttgcttgactaatactgtctcgtgcctacccttacagtatagcacatttgtgaaggtaggtctcgccgaggatta

SEQ ID NO: 1772 - DNA, 802 bp, Medicago truncatula
  Predicted polypeptide sequence is orthologous to G1852
ggtggtttggataacccgtttaccagcctacaatgcaacttatttcattgaagtggatagattacttcgccctggtggatacctagtcatctccggtcctcctgttcggtgggctaaacaggaaaaagaatggtcagatctccaggctgtggcaaaggccttgtgttatgaacagataactgtacatgaaaacactgcaatctggaagaagccagcagcagattcgtgtcttcctaatggaaatgaatttggtcttgagttatgtgatgattctggggacctaagtcaagcttggtactttaaattgaagaaatgtgtaagtagtacgtcatctatcaaaggagattatgctattggaacaattcccaagtggccagagaggctaactgccgcaccttcgaggtcccctctcctgaaaaccggtgttgatgtatatgaggctgacactaagctgtgggtacagagggttgcacattataagaattcactaaatataaaattggggactccatcaatacgcaacgtcatggacatgaatgcattatatgggggttttgcagctgccttaaaatttgatcctgtgtgggtgatgaatgtagttccagctcaaaagccgccaactcttgatgcgatctttgacagaggacttattggtgtctatcatgattggtgtgaacctttttcaacatacccctcgacttatgatctgatccatgcagtcagcatcgaatcacttataaaagatccagccactggtaaaaaccagatgtatattggtgatttgatggtggaaattgatcga

SEQ ID NO: 1773 - DNA, 592 bp, Glycine max
  Predicted polypeptide sequence is orthologous to G1852
  misc_feature (543)..(543): n is a, c, g, or t
ggagagcttgcacaagatatggcacagcaacatgccatacaacaagattgctgacaggaaaggtcaccaaggatggatgaagcttgatggtcctcactttatattccctggaggtggcacaatgtttccagatggagcagagcagtatattgaaaaacttggtcaatacattccaatgaatggcggtattctgaggactgctcttgatatgggatgtggggttgccagttttggaggatatttgctagctcaaaacatattaaccatgtcttttgctccaagagattcacacaaatcacagattcaatttgcacttgaaagaggagtaccagcttttgttgccatgcttggtactcgcagacttccatttcctgcatttggctttgacttagtccattgttcccggtgtttaatcccttttacagcctacaatgcatcttatttcattgaagtggacagattacttcgccctggtggatatttagtcatttctggtccccctgttcagtggcctaaacaagataaagaatggtctgatctccnagctgtggcaagagctttgtgttatgaattgattgccgtagatggtaac

SEQ ID NO: 1774 - DNA, 547 bp, Lycopersicon esculentum
  Predicted polypeptide sequence is orthologous to G1852
tgtgtgactaggacttcatcttccaaaggagaatttgccattgggaaaattccaaaatggccagcgaggctgatgaaagctccttcgagggcaattgtaactaaaaatggagtggatgtgtttgaagctgactcaagaagatgggcgcggagagtcgcacattataagagttcattgaacttgaaactaggaacttcatcagttcgtaatgtcatggacatgaatgcattttttggaggatttgctgcagcattatcatcagacccaatctgggtgatgaatgttgttccagcacaaaagcctttaacacttgatgtcatttatgacagaggccttattggagtttaccacgactggtgtgagcctttctcaacatatcctcggacttatgatctgattcacgtgggagccatagaatctctcataaaggatcccgtttccggcaagatcaggtgcagccttgtcgatttgatggtggaaattgatagaattcttcggcctgaaggaactgttataattcgggactctcctgaagtgatagacaaag

SEQ ID NO: 1775 - DNA, 572 bp, Pinus taeda
  Predicted polypeptide sequence is orthologous to G1852
  misc_feature (431)..(432): n is a, c, g, or t
  misc_feature (460)..(461): n is a, c, g, or t
  misc_feature (469)..(471): n is a, c, g, or t
  misc_feature (498)..(499): n is a, c, g, or t
  misc_feature (525)..(526): n is a, c, g, or t
  misc_feature (556)..(561): n is a, c, g, or t
  misc_feature (565)..(566): n is a, c, g, or t
  misc_feature (569)..(571): n is a, c, g, or t
gaacctcctcagcatgctgtagacataaagaattttttggatatatttaaagctgacacacggagatggcaaaggagagtgacatactataagaatgtgctgaatctgaagttaggatcttcaagtgtacgcaatgttatggatatgaatgcaggttttggtggctttgcagcagcacttattgcagatcctgtctggatcatgaacgttgttcctacttatacaacaaatactcttgctgtgatttatgacagaggccttattggagtttatcatgactggtgtgaggccttctcttcttaccctcgaacatatgattttattcatgcaattagcattgattctctaataagagatctgagtagaggtggaaacagatgtagtcttgttgatttgatgattgaaatggatagaattctccggcctgaagnnactgttgttgtccgggatactcctaagnncattgatnnngttgcaaagattgcaagtgcaatacgnnggagtacagaagtttatgacactganncagagtccaatcgcaaagagaaattgctannnnnnaccnngcnnnt

SEQ ID NO: 1776 - DNA, 440 bp, Lotus japonicus
  Predicted polypeptide sequence is orthologous to G1852
gtacttcaaattgaagaaatgtgtcagtaggacatcttctgtcaaaggagaatattctattggggtgatccccaagtggccggaaaggctaactgctccacagcctaggtccacactactgaaaaatggtgctgatgtatatcaggctgacactaggcgatggttaaggagggttgcgtactataagcattctctaaacatgaagttggggacttcatctgtacgcaacgtcatggacatgaatgcattctttgggggttttgcggcagcattaatatctgatcctgtgtgggtaatgaatgtagttccagctcgcaagccgtccactcttgatgtaatctttgacagagggcttattggagtgtatcatgattggtgtgaacctttctcaacatatcctcgtacctatgatctgatccacgtgtccagcattgaatcac

SEQ ID NO: 1777 - DNA, 613 bp, Gossypium hirsutum
  Predicted polypeptide sequence is orthologous to G1852
atccctttcacagcttataatgcaacttatttcattgaagtggatcggttactacgtccaggtggatatttggtcatctctggtccccctgtacagtggcctaagcaagataaagagtgggcagatctccaggctgtggcaagagcattgtgctatgagttgattgctgtggacgggaacacagtcatttggaaaaagcctgatggagattcgtgtctgccgaaccaaaatgaatttgggcttgaatcttgtgatgaatcaaatgaccccagtaatgcatggtactttaagttaagaagatgcgtgacgtcaacgtcttctgggaatggagaatatcctggtgggattattccgaagtggcccaaacggcttaccagaacttctttcaggccttgggcttgaaaaacgggatggatttgttcgggcagaccagggaggtggacatggagagttgcctattataagatactctgaatctgaagctgggagtcagcagtcgcaatgtatggacataagcattttggagtttgcacacactgtttaatcatttgggatgaagtgtctgctgagcatacttgtgaatttgcaagcttatgattcagatgtggaactc

SEQ ID NO: 1778 - DNA, 575 bp, Solanum tuberosum
  Predicted polypeptide sequence is orthologous to G1863
tggatatggttaccagccgccatttacggcggtgcaatggcaggagctggagcatcaagcaatgatatacaagtacttggtggcaggtcttcctgtgccacctgatcttgttgttcctattcgtcgtagctttgaagccatctcagctaggttctttcatcatcccagcttgggctattgttcctattatgggaagaaatttgatcctgagccaggaaggtgtagaaggactgatggaaagaagtggagatgctcaaaagatgcatatcctgactccaaatattgtgagcggcatatgcatcgaggccgcaaccgttcaagaaagcctgtggaatctcaatctacttcccagtccttgtcgactagtatgtcacaaattacaactgggagcagcaatacaagaggaagtttccaaaatagcagcagcggaagcttccaaaacatgccattatattctgttgctaattcagggaattatggaagcactgcaacaaagctgcagatggagcctgtctcctatggaatagataacaaggactataggtatctccatggaattactcctgatgctgatg

SEQ ID NO: 1779 - DNA, 710 bp, Medicago truncatula
  Predicted polypeptide sequence is orthologous to G1863
tcccggcacacaattaacaccaaaccaaaacggaccaaatggttccttccgacaaagctcgatctgagtctggtctctgactgaacaacaactacaagtgtatgttgtgttagctagatagatagatagatacactattgattcactcactcactgagagttacagtacaaagcagttagaaaaagtatgaatagctctgggggtggcagtagtaacggaggaggtgtagggatgatgatgggttacagtaaatcatcaccattcacagtgtctcagtggcaggaacttgaacatcaagctttgatctttaaatatatggttgctggtcttcctgttccacctgatcttgtccatcctattcattccagctttcactctctttcttctaataatttctttcaccaccctattcctaccttgagttactgttccttctatgggaagaaagtggacccggagccaggaagatgtaggaggactgatggaaaaaagtggaggtgctcgaaggaagcatacccagactccaagtactgtgagcgccacatgcaccgtggccgcaaccgttcaagaaagcctgtggaatcacaaactatggcacagtcgacatccactgtgacatcgctgactgtcgctggtggcagcagcagagctggtaacttccagaacattcccacaacaaatgcatttggtagtgttcaaaatactacag

SEQ ID NO: 1780 - DNA, 466 bp, Lycopersicon esculentum
  Predicted polypeptide sequence is orthologous to G1863
atgtgggagatgagtatggcggctgagaatgggtacagaccgccgttcacggctgtgcagtggcaggaattggagcatcaagctatgatatataagtatttggtggctggtattccggtgccggcggaccttgttgtgcctatacgacgtagctttgaacccatttcagcaaggttctttcatcatcctagcttggggtactgttcctattatgggaagaagtttgatcctgagccaggaaggtgtagaaggacagatggaaagaagtggaggtgcgccaaagatgcatatcctgactcaaagtattgcgagcggcacatgcatcgaggccgcaaccgttcaagaaagcatgtggaatctcaatcgactgcccagtccttgttgactagtatgtcacataatactactgggagcactactgggagcagcaaaacaagcggcaatttccaacgtaacagcagtgaaa

SEQ ID NO: 1781 - protein, 396 aa, Oryza sativa
  Orthologous to G1863
MMMMSGRPSGGAGGGRYPFTASQWQELEHQALIYKYMASGTPIPSDLILPLRRSFLLDSALATSPSLAFPPQPSLGWGCFGMGFGRKAEDPEPGRCRRTDGKKWRCSKEAYPDSKYCEKHMHRGKNRSRKPVEMSLATPPPPSSSATSAASNSSAGVAPTTTTTSSPAPSYSRPAPHDAAPYQALYGGPYAAATARTPAAAAYHAQVSPFHLHIDTTHPHPPPSYYSMDHKEYAYGHATKEVHGEHAFFSDGTEREHHHAAAGHGQWQFKQLGMEPKQSTTPLFPGAGYGHTAASPYAIDLSKEDDDEKERRQQQQQQQQHCFLLGADLRLEKPAGHDHAAAAQKPLRHFFDEWPHEKNSKGSWMGLEGETQLSMSIPMAANDLPITTTSRYHNDE

SEQ ID NO: 1782 - DNA, 465 bp, Glycine max
  Predicted polypeptide sequence is orthologous to G1880
gagatctgcaaccagggattccagagggaccagaaccttcagatgcaccggcggaggcacaaggtgccgtggaagctgttgaagagggaaacgccggtggtgaagaagagagtgtttgtatgcccggagcctagttgtttgcaccatgacccatgccatgctctgggtgatcttgttggaataaagaagcacttcagaaggaaacacagcaatcacaagcaatgggtctgcgagagatgctccaaaggctatgcggtgcagtccgattacaaagcacatctcaaaacttgtggcacccgaggacactcttgcgattgtggccgcgttttctcaagggtggagagcttcattgagcaccaagacgcgtgcaacgtggggaggttggggccagaaacacagccacagccacagacacagacaccggcagtgcaagctgctgcatgcttggctcgaacagcttcaagc

SEQ ID NO: 1783 - DNA, 1118 bp, Glycine max
  Predicted polypeptide sequence is orthologous to G1880
gcacaaggtgccatggaagctgttgaagagggaaactacagcggtggtgaagaagcgagtgtttgtatgcccggagcctagttgtttgcaccatgacccatgccatgctctgggtgatcttgtcggcataaagaagcatttcagaaggaaacacaacaatcacaagcaatgggtctgcgagagatgctccaaaggctatgcggtgcagtctgattacaaagcacatctcaaaacttgtggcacccgaggacactcttgcgattgtggccgcgttttctcaagggtggagagctttattgagcaccaagacgcgtgcaacgtagggaggctggggccagaaacacaatcacaggcacaggcagtgcaagcagctgcatgcttgtctcgaacagcttcaagcgaaacccatttcagcactggttccccttggccacaaagcggtactataataattccaaatcccaccgttacggtagtagaaccctcctcatacaccattgtcactgccgaaaccaacaacaaagtccaccccaacctggagcttcagctctctaataccactcctactgcatcatcacaggaagaaagggttcatcaagagcagttgaggattgcgaaggcgaagaaagcgttggcggaagaggcaaggaagcaagccaagaggcaaatcgaactggccgaacttgagttcactaacgccaagaggataagacaagaagcgcttgcggaacttgacaaagcctatgccttcaaggaccatgcaatcaaacacatcagttcaatcatgcttcaaatcacttgccgagcttgcaagcaccattttcattcgccaaccgacgaccaaatcttctcctacataacacaagctcgccaagtacaaaaacatcgtctcaaacccattattaattaactcttaattagacgacatcgatcccttccttcttttactattactactatgtcaagtgagtgctatggttatgtacgtgtgggattaatagccagctagcgaggtggtggaaaaaatgtgggttattattaatgtaaatgtaaattagttgcagcttgtgccatgttatttaaatgccccctatcatatgatgagcaggttttgctgg

SEQ ID NO: 1784 - DNA, 598 bp, Medicago truncatula
  Predicted polypeptide sequence is orthologous to G1880
ataggcttattctattctaatatatcatatactttatatatcaaattttcttgcttaattttgctatattgagtttagttaccatgttagctaatagcttatctccatcttcacttccatcttctgagcctttttcttgcaatgaaaatggcacttcttccactaataaaaggaaaagaagacccgccggaacaccagatccagatgcagaagtggtgtctctctcaccaaaaacattgttggaatcagatcgttatgtatgtgagatctgcaaccaaggattccaaagggaccaaaatttacagatgcatagaagaagacataaggtaccatggaagctattgaagagagaaacaccagttgttagaaaaagagtttttgtttgtcctgaaccaacttgtttgcaccatgatccttgtcatgctttaggtgatcttgttggtatcaaaaaacattttagaagaaaacatagttaatcataaacaatgggtttgtgaaagatgttccaaaggttatgcagtgcaatctgattataaagctcatctcaaaacttgtggtacatagaggtcattcatgtgatttgtggtcgtgttttctc

SEQ ID NO: 1785 - protein, 420 aa, Oryza sativa
  Orthologous to G1880
MVFDHGARVYVDPDAEVVALSPRTLLESDRYVCEICGQGFQREQNLQMHRRRHKVPWRLVKRPAAATAAEDGGAAGGGGGAGGGAGGGGARKRVFVCPEPSCLHHDPAHALGDLVGIKKHFRRKHGGRRQWVCARCAKGYAVQSDYKAHLKTCGTRGHSCDCGRVFSRKITRSLNLYSDIANYLRMKYIISLSNIAIKVESFIEHQDACNSGRVRGEVVPVATTLPVIRPAALRHHHHHPPPPPPELQLLPASTTAPLAAAFSSNSTTTGSSSHEQHATTMTTTKLQLSIGPAAVVAAASGGGGACAAAAGGEEEQQREEVRRALEEKTAADAARERAREEAAAAERALEDARRARHRARGELEKALALRDHAARLIAQVTCHACRQRSLAVMSMAAIDGHGASAVAREHLRGGGVGAGI

SEQ ID NO: 1786 - DNA, 1244 bp, Glycine max
  Predicted polypeptide sequence is orthologous to G1902
  misc_feature (4)..(4): n is a, c, g, or t
agcncggagggggctcgaggaggatgcaagacccaacagcattccaaggagtgaagccaccccagtttcctgaacaagaacaactcaagtgtccacgttgtgactccaacaacaccaaattctgctactataacaactacaacctctcgcagccacgccacttttgcaagaactgcagaaggtactggactaaaggtggcgctttgagaaacatccctgttgggggtggaagcagaaagaccacaaaacgttcttcatcaaccttatcaaaacgctcttctgcaccatcttcttcctctgcagtttcggatcctgacccgacccggatttgcaccaacccggttgatcaagaccaaagggtgctcaacattggtggtggcagtttcagttcccttctagcttcatctgggcacttcggaaccctcttggagggtctgaatccatctgggtcgggtctcaaaatgggtgaatttgtggagggcgtgagttctgacccgggtctgaatctggtttcgggtctaaacccgggtttgcaggtgcagagtactaatgggaggtcagagagttttctaggtttgcagaatggtgattcaagctgttggaatggtacccatggctggtctgatcttgcaatatacacacctggcccaagttttcaatagaagcttggtgatacaagtttgaggcttttcggcttaaatgcttaatccagcttctcgattatggtgattggtcttatatatataatatatacttaaatactattgttgtgttttttcctggttatagaaaagtttagtggagtttgatcttgggaaattcataacaggtttcaccgttcaaaaagcacttaatgtacaggatattcaaattcacattcttgtgaaatatgaattctatcttgtcaactggatcaatcttcgttcatatttactatatgattatgtaaagagttatataatttgatcaagcctatggagagcatgctatggaggatcatacatacaccagaatgtcactgaagcagcatcctttaggtaaagatttttttttctttcaatagtttatatgctcgtgattggtgtttttcaaacttaccacttgtgaaaatttggggaaaaaaaaggcattttttttgtgaggatggctcggaggatgtgagatgttattatcatatgtaatttggtatgtgtttttgcatagcttttgaagtgtcctcggatatatggaagtttacattgaca

SEQ ID NO: 1787 - DNA, 1485 bp, Glycine max
  Predicted polypeptide sequence is orthologous to G1902
gggagattttctgtttctatttgaaggctgcggagtgcggtagagtcatctcgttacaaactcgggccggatcatttcatctccatcaacctctccaacaaaataaatatccctttaccctattttctcgaatcttgtttgctatctcctgactccggctaaatccttgccttttcagccagttttcctccgtcttcccaacctcaatcacacttatccatcacaccccatgtaacaactttctgtctctagctttgagctttttctttttcttttttcttcaaacacaaaacaactttctggaattagttacttctactctcaataaagtttttttttttttttttttttatcatcagcttcatttattagtattttggtcggttctatatccttcctttttctttttgtcttctttccactttcccctcactttgttgtgagatcttgacaacaaagtgcgtgcttgaaaactgaagtcccttttaggaatacgagaatgcaggatccaacgttgttccaacccatgaaaccccactttccggaacaggagcagcttaaatgcccgcgctgtgactccaccaacaccaagttctgctactacaacaactacaacctctcgcagccacgccatttttgcaagaactgcagaaggtattggaccaaaggtggtgccttgagaaacatccctgttggtggtggaagcagaaagaacacaaagcgatcatcttcatccaacaacaacaccaaacgcgcttccccatcacccccagtttcctctgcacccgctccagaacccgaccctacccggattggccccaccccggttgttggtggcgggagtttcagttcccttttggcatcaagtggccatttgggcctggggaacctcttggagggtctgaattcaagtgggtctaatctgaaaactgtgcaaatggaagagtttggggagaatgttagttcgggtccggttgcggatccggattcgggtcggaatcccgggttggagatgcaaagcaatgggaacgcagagaattttctgagtttgcaaaatggtgattcaagctgttggaatggtactagtggttggtctcaccttgctattttcactcctgggtcaagctttcagtaatgacaaattaatgaatatgattactctgatctgtatatttagacatatgtcgtactattatggaggatcacaaaccagaaggcccctgctataggatcattaggtaaagtttctcctgttttggatttttatatttgtgaattgtggttggtgttcttcagctatatcaatgatggaagagaaatggaaagcaagtcatattttagggcagggtatggggggtatatgaatgttgttgtagtgagattgttttcagtctcatcacgtagaggaagtgttgccatggcttggagattctaatttatttaatctatatatgtgtattttacacgcgcagtttgtcaaaaaaa

SEQ ID NO: 1788 - DNA, 684 bp, Glycine max
  Predicted polypeptide sequence is orthologous to G1902
gagaatgcaggatcaacgttgttccaacccatgaaaccccactttccggaacaggagcagcttaaatgcccgcgctgtgactccaccaacaccaagttctgctactacaacaactacaacctctcgcagccacgccatttttgcaagaactgcagaaggtattggaccaaaggtggtgccttgagaaacatccctgttggtggtggaagcagaaagaacacaaagcgatcatcttcatccaacaacaacaccaaacgcgcttgcccatcacccccagtttcctctgcacccgctccagaacccgaccctacccggattggccccaccccggttgttggtggcgggagtttcagttcccttttggcatcaagtggccatttgggcctggggaacctcttggagggtgtgaattcaagtgggtgtaatctgaaaactgtgcaaatggaagagtttggggagaatgttagttggggtgcgggtgcggatccggattgggggggaatgccggggtggagatgcgaaggagtgggaacggaggggattgtgtgggggggagatgggggtgcaagctggggcgatggggccaaggggggggggggacttggtgttgtggctggtaggggaagctgtggggcgggcgggtgggggcgagggcggtgggggggggggggggggggtgggggg

SEQ ID NO: 1789 - DNA, 1063 bp, Zea mays
  Predicted polypeptide sequence is orthologous to G1902
cctcgaggccggccggggctagcgatcagctgaaactgaaacagcccgtcatctaccattcgcccgccgcaacgctccctgctcggaacagcctgcgttgctcgcccacacgacgccacgcatgcaggaggagccagggcgtcgtcccgtgccgccgttcgcgggcgtggacctccgccgccccaagggctaccccgtggcggttgccaaggaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacgcgcaagagcagcagcagcagcagctcctcatcatcctcggcgacgacgacgtcaacctcgcccggcgccgcgcccaaggccacgaagcggtcgaagaactccaagcgccgccgcgtcgcgcctgccccggaccccgccgcgcccggcacggacgcctccaccgccgacgtcgcgagcacggcaccgtccgcagcgacggtgactgcctcggagaagccgagcgcgacggagcacgcagcggcggctgtcgccacggagaagccgccggccgcgcttccggtgtccgtcggcgctttcgcggacacgtccccggcgccagatgctgggagcggcggcgttagggagctgctgccgcacccgagccgcttcgagtggccgtcgggctgcgacctggggccgccctactggggctggggcaccagcgtgttcgccgacaccgacccggcgctgttcctcaatctgccgtgagtgacccgtgacaacgccatggcgcccatggttaactaatcaaccatgatcacacggtcgacgagatgagaggaacagagcacgcagtgcgtcgggctcttgaagctaggcgctgtagtagtctcctaagcttactgttgtctagaccgatagtctcgcgtacttgtgtagttgtgttgatggtttttaatcgccgctttgtactgc

SEQ ID NO: 1790 - protein, 215 aa, Oryza sativa
  Orthologous to G1902
MEVAEGRTVAAAAAGGGGLGGGARTEAEGLACPRCESTNTKFCYYNNYNLAQPRHFCKACRRYWTRGGALRNVPVGGGTRNKVAPAPCTGRRKRAAHAAHAAAPPPTTTASSAPLPLMPPAVAYELPFLPPPPPLPLAAVDPDRRLLDLGGSFTSLLAPAQLHNGHFTTGFLLGTMSSAPPPPPPPATSTPSPAPAAHPPVSDSIWAMGWPHLSI

SEQ ID NO: 1791 - DNA, 2582 bp, Glycine max
  Predicted polypeptide sequence is orthologous to G1927
aaaaaccgaaaaccctcgcaattccccgcgtcacgcgtttctttcctttcaagactctctctctcgctctagttttttcgttccgcgactcagcctttcgaatcctctcacccagagttagggtttttaactctattcgatcggcgatttcgaatactcggaggctcgaatcgtgttgggggttttccgttttgattaaaaaagtttccgttttttgtgttgggtgatcaagggttgtttgatttttttcttgcgatcgagaatgggtgaggcttcgggagctggttccgctgattgtttcagccagatgatgtcgtcgatgccgggttttcgcttccatcccacggatgaggagttggtgatgtactatctgaagcggaagatttgtgggaagaggctgaagctcgacgtgattcatgaaaccgatgtgtataagtgggatcccgaggatttgcctgggcaatctatattgaaaacgggagataggcaatggttctttttctgtcacagagataggaaatatcctaatggtggaaggtctaaccgagcaaccagacgtgggtattggaaagcaacaggaaaggatcgtaacgtgatatgcaattctaggtcagttggagtgaaaaagaccctggttttctacgcaggcagagctcctagtggtgagcggactgattgggttatgcatgaatacaccttggatgaagaggagcttaagagatgccagggtgttaaggactattatgcactttacaaggtttacaagaaaagtggacctggtcctaaaaatggtgaacagtatggtgcaccatttaatgaagaagagtgggcagatgatgacatagtagattttaatattaactcagctgatcaggaggctccaaatgatgttgctgataatggtaatgtaccgctgcctttgcttgatgatgaaatcgacaacatcattaggggaattttggatgatgagcttgtccttgatcagcagcatgtgaatggttatcctgactttcctcaggttgttagtgaagaaacacaaagtactgttgtggatcagttctctgaggctgtgatgttccctgagccagtcagaatcacacagcctagcaaccaattttttgatgcacagcctagctttgacttcaatcggccagttacttctcatctgcatgtttctgaaacatctgaggtcacttctgcttccaacattaaaacaaaggagcttgactttaatgaggatggcttcttggaaattaatgatctcattgatactgaacctacattgtcaaatgttgaaaattctgtggagtaccagcattttgaagatgggttaagtgaacttgatttgttccaagatgcacagatgtttcttcgtgacttggggccaattattcatgaaacagattcacatgcatatacaaatgcccttgtcagcagcaatattgaatgtcaaagttaccaattgctgccaaatccagaggatgccaatcaaactgttggtgaattctggatgcatggtgaaagtaatcagctatcatccccaggtgttgtatatgaatctgttggctttcctacggaaggcaataacaatcaaagtagcactgtggaagatgttgctacaagtagcttgtcctctgctctctgggcctttgttgagtcaatacctactactcctgcatcagctgctgaaagtgcattggtgaaccgagctttgaatcgaatgtctagcttcagcaggttgaagatcaagcacaccaacattgctgcatcaggtaaagacactggaactatgaagagagctggcagaaagggacttccattccttttcttctctattcttattgctttatgtgctttttgttgggtttttgttggaaacttaagactagtaggtagaagtatttctccttgaatatatttatgtaaatccaaagttttgctgctaggtattttgtctgggacctcccagaatgactgttgtctgggatctccccagaattaccaaacagtgctgtcctaacatattctcaaaataaaaaaaaatctttgtgaatactggaggcaatataaggtgtagggtaattctaatgaaccttaattcaagagaaggcgctgtaaaggaatttgcagggtgaattgctaacttgattcataaaaactttagcaagtttttatgcttgtctaatcttatttttggataagtttatttagtttgttctttttggccccatgtaatatattgttctttattaacccggagagcactttattttggagattgattgtacatggataagatcttatcttgtggaatctgtctttgtatttgtaatgatcttttgttggttgtaacttgtaagttgtaacgcctgcattagcattagattaatattgttcgataaataaacatgtgtcctgaataaccggtatgcaactatggatcgagaaccggttatttcatcgacctgcacaattcttgaaactggtgagtagaaaatgggtcaagaatcgactaaaatttgtcaggtctgggtatatttgaaatttatatgtggattattatgagagttacttattattac

SEQ ID NO: 1792 - DNA, 490 bp, Oryza sativa
  Predicted polypeptide sequence is orthologous to G1927
  misc_feature (374)..(374): n is a, c, g, or t
cggacgcgtggggtgccagtcaccaacccattccggcggcggcggcggaggagaccgagatggggagggagaacccgccgctccggtggccgccggggttccgcttcagcccgaccgacgaggagctcgtcctctacttcctcaagcgccggatcgccaccggccgccccaccccctacatcgccgacgtcgacgtctacaagtcccacccctcccacctccctgagaggtcggcgctgcggacgggggacaagcagtggttcttcttcagccggatggaccgcaagtaccccaacggctcgcgggcgagccgcaccaccggcgagggctactggaaggccaccgggaaggaccgctccatctgcaacggcggnggcggcggcaccgcctcggggcgcgcggtggggagcaagaagaccctcgtgtaccaccacggccgcgccccgcgcggggagcgctcggactgtgtcatgcacgagtacaccctcct

SEQ ID NO: 1793 - DNA, 858 bp, Zea mays
  Predicted polypeptide sequence is orthologous to G1927
  misc_feature (45)..(45): n is a, c, g, or t
  misc_feature (61)..(61): n is a, c, g, or t
accctgacccctgaccatggaagaaacaggctgtgcttcagaaancaactccggatccatntcaaaatctgacagtggttgatcaagaccctcaatcggaagctcacggtcagtaattgcatgctcctccattgtagatggtgggctgttggtgttaggaacaggattagcggctgcacccgcaatcactctctcatcgtcgtcatccaaccaatcctcctctcgaaagggagcaccgtactgttcgccgttctttggcccggccccgctcttctggaacagcttataaagcgcgtagaactcccgaccctgcgcagcaggcgggagcgcatcggcaagtagggtatactcgtgcatgacccagtccgtacgctccccgcgcggggcgcggccatggtggtacaccagcgtcttcttgttgccaaccgcccggccgccgccgcagatgaagcggtccttccccgtggccttccagtagccgtcgccagtggtgcggctggcgcgcgagccgttggggtacttgcggtccatccggctgaagaagaaccactgcctgtcccccgtctgcagcgccgacctctcggggaggtgggaggggtgtgacttgtacacttcgacgtcggcgacgtagggagaggggcggccggaggcgatccggcgcttcaggaagtagagaacaagctcctcgtcggtggggctgaagcggaagcctggcggccaccggccccgcggcggggtctccatctcgctctcgccggatggttggtgctggtggcgtgtcgtctgccgggtcaacccgatgctccggctacttatgctaaagacatctcaaggggctgccggttctgccccggccgg

SEQ ID NO: 1794 - DNA, 674 bp, Lycopersicon esculentum
  Predicted polypeptide sequence is orthologous to G1927
agcttcagattcattgattaaggggatattctatggatttctgaagtgggtgttgagattattttgtggttgtgaagaaagatgaagcttttgatggattcatcagcaccatcatcatcatcatcgccatgtaaagagatgaaggtatcggagtgttttggagaaaatagtgttttcccacctgggtttaggtttcatccgacagacgaggagcttgttctgtactacttgaagaggaagatctgtcggcgccggattttgcttgatgcgattgcggagactgatgtgtacaagtgggagccagaggatttgcctgatttgtccaagttaaaaactggggacaggcagtggttcttctttagtcccagagatcgaaaatatcccaatggagcacggtcaaacagggcatcaaagcacgggtattggaaagctactggaaaagatcgtattattacatgcaactctcgtgctgttggagtgaagaagacgctggtcttttataaagggcgagcgccagtaggtgaacggacagattgggtgatgcatgaatacaccatggatgaagaagagctgaagagatgccaaaatgcacaggactactatgcactttacaaggtcttcaagaagagtgggcctggccccaagaatggtgagcaatatggtgcaccttttag

SEQ ID NO: 1795 - DNA, 479 bp, Oryza sativa
  Predicted polypeptide sequence is orthologous to G1930
ccccgggctgcaggaattcggcacgagagcatcgccaacagaaggaagcaagagatagttcgagtcgagttgagttgcatccgtacgtactggggtagaggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgaa

SEQ ID NO: 1796 - DNA, 1881 bp, Glycine max
  Predicted polypeptide sequence is orthologous to G1944
ttatttttttaatctcaatttggacagtccgttaggaaagttaggaacccaattacctgaacaacaaaaacaaaggattcattttatctggccattttcatttcccttggaaactcaaaatatttcaaatttcactctttctttctgcacaatattttcccatctatttttttcttcttctcaaaactcacatattagtattttctcccacaaaatttcagctcataatttttatttttcgatttcatccaatcctgctaatttatttttaatgacgaaatttacgcaaatggtgcaaaggtgaagattttccacatcttgtttcatgcccagctcctcaagctagcttttaattttgatttttctcatttcctggcttaaatttttcatcttttctaaaagaaaaaaaatcatttcccagcagcatagcatagtagtagaagttttgggtgattgagtttgaagaagaagaaaaaatatgagatattgatgtgtggttttactttatgttacgtgtgagtggtactacttctcaagtgtttgaacatggagaccagtggcggtgttagcggcggcgttacgctggtgggatcggatgctccgtcggactaccatgtagctccgaggaccgacaacccggctccggcaagcggatccacgacgcagattccggcgacggcgggaagtgttccgccgtcgccacatccgccacacacggcggcgatggaggcgtatccggcgaagatgccggcgaaaaagaagaggggccggccgagaaagtacgcaccggatgggtcggtgaccatggcgctgtctccgaagccgatatcttcctccgctccgttgccgccggtgatcgatttctcgtcggagaagcgcggaaaaataaaaccaactagctccgtgagcaaagccaaattcgagttggagaatttaggtgaatgggttgcatgctcagttggtgctaattttactccccatatcatcactgttaattctggggaggatgttactatgaaggtaatatcattttctcagcaagggccgcgagctatatgcattctttcagctaatggtgtcatatcaagtgtcacacttcgtcagcccgattcttctgggggcacattgacatatgagggacggtttgagattctgtcattgtctggctcattcatgcccaatgaaagtggaggaacacgaagcagatccggtggcatgagtgtatctttggctagccctgatggacgtgttgtaggtggcggagtagctggtctgttggtggctgcaagtcctgtgcaggtagtggtaggaagttttctggcaggaaaccaacatgagcagaagccaagaaaacagaaacacgaggttatatcaagtgtgacaccagctgcagttgttccaatctctacacttgatccagtatcaattctatcagcagcgtcttccatccgcaacgataattggtctgctatgccggcagaggccaaggataagccagctgacattaacgtgtcgcttcctgcagggtaattaacttatatagggcttcattccatctgaatttacatttgctgctgacaacattgtaatgggatggattcctagttgttggctttgatttccgttgtttgttgtgtctgtaattgttgactgtgtaccgggaccagcattgttttcagaggtttaccagcttcctgttcttgtagaatttgagttggctgattaggtatgcttttaatgctgatgttgtgacatgaacaacactttgatgtgatagttattcatgagaatccatcttccctttggagtgatagattgcgcaatccacgttatttctattaagacaatattcctaatttgagaatgatcatttataatctt

SEQ ID NO: 1797 - DNA, 1534 bp, Glycine max
  Predicted polypeptide sequence is orthologous to G1944
tttctcaaaactcacatattagtattttctcccacaaaatttcagctcataatttttatttttctgtttcatccaatcctgctcatttatttttaatgacaaaatatacgcaaatggtgcaaagttgaagattttccacatcttgtttcatgcccagctcctcaagctagcttttgattttgatttttctcattttctggcttaaatttttcatctttttctataaaaaaaataaaattcccagcagcatagtagtagaagtttttggtgattgagtttgaagaagaagaagaagcaaaaaaaaaaaaaaagagagatattgatgtgtggttttactttatgttacgtgtgagtggtactacttcacaagtgtttgaacatggaggccagtggcggtgttagcagcggcgttacggtggtgggatcggatgctccgtcggactaccatgtagctccgaggaccgacaacccggctcccgcaagcggatccacgacgcagattcctgcgacggcggggagtgctctgtcgccgtcacatccccctcacacggcggcgatggaggcgtatccggcgacgatgccagcgaagaagaagaggggccggcccgagaaagtacgcaccggacgggtcggggaccatggccgctgtctccgaagccgatatcttcctccgctccgttgccgccggtgatcgatttctcgtcggagaagcgcgggaaaataaaaccagctagctccgtgagcaaagccaaattcgagttggagaatttaggtgaatgggttgcatgctcagttggtgctaattttactccccatatcatcactggtaattctgggggggatgttactatgacggtaatatcattctctcagcaaggaccgcgagctatatgcattctttcagctaatggggtcatatcaagtgtcacacttcgtcagcccgattcttctgggggcacactgacatatgagggacggtttgaaattctgtctttatccggctcattcatgccaagtgaaagcggaggaacacgaagcagatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctacccttgatccagtgccaattctatcagcagcgtcttccatccgaaacgataattggtctgctatgccagcagaggccaagaataagccagctgacattaacgtgtcgcttcctgcagggtttgtctttatgtagataaatgtgccgtgaagctgggtttggcatttgctttgaattattttaattttgtcaacggccataatcttcgggcacgtaacctcaatctattgtcttgtatatatataaatgtttcttgaaccttggtttgacacccgttggtttgcaatagttt

SEQ ID NO: 1798 - DNA, 1100 bp, Zea mays
  Predicted polypeptide sequence is orthologous to G1944
tgtcggccgccgcgcccaccccggcggtggtcgtgtccgcgccgacgcccgcgctgcactcgccgctcgggccactcggtgaactggtagcttgtgcttctggtgccaactttacaccacatattattaatgttgctgctggtgaggatgtcagcatgaaggtcatatctttctcccaacaaggtccaagggctatttgcattctatctgccaatggagttatcgcaaatgttacactgcgtcaacaagactcattaggtggtacagttacttatgagggtcggttcgagctgctctccctgtccggatctttcactcccactgatagcggcggcggcaccagaagccgctcaggtgggatgagcgtgtccttagcagccgccgacggccgcgtcatcggaggcggagtcgccggcctcctcgtggccgccagccctgtccaggtcgtggtgggaagcttcctcccgagctaccagctggaccagggcgccaacaagaagccggtgatagagatcacgacagtgccgccggcgcccgtcgggttcaccatctcaagcggggacatggacgacgcgtacagcggcagccagcatccaaggtcggcggcggcgaaagggggctcgaccaccacggcactgttcaaggtggagaactggacggcgcccgtgcccgcgcccgatcaggcgaggaaggcgccggcgccggcgccggaggccaaagtccccgtccccggaggctgaagccgacatcctctacctagctagccggccgaccgtcgatcgatcaggccctgcagcttgttgggaatccagtaattcgtgatccttgtaaccgacgccgtcttagtacagaagtggatcagtatgaatcacccgctgttcatcattaattaggtgtcgacattttcccggtttatatatgtgtggagcttcattacccattgtttaaataacggtgtatgtatactggttagcagtaatacagtcgtcgtagcacagtgcccatttcttctccccccccctgaaacatcaaacaagtaatatacacagcatgtagtgtagtgccttttctgtcagaaaaaaaaaaaaaaaaaagcggcc

SEQ ID NO: 1799 - DNA, 759 bp, Glycine max
  Predicted polypeptide sequence is orthologous to G1944
  misc_feature (5)..(7): n is a, c, g, or t
  misc_feature (612)..(614): n is a, c, g, or t
  misc_feature (668)..(670): n is a, c, g, or t
  misc_feature (685)..(685): n is a, c, g, or t
  misc_feature (695)..(698): n is a, c, g, or t
  misc_feature (708)..(713): n is a, c, g, or t
  misc_feature (738)..(739): n is a, c, g, or t
  misc_feature (753)..(755): n is a, c, g, or t
cattnnnatatatacaagacaatagattgaggttacgtgcccgaagattatggccgttgacaaaattaaaataattcaaagcaaatgccaaacccagcttcacggcacatttatctacataaagacaaaccctgcaggaagcgacacgttaatgtcagctggcttattcttggcctctgctggcatagcagaccaattatcgtttcggatggaagacgctgctgatagaattggcactggatcaagggtagagattggaacaactgcagctggtatcacacttgttataacctcatgtctctgttttcttggcttctgctcatgctggtttcctgccagaaaacttcctaccactacctgcacaggacttgcagccaccaacagaccagctactccaccacctacaacacgtccatcagggcttgccaaagatacactcatgccaccggatctgcttcgtgttcctccgctttcacttggcatgaatgagccggataaagacagaatttcaaaccgtccctcatatgtcagtgtgcccccagaagaatcgggctgacgaagtgtgacacttgatatgaccccattagctgaaagaatgcatatagctcgcgnnncttgctgagaaaatgatattaccttcatagtaacatcctccccagaattaacannnatgatatggggagtnaaattagcannnnctgagcatgnnnnnnattcacctaaattctccaactcgannttggctttgctcannnagct

SEQ ID NO: 1800 - DNA, 518 bp, Glycine max
  Predicted polypeptide sequence is orthologous to G1944
acgaggttactatgaaggtaatatcattttctcagcaagggccgcgagctatatgcattctttcagctaatggggtcatatcaagtgtcacacttcgtcagcccgattcttctgggggcacactgacatatgagggacggtttgaaattctgtctttatccggctcattcatgccaagtgaaagcggaggaacacgaagcagatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctacccttgatccagtgccaattctatcagcagcgtcttccatccgaaacgataattggtctgctatgccagcagaagccaagaataatccagctgacattaacctgtcacttact

SEQ ID NO: 1801 - DNA, 2508 bp, Glycine max
  Predicted polypeptide sequence is orthologous to G1946
attcccggggtcgacccacgcgtccgctaaagtgtaggtaattcgagcaaggcgcaacccaaagagggtgaccacaacctttaattcaatccatttcccctctctctctgttcaaagccacaatctaattaatttcccattcttctccaacaacttagggtttcccttttcccaacaacaatgccacccattccctaattagtaattacgctttttcttttcctattaaattcatttccccgacatggacggcggcgggtccactccggcggcgccgattccgaacgcgaacgcgccgccgccttttctgagcaagacctacgacatggtggaggacccttccaccgacgcgatcgtgtcgtggagcgcaacgaacaacagcttcatcgtgtgggaccctccgcagtttgccagagaccttttgcccaaatacttcaaacacaacaacttctccagcttcgttagacagttaaacacttacggtttcaggaaggttgatccagatcgctgggaatttgcaaatgagggttttttgaagggtcaaaagcacttgcttaggagtattacacgacgaaaacctgcccatggtcaaaatcatcaacaggctcagcaaccgcatggacagagttcatcggttggggcttgtgttgaagttgggaagtttggacttgaggaagaggttgagaggctcaagagagataagaatgtgctcatgcaagagcttgtgaggttgaggcagcagcaacaggccactgataaccagctgcagactatggttcagcgccttcagggaatggagcaacgacagcagcaaatgatgtcattccttgccaaggctgtccagagccctggcttctttgctcagtttgtacaacagcaaaatgacagcaataggcgcataactgaagtcaacaaaaagcgtcggcttaaacaggaaggtatggctgaaacagagcatgctgctactccagatggacaaattattaaatatcaacctatggtgaatgaagcagcaaaagcaatgcttaggcagatcatgaaatgggatacttcttgtgtagaatctttgaataaaaattctgataactacgtgattggtgatgcttcatcatcttccagtggaatggacagtagcagctcttcaggctggacttctggagtaactcttaaagaggtctctccagcttcggtgcagtcttcacatgttccagctgcaactgggactcaagggcatgtcccctcaaccgttaaacctgaaattttatctgtaccacaagcagtagcttctgaaaaagttatgaaagatggagcacatgatccaccttctatccctgtgtctcaagcagatgtaatgatccctgatcttcctccaataacagagatggtgacaggaaatattcttgatattcctgaagaaaattatatggcaactgagacagatgagggatacatggattcttcattgggggctggtgggtcatttcccattgatttcgaaggtatttcacctgatgcagacattgatgatttgttagccaatcctatttgggatgaaattttgcaaacttcagttccagaggatatcgataccaatgtggctgaagcatccaaagggaatgaggtccaaccaatggaaaatggatggggcaaaactcaacatatggatcaccttacagagcagatgggtcttctttcttccgatgcaaaaagagtttgatatctatgatatatgattaatcttcatattgtctgaggtagtccctgacccaaacaatacatgactgaagtgatgtctataatatataattagtaattacactcccacttggtcactgaaaaagacaatgtttttcatttggtcttcaatggctttttttagtttgttgtgcataccaaggctaaatccaactttctcacacgtgcatttacattgatttttcattcgacttcgtgttgaaaacaagttatgaacttatggccttgtcatggcatcctcaggaagtgtttgtgatcacaagatcagtttttccaatgttataggcaatctgtcaagttgagttatatgtgaacgattcggttctttcccaattttcaagtttccttgatgaggggaaaaagagaacatgttgggtgatgattgactgctcaaggcgtctgaaaaatgcacattggaagatttgctttttgaacaagggcggcaacaatggacagcagtggtacgatgttaagctgcaggctgtttgcttcttcgtcaattttattttgtcctttccgaggttatgtttcaactgatggaaaatagaaggaaatgaaattgaatgatattagtccccattgttgaaattgttcataacatgatggaattgaacttgatggaatttattccatttctttttatccaatgctcttaccccctaatttgggtatatggtagaactattttattgtttgtcaagcaatctccttaccattctgtttgctttaatgaaatgaaaagttctattacgc

SEQ ID NO: 1802 - DNA, 940 bp, Glycine max
  Predicted polypeptide sequence is orthologous to G1946
  misc_feature (503)..(503): n is a, c, g, or t
gcgttcgcccacgcgtccgctctattcctctgacttcccatagaccacaatacactcaccccaggcaaaaaatttcgtttcaaaattgtgatatggacggaagagcgagcagcagcgtgggcggagaagcatcgccagctccagcaccggtgccgataacgaatgcgaacgcgccgccgcctttcttgagcaagacatacgagatggtagaggacccttcgacggactcgatagtgtcgtggagtccaacgaacaacagtttcgtggtttggaaccctcccgagttcgccagagatctcttgcccaaacacttcaagcacaacaacttctccagcttcgttcgccaattaaacacctacggatttaggaaggtagatccagatcgctgggaatttgcaaatgagggatttttgaggggtcaaaagcacttgcttaggactattactcggcggaaacctgcccatggtcataatcatcaacagcctcagcaaccgcatggacangagttcatcggttggggcttgtgttgaaggtgggaagtttgggcttgaggaagaagttgagaggcttaaaagagataagaatgtgctcatgcaagagcttgtgaggttgaggcagcagcaacagaccactgataaccagctgcaaacaatggttcagcgcctaattagtaattacgctttttcttttcctattaaattcatttccccgacatggacggcggcgggtccactccgcggcgccgattccgaacgcgaacgcgccgccgccttttctgagcaagacctacgacatggtggaggacccttccaccgacgcgatcgtgtcgtggagcgcaacgaacaacagctttatcgtgtgggacccctcgcagtttgccagagacctttttccccaatacttcaaaacacacaacttcttccgctttgttagacagtta

SEQ ID NO: 1803 - DNA, 655 bp, Zea mays
  Predicted polypeptide sequence is orthologous to G1946
  misc_feature (28)..(28): n is a, c, g, or t
cctctccccgcgcaccacggccaacagnaaccactccgctcctcgccgtaccgggccgggccgggctcccctacatgacgccaccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcgaatgagggttttctgagaggacagaagcatctgctgaagactatcaacagaaggaaaccatctttgcaggggaacagccaaccacagcaacctcagtcgcagaacgctcctgtgccttcctgtgtagaggttggtaagtttgggttggaggaagagattgaacggctgaagagggataagaatgttcttatgcaagagcttgtcaggctgagacagcaacagcaaacaactgaccatcagctgcagactttgggcaagcgtcttcaagggatggagtcacggcagcaacagatgatgtctttcctggctaaagcatgcaaagtcctggtttcctagcacagtgtgttcagcaa

SEQ ID NO: 1804 - DNA, 2635 bp, Zea mays
  Predicted polypeptide sequence is orthologous to G1946
gccggccggtccgggataccctccccccccccgccccctggcaattccattttccaattcccctttcctctcatcgcatacaccagcggcggcgccgggaccccgaaaaccctctccccgcacaccacggccaacaggaaccactccgctcctccgagccctagccgtcccgggccgggtcgggctcccctacatgacgccggcgtgaggcaagtgcttagtggatcgcgctggtgggaggatgcagggcggtgtcatggcccatgccgccgccgccgcggcggccgcgtcgacggtgaccacggcggtggcgcccccagtcacggcgcacgcggtggcggtggcgcccccggtcacggcgcacgctgcggcggcggcgggcaacggcagcgccaccgccgcgccgccgccaccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcaaatgagggttttctgagaggacagaagcatctgctgaagactatcaacagaaggaaaccatccttgcaggggaacagccaaccacagcaacctcagtcgcagaacgctcctgtgccttcctgtgtagaggttggtaagtttgggttggaggaagagattgaacggctgaagagggataagaatgttcttatgcaagagcttgtcaggctgagacagcaacagcaaacaactgaccatcagctgcagactttgggcaagcgtcttcaagggatggagtcacggcagcaacagatgatgtctttcctggctaaagcaatgcaaagtcctggtttcctagcgcagtttgtacagcaaaatgagaagagcagaagaagaatagtagcggcgaacaagaaaaggcggctgcccaggcaagatggtggcctagactccgaaagtgctgctgcttcgttggacggtcaaatcatcaagtatcagcctctgatcaacgaagcagccaaagcaatgctaaggaagatactaaagctagattcttcgcataggttggaatctatgggcaattcagagaatggcaattttctgctggagaattatatgccaggcgctcaagcctttgagagctcttcgtcaacaagaaactctggggtcaccctttcagaggtttcagctaacccaggtttgccgtatggcggcggcggcggcacgagctctgggctgtcagccatctgccctcctgaaatccagtgcccagttgtgatggacaacatgtcgtctaaccaagtgcccagcatgagtgctgtgcctcctgtttcgaaggctacaattgacatgggtattcctgaattctcagctctggcagacttggtgaatgaaggctccgtcgatatccctggaggggcctttgagatgcctggtcctgagtttcctctgccagaaggcgatgacagtgtccccatcgagaccgatgagaccatgtacaacaacaacgacgagactcagagccttccaggcatcatcgactccttctgggagcagttcctggtaggcagccctctctctgccgataacgatgaagttgattcggggtcgccacaggagaacggatggagcaaagtggggaacatcggtgatcttacagaacagatgggccttctgtcatcaacaaatcaccgcgactcagggaatgggctgtagtgtatcttaattaatatacggtagactgggattatcggtaataagcgtcgcctgcagtttttgttatttttccttttggccaaaaaatgatatgccggtatatcaaccactcgctcgacctatatgcgcgggaggggcagtcttccagctgagctctgaatgccacagccacctgcttgtatcaatctatgatgttggcagtcttgagaacaccactgtgacttgttaaatctgtatgcttattcccactctagttgctgatattgtttagtttgttatattggtgcggaaacacgggggttgtttagcaacaaagtataacacgttgctttattacaattcgattctgtacaattccatactccaaccaatatattttccggcaacggaatcaagttgccagatttaaagctttacaatcacgcttacaagggtgtcaaattggtctaatttgtaggaatccacttgaaagattttgttactgtcaaacaggttaccccaaagaaagttgaaaattgttgtttcaagcacaagggcttcatgtaagcacaggttatccaaagcgcgctgagattgcgctgcaatgcgaccaaggagaattacttctgcagtaacccaactagatcatacacgctgttcgtgtagagatctggatggatattgttacgagcatcctgcacttctggtaaggcagtgcaaccagacaaaacaaggagggtcttgcagccggggttctggccaaatagtatgtccgtgtccagtctatcaccaaccatgcacatcccggacgcctccagattgaagcttttc

SEQ ID NO: 1805 - protein, 406 aa, Oryza sativa
  Orthologous to G1946
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQESPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 1806 - DNA, 1690 bp, Glycine max
  Predicted polypeptide sequence is orthologous to G1948
tttttatctctaacataggtagatagttaaaatgcaactagatttacacagaattcaaattatctaaactactaaagataaaatctaagtaatagagccacaaattcattggatgattccttttccagttttccggatatatgcacaaaaattgttcctcgaaaaagttgtggctagaattgttacattgaattaaaataataggaaaagaagaggctccagttaggcaattaggctttggtcccatccaatcgcaaccaggaaatggatgtggttccttatccagtaacacccccaaacctcatttctctgccacatgaaccctcccaaacacagaaaccatagcaaaaagaaacccagattattgattattaataatggaagccatattcgtcaccaaacccgcttcccattctctcctcttaactaaactctctccgaatcccaaacacttgttccctccacaccaacaatcctttcacaacatccgccacaaacccacgcgcttccgccccgtcatcgctgttttccaaaaccaacatcaacaagatgcagctgcagcttccaaccacaccgaagatgagtcctacggcgaagtcaaaggcatcattggaagcagagccttggaagccgccaccggaatggagtacctcatcgagtggaacgacggccacgcgccgtcctgggttcccgccgacttcatagccaaagacgtcgtcgccgagtacgaaactccctggtggactgccgccaagaaagccgacgagtccgcgttgaaaaacttaatcgaatccgacgacggccgcgacgtcgacgccgttgacgccgacggccgcactgcgctcctcttcgtcgccggactcggctcggagtcctgcgtgaagctgctagcggaggccggcgctaatctggaccaccgagaccggagcggcggcctcgcggctctgcacatggcggcggggtacgtcaggcccggcgtggcgaaggttctcttggatctcggcgcggatcccgaggtggcggacgaccgcgggagaacggcgttggatctggcgagggagattctgaaggtgacgccgaaggggaatccgatgcagttcggacgcaggattggactggaaggtgtgattagggttttggaaggggcagtgttcgagtacgcggaggtgcaggagattctggaacggagaggaaagggtgagaatttggagtatcttgtgcggtggaaggacggtggtgccaacgagtgggtgaaggcgaagtttgtggcggaggatttggtgaaagactacgaggctggcctcgagtacgccgtcgctgaggcggtgctcgcgaaaagggtagcggatgaagggacgccggagtttttggttaaatgggccgatttggaggagcccacatgggagcccgaggagaatgtggacccagagcttgtcaaagctttcgagggaagtaacaaccaggcccagcccagtagtaatgggcccgctgtggtcttttccaatcaggatagccctagcctgtgatttttcatagtttgtttggactgggattttgttgcaaaatttcgggagcaaattaattaataattgttttgtaccaaatcaagttgtggacatgaaaaagctaatcaaatccaatacatattttcctcctggttttagatcgtactttgaatgttttagggaag

SEQ ID NO: 1807 - DNA, 623 bp, Glycine max
  Predicted polypeptide sequence is orthologous to G1948
agataacaaattctatggtaactcatccaacaacgctaatcaatttagtttaacacactaaatggctggaagaaaccaaaagagaaaataacgaagtcaccatgccttcttcccctcagtttccccctttgcttgttggtgacagcatggcatcatgcattacaactacagaaaagcatctttctcaagtagctttaggacttcattttgattgtttagcttcgcaacatcgattggagttttaccatccatattctggagagtaactgcagcaccattttcaaggagaagggccacacattcctttctgccataaccagctgcataatggagagcagtgttcttattcttatccaaagcatccacttttgctccagcctcgaggagaacttgagcacattttacctcgccatatccacaggcaaaatgcaaagcagttcttccctctgaatcttcttcatccttgtcagcaccagaggctagtgcatttttcaagccctaaatgtgtaaaattttagctctcaaatatttcaaatcatacctgatgacactaagacaagggctggattaaacaataccataactagatggcttagcaacctaatccacccttcaaaaatgaa

SEQ ID NO: 1808 - DNA, 722 bp, Oryza sativa
  Predicted polypeptide sequence is orthologous to G1948
cccaaccccaatgctcagagaactccagccctctccatcaccgtccctttccggcttcggctccccaaccggcggctcaccgccgcggcggtgttccaggaccagaccaacccaagaaacccagcgagcaagggaggcgacgacgatgaggcgtacggcgaggtggaccgtattgtgtccagccgcaccatcaagaatccggtgttcgcggaggacggctcggccaccacggtcaccgccacggagtacctcgtcgagtggaaggacgggcacgagccttcgtggatcccggcggaggccatagcggcggacgtggtggcggagtacgagacgccgtggtggacggccgccaagaaggcggacgcggcggagatcactgcgctgctcgcggacgagacgctgcggcgtgaccccgacgcggaggatgcgcaggggcgcacggcgatgcacttcgccgcggggcttggatccgaggagtgcgtgcgcgcgctcgccgaggccggggccgacgtggggcgacccgagcgcgccggcggcgggctcacgccgctgcacatcgcggtcgggtacgggcgcccggcggccgtgcgcgtgctgctggagctgggcgccgagccggaggcccccgacgggcagggccggacgccgctggagctggtccaggacgtgctcgcgaagacgcccaagggcaacccggcgacgttcgagcggcggctggcgct

SEQ ID NO: 1809 - DNA, 541 bp, Oryza sativa
  Predicted polypeptide sequence is orthologous to G1948
  misc_feature (421)..(421): n is a, c, g, or t
ttttttttttttttttttttcaaatttgcaatctgaggctaaagttctgctcaactcaaaaattatcaaagcgctaatgatacattttgcagcagcacaaacattttatcccgttctgttatacacagcaaaaccaggaagaatcgaacaccctccgtcgacgtgcgacacgctgtcacccggcgaccggcggcggcggcggagcatcaccgccagcagccaccccagattgccgctgctcgaactcctggaggagttcggcgtcgacgttctcccccggcccccacgtggccttctcgatgtccacccacttgacaaggtactcccatttcccctgcccttccgccgcctccctattgttgacgacggcctccgcgacggcgtactccagcccggcgtcgaagtccttcaccaggtgctncgtcacccacgccgccctaacccacttcctgtcggcggcgttgcgccaattcaccaagtacttccgacacttggccttgccggggccgggcaccaccttttgcactttggcccaattgta

SEQ ID NO: 1810 - DNA, 942 bp, Zea mays
  Predicted polypeptide sequence is orthologous to G1948
accgcggcgcacttcgccgcggggctggggtccgaggagtgcctgcgcgcgctcggcgcggctggagcggacgtgggccgtcgggagcgcgcggggggcgggctcacgccgctacacatggcggtcgggtacggccgcgcgggcgccgtgcgcgcgctgctggagctgggcgccgacccggaggcccccgacgggcagggccgcacgccgctggagctggtccaggaggtgctcgccagggcgcccaagggcaacccggcgacgttccagcttcggcaggggctggaggcggcgcagaaggagctggagaaggccgtgtacgagtgggccgaggtggagaaggtgatcgacggccgcggcgaaggcaagcggcgggagtacctggtggagtggcgcgacggcggcgagagggagtgggtgaaggcggcgtgggtggcggaggacctggtgagcgacttcgaggccgggctggagtacgccgtggccgaggccgtgctcgacaagaggcaggcggcgacagcgacggcggaaggggaggacagctgggagtaccttgtcaaatgggtcgacattgaggaggccacgtgggagcccgccgagaacgtggacaccgagctcgtgcagaagttcgagcagcagcagtcggggtctgcaggcggtgattgatggcggcagcactgcgccaccgtcgccgcaggtgatagagattacttgatgaaggtgattgcgttttattcgtcgggtattcaaagcactgcccgggttgtattttaggatgaaacttttgtgagtatcatattttcaccggaattgcagtttcagccttcccgcttggaaactttttattcgtcgggtattcaaagcactgcccgggttgtattttaggatgaaacttttgtgagtatcatattttcacccgaaaaaaaaaaaaaaaaagcggcc

SEQ ID NO: 1811 - DNA, 765 bp, Zea mays
  Predicted polypeptide sequence is orthologous to G1948
ttgggaccctcgaggccggccgggacggtgtgtcgtgttcgctccacacgcgccaccaccagagacctcccgctggttacaccaatggaggccgtcctacggcatccatcgctctcgcgcaccaggcctccgaacctgaaccctcccacaacgccatctccatcccttcatgcaccatctcttctccgcctccgcgcgcgccggctcatcgccgccgcggtgttccaggaccagaagccgaaggagccagcaagcaagggaggtgatgacgaggaggaggcgtacggcgaggtggaccgcatcgtctccagccgcacagtcagcagcccggtgttcgcggaggacggctcggccaccgccgccgtcgccacggagttcctggtggagtggaaggacgggcacgagccgtcgtgggtgcccgcggaggccatagccgcggacgtggtggccgagtacgagacgccgtggtggacggcggccaagaaggcggactcggaggcgctggcggcgctgctcgcggacgagacgttgcggcgggaccccgacgcggaggacgcgcaggggcgcaccgcggcgcacttcgccgcggggctggggtccgaggagtgcctgcgcgcgctcggcgcggctggagcggacgtgggcccgtcgggagcgcgcggggggcgggctcacgccgctacacatggcggtcgggtacggccgcgcgtgcgccgtgcgcgcgctgctggagctgggcgccgacccggaggcccccgacgggca

SEQ ID NO: 1812 - DNA, 507 bp, Zea mays
  Predicted polypeptide sequence is orthologous to G1948
ccgcggcggaaccggcgggaccaccgccgccgctgcggacgcgggggacgacccagcggcgggggagaagtaaggacgcacgaccggcgcacccgacggcccgaacggcgaggccggcggcgcagagcacgccgaggcggaggacgacgctggggaggaaggcgagaacgaggacgagaccatcgaccaccacaccgccagagagggcgacgccgagggccacaagaaagcgctggagaacggcgcggacaaggacgaggaggactcggaagggcggcgtggcctccactacgcgagcggctatggcgagcaccagagcgcgcaggcgctcctggaggccggcgccgccgaggacgccggcgacaagaacaagaacaccgcgctgcactacgccgccggatacggccgcaaggactgcggcgcgcaccacctggagagcggcgccgccgagacgctggagaacccggacgggaagacgcccagcgacgtggccaagcgcaacaacca

SEQ ID NO: 1813 - protein, 388 aa, Oryza sativa
  Orthologous to G1948
MEAVLRHPSLSRLKPPNPNAQRTPALSITVPFRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIAVGYGRPAAVRALLELGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVNKREAAEGEGKWEYLVKWVDIEEATWEPAENVDAELLQEFEQRQSGVAAGGDAPPPPPVAG

SEQ ID NO: 1814 - DNA, 2513 bp, Glycine max
  Predicted polypeptide sequence is orthologous to G1950
gaattcggctcgagcttcaatttgattccttcgttgtttcgtcctgagagggtcagccatgacccaaaccctctcattctctctctcaccttcccagaaaaccctagaaattaattaaaaccatccaatcttcttttctccatttccccgatttttttttttcatttctatttcaatcgcaacctcctcctccttccaagtcaacgcggatttcagaattctcgatccatgtcgtccgagatcgaggttgtcgaggaggtgcagtcccgcgacgagcaatcgggggcggaggagagcctccgtaatgacgtgtacacggcggcggcttacggggatttggagaggctgcagagattggtggagcaagagggttgccccgtctccgagcccgacggtttgggctactacgcgcttcagtgggccgcacttaacaaccgcactgccgctgctcagtacatcattgagcatgggggagatgtaaatgcaacagatcatactggtcagacggccttacattggagtgcggttcggggtgctattcaggctgcagagcttttactccaggagggtgctcgagtgagtgctgccgatatgaatggatatcagacaacacatgttgctgcacaatatggtcagacagctttcctttaccacattgtttcaaaatggaatgctgaccctgatgttcctgataatgatggaagaagccccttgcattgggctgcttacaaaggttttgccgattctatacgtcttctgttatttcttgatgcacacaggggacgtcaagataaagagggttgcactcctcttcattgggctgctattaggggcaacttggaggccagtaccgtgttagtacaggctggcaagaaggaagatcttatggtggctgataatacaggcctgactccggcacagcttgcttctgataagaatcacagacaagttgcttttttccttggaaatgcccgaaggttgcttgacaaacgctgtgacgggaacagccgccttggaaagatttccaaattaggacttgctcccgtcctttggtgcataattcttgtgctattggttacgtatattcattcagtcatcttggcaacaaaaatgccaaagctgacagctgcagctggccttcttgcatggtttggagtttttcttgcaagtgttggttcggtgatggtttacaggtgtagcagcaaggatcctggttatatcaggatgaatatgcatgacaatcaggatacaaaagatgacgagcctctcttgaagattgagataaataatcctgctttgctagctggaaattggtcccagctttgtgcaacatgcaagattgtcaggcctcttcgagcaaaacactgttccacctgtgatcgttgtgtggaacaatttgatcaccattgtccttgggtatccaattgcatcggcaagaagaacaaatgggatttctttgtttttcttgttcttgaagttccggcaatgttggttactggtggagtttgtcttacaagagtgttaactgatccacttgcacctcagtcatttggggcatggattcagtatgttgctaacaatcacactggtgcaatatcatttctaatagccgattttttcctcttcttcggtgtgtttactttgacagttgtgcaggctagtcagatatcacgcaatattacaacaaatgaaatggcaaatgcaatgcggtatagttacctcagaggtccaggtggtagatttagaaacccatatgatcatggtatcaagaagaactgttctgatttcttgatcaatggttacaacgaagacgttgagtgcattgaagaattaggtaactcagaggagggtataggaatgatgcatatggcaagaagctcgaacttggcaaatggagactcgcacacccatactgaatatgcaagaggcaatggaaatggccatcatgctattaatgtggattccaattccaacagtaccaactccaaaatacatcatggtcatattaatggtcatgttcattcttcgcattgtagccataataaccatggcaaaaccagaaatgacaacgttcccttgggcttgggtcttggccttggacggaacagatctgttacagcctcatcatgatatttacatacatgtctggtgtttgaacctaacctgtaatgtaacataggcacacatctgggttggtttacgttaattcaatttattgtggctcttttctaccacacccccatgtgcaattttgtgctgttacatttagtcgtcctcttatcgttttttctttctactttttgtaactaatttaagttgcattttaaagatgataagccttgaaatctatgtatgaaattcgaatgtatttgctagagcctagaggtcccgccccccttccttcctatggcggttgctacttgctagtgtgcggatgaaacaaatatatatatatatatatatactggtacaacttattctttttaataaattttcttacatatttaattttt

SEQ ID NO: 1815 - DNA, 3066 bp, Glycine max
  Predicted polypeptide sequence is orthologous to G1950
  misc_feature (3048)..(3049): n is a, c, g, or t
  misc_feature (3051)..(3052): n is a, c, g, or t
ccttttttttttttttttttttttttttttaataaaatcatgacggcactaatcttcaaaatcatgcagtgtactgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcagtgtaacaataaatgcattacaagaccatagataacaaattctatggggactcacatccaacaacgttaatcaatttagtttaacacactaaatggctggaagaaaccaaaagagaaaataacgaagtcaccatgccttcttcccctcagtttccccctttgcttgttggtgacagcatggcatcatgcattacaactacagaaaagcatctttctcaagtagctttaggacttcattttgattgtttagcttcgcaacatcgattggagttttaccatccatattctggagagtaactgcagcaccattttcaaggagaagggccacacattcctttctgccataaccagctgcataatggagagcagtgttcttattcttatccaaagcatccacttttgctccagcctcgaggagaacttgagcacattttacctcgccatatccacaggcaaaatgcaaagcagttcttccctctgaatcttcttcatccttgtcagcaccagaggctagtgcatttttcaagccctccacatcaccaacactagcagtatgatgaacaattgattcatcttcatttcccaaatcttctgtctgcatctgccccagaattttcagcagaggcacctgcatctcccgaattggcaagacccatggcttgtcccaacttctgcaaaacctcctcattattccagtacctcatcatagcagcaggaccgccagtctctatctcctccaaaatatgtttcagagatggatcctccttgatgcgtgccattcttttttcaaggagctccacaagatgctatccctagcttcgataatcaacaatatttttcaaccatgcaacaggttatgcagaatcctaattttatgaccatggctgagcgcctgggtaatgcattgatgcaggatccgtctatgtctgccgctagtaatttactttattgacattatggaacttaatccagcatcttcaactcatttcatgaaatagaagtaaagttgctcttcaatgtcatcttgaagatattaacttattccaaggttcattgatggatggaccaatccagtgaaaggatgaatgcctacagccacatttgctccttcaatcccaggaaaaatattttcaatttgttttagaaccaatcttccctcgtgccgaattcggcaccagaagtagtgaatatgcttgaaggacatgcagatattcctgatgtaatcccagaaccaagtacctacaatgatgatttaaggttcaaagccttaaggaatctccatcaatatcaatcaaaacagagtttgagtggaaaccagagccagagttcaatgacacatacattcacctcagcatctggtggtaatactcacactactagttatattgaggatcatagttcagttgacagtagttagttttctcctttcaccaacttgacgcactttaccagatagcagtggtagctccagatcttagggcttgaaaattttgaccagcatggaaccttctattttcacttgtgtagttttctgctttctgaagaggtctccaaaggagtatgagaagatttttcctttcttccttatgtcacccttatttgatttgattttactttttttgtttctttaatgtacaaatanntnnctacaaataaagca

SEQ ID NO: 1816 - DNA, 1015 bp, Glycine max
  Predicted polypeptide sequence is orthologous to G1950
tggcatttggcaaaactgcgaagaagagcagaagaaataccggagaaaagagagttgttgagcagaagagtgttgtgttgtgcattcgcggaagaagaaggagcagatgggtaatccacggaaaccgagtaccgccgacgagcttcacacggcggcaaggtccggtgatctcatcgccgttaactcaattttggcttcaaatcctttggccgttaattccagagataagcattccagaacacctctgcatttagctgcattttctgggcaagcagaggtagtcacttatctctgcaagcagaaggctgatgttggtgcttctgcaatggatgacatggctgcaatacactttgcttcacagaagggacatttagaagttgtccgcgctctactttcagctggggcctctctcaaagccaccacccgcaaaggcatgacttcattacactatgctgttcaaggttcccatatggaactcgtcaagtacttggccaagaaaggggcaaaccttggtgccaagacaaaggcaggaaagacccctttggatcttgctaccaatgaagaaatccgctcctttctggaggaatatgagaagtcagcaaagaatggagaattgggaaagaaagacaaagataaagctgaagaatctgatccaaagacatccacattgggatctgaaggtgatttgagttctgaacctgctgcagctgctattgatgaagaagacaatgtgggagagaagaggaagaagggtaatgaagatggcacaagagaagaagagtcatcacaaccaaaaaaggctagagttaacttaagtcatctccaaagttccgacgatacccaagaagaagaaaacctgtagtttggtattttcatagtagaactaaaattttgttattgtaatgtagtatgtaattgtatctgatttggaatccctttgttgggttagttggctggactatctgttgactgttaagtaacgaccgattctggattaatacaattttctcttgac

SEQ ID NO: 1817 - DNA, 1829 bp, Glycine max
  Predicted polypeptide sequence is orthologous to G1950
ccacgcgtccactgtgagcgagactcggtagtaatagtatagtctacaaggtttcgtattctactacttgaaacctaactcttccttcttcttctacattactcctatggctcccgatgcttccgacgcacttgcagtaaggcagaaagttcaattatttctgaacgcggctcgtactggttcaattgatctcttgaagaaattggcgttgcagctggacgagggcaaggatttggcgaaatcggtggaagcaataaaggacgccaacaagagaggagcactgcattttgccgcgcgagaaggccaaacctctgtttgcgagtacctcttaaccgatttgaagctctctgtcgattctcaagatgatgatggcgagactgcactcattcatgctgctcgtcagggacataccgccaccgctaaatatctgattgaccacggtgctgatcctactgtggctagcaatttaggggccacggcattacaccattctgcggggataggagatgctgagctgctcaagtacttgctgtccaggggagttaatcctgatctagaaagtgatgcgggaacacctttggtttgggctgctggccatgcccaaccagctgctgtcagtgtactgttggaacatggtgcaaatccaaatgccgaaactgatgatggtattactccactcctttcagctgtggcagccagttctctggcatgcttagagctgttaattcaggcaggtgctaaagtaaatataagtgctggtggagcaactcctttgcacatcgcagctgataatggaagtcttgaactattaaattgcttattgaaagcgggagctgatcctaatgtctctgacgaggatggtgtcaagccaatacaagttggtgctgcaaggggctatccaaaagctgttgagatattgttccccttgacgtccaaagtagatactattcctacttggactgttgatgggatacttgagtatatgcaatctgaaactagaaagcagctggatgaatcgataaatgccaaagaaactaatcagcccaaggaagctgattttccggagcaaaatgtccccgaggtggcacctgaagccaaaaagagagcagcagaagcaaagtcaagaggggatggggcttttaaaaggaatgaccatcatatggctatagatttttatacccaagcaattgatctgaaccccattgatgctactttgctatccaatagaagtctctgttggattaagttgggccaagctgagcatgctttagctgatgcaaaggcctgtagagctttaagaccagattggccaaaagcttgttatagggaaggagcggctctgcgtttgttgcagaaatttgatgaagctgcaaatgctttttatgagggagtaacgcttgatcctgaaaataaggagcttgtaaatgcgttcagggaagctgtcgaggctgggaggaaatttcatggaacggctgaaaataaatcatagtttagccttttgttaataccatgtttcagagagaagagatcaaaatattgcgggtggtgcagccttattcacttgatccttttttccccaatgtgtgtgtgcgtgttttctttaactagttactgtcgtataggaagagtcagctagtaatctgtttcattaaattgttttagtaattataaaggttatgcttatttgacatgttccaaaattgttgcagaattagtacacattatgaaaatggcaatgcaggttcatgggtatttctcccatactgttgtaggattcatttgtttaaagttcagaattttttttatagaattaaaaaaaaaaaaaaaag

SEQ ID NO: 1818 - DNA, 756 bp, Glycine max
  Predicted polypeptide sequence is orthologous to G1950
tttttaagaagacccttacacatttttactacctctatcaaatagtaatttaagtagaaacttattcatgggaaactcccaagtcccaataacaagtaacaacattgggcagcatcattatgctgaacttgttaaacaatctaagatttcattacagatacattttcaacccgaaggcgaagttagagaatacaaggcacccctgctaacaagcagttgacatatatcatcatacccccaaattttagccatgtacaaaggggtagcacccctcttattcacagcattaaggttcactcccttctcagccaacactttcacggtccctacatcgccactctccacagccatgtgaagcggcacgtgaccttcccggtcttcacattccaaatccaaatccgataattcactaagcaccatcaacacatccttgtgccctttaaaagccgccgcgtgaaccgccgtcagaccatactggtcacggtacttcacactcccaccacatctccgtaacagcgattccacttccgccacgtgtccgttcctcgaagcctcaaatatttcttctccctcatttatgtttgtatttgtatctgccacgtgtacttgatcaggggcattattgggattggggattattctcaagccggcttcgaggaggaggtgaaccatgtcgtccgggttgcagcagcttggtggcggctccgaggagcgtctcggcttgggtgggtgacaactcggcgagcatggaacgct

SEQ ID NO: 1819 - DNA, 1210 bp, Glycine max
  Predicted polypeptide sequence is orthologous to G1950
ccacgcgtccgtccacgttattttctgaagtctggtgtgtatttgcggcaaggtttggctccaacaagagaaacgagcaatcatatggtatttgatttttagggtggaagaaaaatcagagtgagagaaaaaatcgatggagatggaagtagacatcgagaagaagcaacaagacgtggtgaaagagaaagacttgttcaaagctgcagaagagggcgaggcatcaacgttcgaagctctctcttctgaaatcctctccaaagccctctctctcagaaacgaagacgctcgttcccttctccacgtcgcagcttcttccggtcactcccaggtagtgaagatagtgttgtcttgtgatgcatctgctggtgtggtgaattgtgctgatgaggaagggtgggcgccgcttcactctgcagccagcattgggagtgtggagatagtggagactctattgagcaaaggagctgatgttaatctgaaaaataatgggggtcgtgctgctctacactatgcggccagcaaaggttgggtgaagattgctgaaatgctcatctcccatgatgccaagattaatataaaggataaggttggttgcactccattgcatcgggcagctagcactgggaaatctgagctgtgtgaacttttgattgaagaaggagcagaggttgatgctgttgatagagctggtcaaactcctctaatgaatgctgtgatttgctataacaaagaggtagcccttcttctgataagacatggagcagatgtggatgtggaggacaaggaagggtacacggtgcttggtcgagccacgcatgagtttagaccaatattaattgatgctgccaaggccatgcttgagtgatcatacaattataagaaaatgagaaaattgtcaggacaggaatgtcgaaagagagcagaattgtggtagttatttcgcaatgccataatggtggttacgttcttgacaaattatgttgctcaggcaaaaagttcatctatacccttatgttcttagttgtcaaaccagtttgttttgggtatttttgtgccagctttaaattaaatcaggaagattagaatttttgttttgataatcccctaaattagcaattcagattgtataagtcaaaacattttaattctagagattttaagaactctccgttagttgattttataagaaatggttcattttactttt

SEQ ID NO: 1820 - DNA, 545 bp, Oryza sativa
  Predicted polypeptide sequence is orthologous to G1950
tcgtcggcgccacggcctcgcagcagcagcgcgatggcctcgtaccccatcgtcacggccatctggagcggcgtcgcgccccgcctggtggcggcgtgcacttcggcgcccatgtcgagcagcagctcgacggcctcggcgctgccgccttcgacggcgaggtgcagcgggcggtgcccttccacgtcctcgcactcgatgtccatgcagcctgacccggcgagcagcgcgatcacgtcgcagtgccctttgatggcagcaaggtggagcgccgtcaggccgtactggtcacgtccccggacgccggcgcgcttgctgaggagggactcgaggctctggaggtcgcctcgcctcgccgccgtcatgaccagttcccaccgttccaggacgtccaccacttcttgatagcccttctcgcgcgcgacgtccagtggagtcctcccgcgcgcgtcggtcgcccgcggcgtcggcgcccatgtccaccagcgccgccgccgcctccgcctccccggccgcggcggcaacgtggaaggggcggtcctacc

(The sequence listing continues in the following parts.)

What is claimed is:

1. A transgenic plant comprising a recombinant polynucleotide encoding a polypeptide that comprises a conserved domain that has at least 95% identity to amino acids 240-297 of SEQ ID NO: 28;
   wherein, due to expression of the polypeptide in the transgenic plant, the transgenic plant has greater yield with respect to a control plant that has not been transformed with the recombinant polynucleotide.

2. The transgenic plant of claim 1, wherein expression of the polypeptide is regulated by a tissue-specific, inducible, or constitutive promoter.

3. The transgenic plant of claim 1, wherein the recombinant polynucleotide comprises SEQ ID NO: 27.

4. A transformed seed produced by the transgenic plant of claim 1, wherein the transformed seed comprises the recombinant polynucleotide.

5. A method for producing and selecting a transgenic plant having greater yield, with respect to a control plant, the method including:
   (a) transforming a target plant with a recombinant polynucleotide that encodes a polypeptide that comprises a conserved domain that has at least 95% identity to amino acids 240-297 of SEQ ID NO: 28;
   wherein, due to expression of the polypeptide in the transgenic plant, the transgenic plant has greater yield, with respect to a control plant that has not been transformed with the recombinant polynucleotide; and
   (b) selecting a transgenic plant that has greater yield with respect to the control plant, wherein the control plant has not been transformed with the recombinant polynucleotide.

6. The method of claim 5, wherein expression of the polypeptide is regulated by a tissue-specific, inducible, or constitutive promoter.

7. The method of claim 5, wherein the method includes the additional steps of:
   (c) crossing the transgenic plant with itself or another plant;
   (d) selecting seed that develops as a result of said crossing; and
   (e) growing a progeny plant from the seed, wherein the seed comprises the recombinant polynucleotide.

8. A transgenic plant comprising a recombinant polynucleotide encoding a polypeptide that shares at least 90% amino acid sequence identity with SEQ ID NO: 28;
   wherein, due to expression of the polypeptide in the transgenic plant, the transgenic plant has greater leaf size, greater biomass, or greater yield with respect to a control plant that has not been transformed with the recombinant polynucleotide.

9. The transgenic plant of claim 8, wherein expression of the polypeptide is regulated by a tissue-specific, inducible, or constitutive promoter.

10. A transformed seed produced by the transgenic plant of claim 8, wherein the transformed seed comprises the recombinant polynucleotide.

11. The transgenic plant of claim 8, wherein the recombinant polynucleotide comprises SEQ ID NO: 27.

12. The transgenic plant of claim 8, wherein the polypeptide is SEQ ID NO: 28.

13. A plant cell derived from the transgenic plant of claim 8, wherein the plant cell comprises the recombinant polynucleotide.

14. Plant tissue or plant material derived from the transgenic plant of claim 8, wherein the plant tissue or plant material comprises the recombinant polynucleotide.

15. The transgenic plant of claim 8, wherein the transgenic plant has increased leaf size as compared to a control plant that has not been transformed with the recombinant polynucleotide.

* * * * *